United States Patent 10,662,479 (IMMUNOGLOBULIN EXPRESSION LEVELS AS BIOMARKER FOR PROTEASOME INHIBITOR RESPONSE) - sequence listing, part 4

SEQ ID NO: 428 - DNA, 412480 bp, Homo sapiens
gggaggaggaagcggctggccgctgaggggcggcggggcccggagcgggggacgcgcagggcccggcggtgggcgggcgggtcggcgctgccccgtgggctcgctggggagccacggcggagacccccgccctcaactgaggtaaggaccgcgcggcgcggagacggggaggcggggaggccagggagggggtgcggaggcaggcgggagggcgggactggggtgcgccgggagggggcttggcggcggctctttatggcgaggagggggtggtggcgccgcgccgggagcagtaagtgagctgcaccgccaacaagatctctcacacacagacacacacacgcacacgcacacacgggcgcgcacacacacgcgcgtacacactgggtctccaggcagcggccgtcgccgcatccccggcagcagctccaggcaaagtgacaggtaggaaaaggcatttcgggtcccgcccgaggatgctcccgcccgccttggccctcagggcttgtttgctttccgcgggtgcgtcccggacgcgcgcgcgcgcgcacccggatgcccagcggggaccccgtgcaggtgccgggtgccaggcgccctgtgcgcgcgggaggcaggggacccagacgccatcccccttcccctgcagtcatcgcctgctgggtttcctcagactctctccagacgttcaccctcttctgggctagaaatagctcggctcgacgtgtatatgattattttggttggaaatagttggcaccgtgcaacgcatgtaaatgtgtatgcgtgtggatcttcttgcctcttctggggaaatcatagaaatgattgaccgtttccacttaaaacaacactgacaggcttagcactcattgggggcagggttcgggcctcctaaaagcctgttagtgaaggaaatccttattttcagaattttaaagttgcttttgctttaaccaattagactctgtatagtacaatacttctgagtgtagacttcgtatatggtactgaatcgaagtatggaaatatggaattctctaatttccaagtgtgtttaagtgcaactttatctagaatcataaaactagcattttcctagagagaaatacaactgcccactatagtttccataaatatggatatatctgaaagatgaccctactcttccaactttttttcctcttaacttctgtagtgattctagctattgttctaaaacatgtatttgaaatttaattttggccagaatattcaggaaaggtgtttttttttccatatacgtaatacttagtggtctatatatttaagttataggtatgtggagatagctgtttaataattctttttgtctggaaataacgttattcaaacataggcagctatgtatcattttaaaatgatattgaatttccccttaaagagaaatcagatttataatgtaaacatgaccaggaaaagcaactggtgactttacctggggaggctccaaggaggttaagaaagtatctgaacaactgtgtttttcagaatagaaaaattgtgtgtgtgttgcgggggaaggtaaaattttaactttattcttttattgttttcaagacggctgttttcagaaatgtgtggttgaactgagaccctcatattttatactcttcaaatttgagtggcctcagttatagaatcatacagaagatcaaaagtctagctcagcaggggcatgtggtgtaatccctcactatctgtgttatgtaatccagaatgctgtttttcataggacagtcttgcatgatccttagctggtgtattgatctattatatcatcttccttttgaactgtagtagtttaataaatgattgccatctttggagagcacctgttttcataaaaaatcactttttgaaatggcaaaacatttttattggcacttttatgaacgtaagacttgctgccagacgagtaaccttttgaatgtgacgtattataacatatctaaaggtaccatgtattagcttatggactacacttccttccaactatattattactcaacagttggaacttagttttgatggtattactacccagctctgaattaatcgctgttgaaaatgctgttctacaagtaactgtcaaaacagaatttctaactccatttgatcactgggtgcacatttaaatctgtcggaataactctacctttattttgcaaatgcatacccacgcagaaagctttgttctaaaatactctattggaagttttatatttatatgcctgaaaatgtgagtgatgttaaactgcttacatgtcctggaatcgtgaggcggtgtgtttttgccttatgagataaagaaatatggtagttgaaaaagtgttacaggttaccaaaaaccttttgcaggaaaagattttaaaaatttgtatcacctctgaaatatttcaaccacagcagagtccattcagtgcccgtagcacagctagtttgcctttcccaagattacacacaactgtctttagattaatgtatactgctgactttggcaacatgggacagttatatttggcaatttcagtaaacatggtattttcctaagataccactaacttcattttggggtttgatttattaagaattgaaatgtttgcctggtattcatctttacctcaccctctaagtaaaattgaggtaaaagtgagcttcagggctgctgtgctgttttccttgtgatcacattagcatgctaatttgtgaaaggatgtaacaatataagtgaaattagcttctgagtttagtgtctgaattttcatccccagtttttcagatgtagctggaaaactcaaataacagaattaatgaaaaaattttgcagattattaaaaaaaattagtaattagctgagtttgattttttattttgaaatcttgagagtaaattttatcttttcggattagagcacttaggtaatgtaagaaagattttggatttctcatgctctccacacttaatagtaaactatttttgaggaagtataaattttctttgaaacttaaaattatttagcaggctgtgactaaatttttgtttgtgatcacttataaagtaagggtgaaacagcatgttgattagcaccgccgacccaggtcttttaataaactgtctatctaccacagttgagtccctgtaaaaccaagaacttctgtatttgatatgcaaaattaggtcaaggactaatggagatgctttaatgatcacagttggtattttatgtccagattgaagtttttaaaatagttgcttttcacctcataatatatgaatgtgtaggccatattagtgtctgtcaaggagacttatctgcctgttgggaaataaatacagcttttcatcgctggtgggaggcagcagtgactttctgtggttttgctgttggttttcagatgtgaactgtgtttgcaaggacactgcttaattctcagtgctgtccattccacattttcctatttccctctcatattgggaaaatgaataaacttgtgtagctctttcttctattccttagtatttgtttgtttaatagttttgcttttgataaagcctcaccctttaaagtagaaatactttctcaaattgtaatattatttatctagttatgccttagaatgatataaaggttttacatgttcctaggctgtgattctttagctaaccaagtataaaaatgagtttacttccttgccagtggaggcagacctgggtgattatgcattactgagtggatgagtgtgatgtttacattgtcttggttggaattaagcttgctttgaaaatatcaccctggaataacttttatttgcaaggcccacttcactcctttgcagcaaccactcccaaaccccattttctgggtggaagggtagaaagagtctgggtggaagctcacgactttggatgcttttttatgctgaaggcgtaacccaagtttctagaggagatgaaagtaataatgctgtacctttcaaatctcagctaggagatccttatgttccagggaatgaatgaccagcagagtgtttattttccctgcatgcacttcgtctacttttcctttcctttatcaaataaaaatagttgaaatggacataaatccaaggtttttctctgaacacctctcttactcactacttataaaaccttcaatgagaatgtcacacaccatgtgaccataagatagtgttatcttctcccctttcctgggattctccttcaaagctcaaaggatcttttggtatgcctagggctgggaaattccacctctagctacggaaatacccttgggccaggcaaatcatggctttaagatacattgcccttcttgtcctcccgaacaattaaagcatgtctttggctcccagacatgagtgaattgaagtagccatttccttagaaacaggaagaaaaaagcaacttgaagtaattaattgtaagcagctcatccagagatcagagaccacagaccacagacccctgattttacatttgacatctccctttcttctctagaacaggagttcttcattttagggccaaggatgcagtttggtgggtccacgaatgtggctggcaaatgaattacatctttatattcacttacttccaagtgacaattggggcaggtgttagggctactactagatcttggcatttagtgggttgaagagaaacacatgtattacttcacatatccctttaaagagttattttgataattatatttcaatgagattgatttccattgtacttttaggtatttaattttatatatttaaacatattatgctgggccaggcatgctggctcacacctctaatgccagcactttggaaggctgaggtaggaggattacttgaggccaggagtttgagaccagcctaggtaacacagtaagatcaatttatgcaaaaaataccaataaaaaaattagctgagtgtggtgcacatgcctgtaatcctagctacttggaaggctgaggcaggaggatcgctcaagcccaagagttcaaggttatagtaagctgagatcgcatcagtgcactctagcctgggtgacagagtgacagtctattaaaaaataataataaaatgaaaatatcctgctgaaaagggtctttaagatttaccatattgcgaagggcattcatgacccacacaaggcgaagaccatgtgctcgagaaatgcttcctcccagaggcagctggctgggtgggtgttttcactgtgggtttgcattgagcagtggttgctgagatcttcaggcgttggaatcaggcactgaattcctgacaaatgccctgttttagcttgaatgctgacagatgccctcttttagctgtgtgaccctgggcattcactctgagcctcagttgccctatctgtaaaatgaggagaataaccctatggggcaaaagtgcttggtgctgcactgtgaatgatacagggtactgttactgctgctactacaggtgctcaaaggatcccaggatctttgggtgtgcccaggtttgggaaattccacctgtagctacggaaacacccttgggccaggaaaatcattactttaagatacattgcctttcttatgctcctgaacaattaaaagcatgtttaacaagtgctactgccccttctcctaatggtactactagtattatggctctcatcttgttctctttcataggggtagatggcattgaccttatccatacaaagcagcctgagaaaattcctataaaatttacaagggacacttactttgccactctgcaagtacagaaagtttcagtcaccccacaggaccaccatgaagtaccagatcttcctttggacttgccaagcccagtgactgcatttggacagagggacctaatattaactcagtcctaatagcttcaaaattctgtgactttggtgtttcagaatataattcagtgagccagatgctgtccccagggtatctgtctcccagctaggcttttttttttttttttaaacaaaacaaaacaaaacaaaacaaaacaaaacaaaacaaaacatattaagccatttagacctggagggagaaaggcctccactagaagaattaggggtctctggtgttcaggggcagtcaccatagctcttgtttttccatggagtttctcggagagtactcaacttctctgctttacatagtattataataacaacaacaaaataaaacaacagacatttgttgagcagttaaaatgtgccactttatttaatacttctgacagcctttttgagtgtgtcctaatagcatctccagtttatacttggggaaactgaggttaggagatgttaaattaatcatcccaggatgttaaagttagaattgagactgaaactcaggtaggctgacatcagaactccaacttctaaccaccgtactgtgtattacctgtcattaagctggtacatgctgcagaaagacttgttaccataacaagttttgtgataattattttaagtgactaggctgagatatgacaaaagcttctggcaatcctgctgtgaatatggaattggaataagaaattgaggataaaacaatgcattcttatctaatcctaggtacttctgtttctgcagttgcatgccagaaatccgagatagggagagtactaaatgctaattcgtggtagcctaaacaaatagttttagttttctggaaggccggtttttacctggtgaagttcctcatggttttaatgagggtgtggtgtactctgattcctctaagggccaagtaagtgaaaggcccaagtgtggctgaccaggtgtcagaggccttagggagtggtgaggcttgcgcccatccaggggcccaattgtgccccttcccatggagcagctaccactcgggtctgacaggtttctgccaggtgggcctagggcccaggattaccagtgcctccacattttcaagagaagcatgaaatccagatttatttggagtcttctcattttaaaatgtttggaaataattaaaatggaaaacaaacctgtcagcccatggtgtggccaaacaaagcatgtttgtggtttgacccaggagctcccatgttgagccttttgttagctgtaagtgcttggaaacaccgtgtactagaacatgtcaatagtttttgttttgccctttaatttttttggctgtaaaatttcttataaaggttgttatggtcatttatttccagtgtacatagatttcagattctgaatttctgcttgtttattctctccctataccctatttttccaagctgttggcaaatacacaaagttgaggggggaagggcatgttttttcctcctgtttcatggtgctcctttaaaataagaacacctggccgggcgcgatggctcacgcctgtaatttcagcactttgggaggccgaggtaggtgggtcacttgaagtcaggagtttgagactagcctggccaacatggcaaaaccccatctctactaaaaatacaaaaattagccgggtgtggtggcaggcgcctgtaattccagctactcgggaggctaaggcaggagaattgctcgaacctcggaggcagaggctgcagtgagccgagatcacataactgcacttcagcctgggtgacagagtgagactctgtctcaaaaaataaataaataaataaaaaataacacccaagtgtacagaaataggtgacttcatttatggagacacagaggttctcttgcctgcctcactgatttgaactctaaccagtcacaagatgtcccccctgctatttggtagtagctgtatttgtcctgaaatatagaatacagatctgttcctgcagaccagtgtttcaagatgcagtccgcttaacagccctcattttccttgttgcttttaaatgagagaccacactggatcaaatgaaaatgcagttccttcgggatgtgtttctctcatatctgccaagatgctattattggacaaatcaccaaagccctctctgggatttcttttaattttttttcattggttttttaaaatgatgtaagtaatacattaatatgttccaattgaagtgataatgcagaaatatggaagcaaaatgcaaagtacccttttccacctacacccattcccagatacagtcattggcaatagtttagaatgcctctttccctccttttttctgtacatttacatgtataagtatatatacatgtcattttcttattacatatactggatcatattgtatacatttttgtctgtgactgacttgcttttgtccacttaactgtatatcatggagagctttccatgtcaatatgttagttatcttgttctttctaacattgcataaaatttgatagtacggatgtactgtactttatttaaccattcttctgtggacactattgcaaactgaaagattcaagatctttgttcgtaggtctttgtgcacatgtgtgagaattttttttgtagctaaatttctagaaatggaactatttggtcaaaagcctatgcacacttcaaattttgacagagcactgatgaattgcctttaaaaaaggtctccatgaaatttgtggaacctctgattatgcagctgaacatagcctctaattgcagcatgtcccacattgttacctcgctttactaattcagtaagatttcacttgtatatggcataccaggaagtgattttagaaacagactatgtccttaaaatcccttgaaaatacagttcttaatcaaaacaaattgatcagttaaggggctaatgtaaaaactcttttaagaaagacatatcttgtagaatcagagagttgaaaatctattttctgatcaatttggtgagctgtgaaactctagacccttcccagcagggacatgtccataagcaccctttaatctgttgttagagaagtgaggtggtccacagccaacacagacagatcagacgttgatactggcctgggaaaattaatttcattgctgaaaaatcctatccaggtgtgtttgtagctttaggttttcaaatactagttatttaagaatctcttttgctttttacttaaagaatgagaagattaggagataatgctatttaatgagttttatttaatggatacttgaatttaatgtccttgactcttatttttttatattttattttatttttgagacagggtcttgctccattgctcaggctagagtgtagtgatgccattatggctcactgcagcctcatcttctgggctcaagcgattttcctgcctcagactctcgagtagttgggaccagaggcgcacactagcacacctggctatttttttctgtttttgtagagacagggtctcgctatgttgtccaggctggtgttgaactcctaggctcaagcagtccccccacctcagccttccaaagtgttgggattacaggtgtgagccactgcgtctggcctggctatgtttttttgaaatgatatgttgataaaggactatataaattagaaactataccttcttttcttttcttctcttttcttttcttcttctcttcttttctttcttttctttctttttttgagatggaatgtcactctgttgcccaggctggagtgcagtggtgcgatctcggctcactgcaacctctgcctccctggttcaagcgattctgggttacaggtgtgtgccaccaagcccggctaatttttgtatttttagtagagatggggtttcaccatgttggccacactagtcttgaactcctgacctcaaatgatctgccctcctcagcctcccaaagtgctgggattacaggtgtgagccaccacgcctggctgctacaccatgttttcttttaaagagatattgggagaaatattgcaggaaatctaggtcactgattgattcctaactgtgttcagaagggactactttgataactgtaattgttattaatgatatgaagtaaattatttgtgaattttaccacattccttgaaagactgagactcagtcagggttagtgagtcttgattagataaatgacagcaaagtgaaatactgtttctgtttcccaaagatggatttagtcctttcatctgtttctccagatactcattttttaagaaaaattctggtttggttggcagtgacattcagattctgattgtatgccttctgcatgtttatttttacaacacactgtgaattgtagaaatatggtgggacagtcatatttccttggcattgaaaccttgcatattcaagaaagtctgtgctaggttttgctcatggaaatgttatagtgtttcacagtttacagacaatttcctttgataatgtctgtgaaagcacagtggagggcaccacctggtcactctttcaacctgtatcattcagggccctgctggggaacagatggcatgtgtacgccaagtcctttgaggagggcttgttaaagggaccttttgcaaggtgtgggcaggtgtagggaatacaatcagggtgaatgctaaagaaagacccagcagtgacggggagttagtcctactctaaggaaggggcaagaaaggctgacaagagctgtatccctttctagagggaccccgtctgcctgtaatatccctccagggagacagaggggaatatatataccttcctcactctctgcctgtcccctaaacgctggctagtgtcttccattagccgaacccagacagaagccagagggcaggagagaggaggaaaagggtggaaaaggtaagtgaatgggtctgggaaggccagtagcagacccccacccatttgccctccagaacagaggtttgcatggttgagtggtcagtccagggtagaaagcttatgatctggttttgtggacaaagaaaataaaactgcatctacagtgattaaattgaaattgaaattgaaattgggaattttctacaataccacatggctggtatcagtaaaatttgtggtgggccttagagtaacattaaaaaaattttttttttagttccctttggaagggattatgctttatgcttcttgggaaatgcgtagaatgggaaatgttatgtatttatctgattaaccaaaaatgtaggcttatagataggacagacagaagggattcataaagtctctcagcatggagttggattcctaagatagatataattcctttgattttaatattttataaaaatattttatttaaaatgtcaggtacctgggggaagagactaggaggaaattaaggttattaacagtaattttccttcaaggaagtcaatttaacagaatcattagcatcactgagtataaatgaacaagctgtatttccccatttgttcagcatggcagcaagactctgaaatttcaggctcatttattctctcattttcttggccctgttgcttgaaaggtgaagtctgctctttggtttgtgtacttgtcctgaatgaacaagcaatggaacttaattagaatcataaaataatactgctataaggtatatcagagttcatttcttcttacctccaaattgtgtgcagtaagaaaccaagatactagtcattagcagctactactttgcaagttctcagagttggtcactctggaaaaatcatatcacctctccatcatgaaggaattgcactagattaattcatttttgcttttacccttatatattcctgaagtccttgattccaagggtttggttgtccattactcactattttcatagattagaggcagagcttcttgagtacctcttcattacttagcccttaaaatggtattctctggaggtctctacattgcttttgactgtgttcactctgtaaactctttctgtataagataactcattcacttctaccatttttataacccccaatttactgaagactcccctatcactgacctcttgtcggagctccagatatatcctgttgtctgctggagatcttgacattgaagtctatggggactttcaaatcaaagtgtacaaaacaggagtcctcaacttcactccaaacttgtgtctccttccggtttctaaatcttcatgaaacaagctatccatctgttgagtctaccccatcaatatccttcatttttgttcacttttctccattcctattgccgctagcctgaatttatgtctgcagaatttcctgtcttgattgttccaagaatttttcattcagtctctctatactgtctctttcttatctgtgcctccattcatgtcttctattggctattcagtgagcatcaggtactttaacagtgagatcttgctctcaggagtttacagtttactggaggagacaaatagacactactttataagtttacatctttgcccgttgactccattctccaaaccagctaaagtaatttgcacaaaacaaatcttattatagcattacctctaagatacttcaacagctccctgttgctatcaggattaatttgttttcctaatttgccaaatgtaagccatccctggcctgacccctgtgatgaagttttaactcctttatttgcatcacctatactaggctgtgttgaaatccaagaacataaagcctgctgcactgtggacactgtggctttgcactatgactttgcactcaatccccttcttcaactggctgactcctacaggcctttagagacttcatacagttgtcatcttcctgtaaagccttccttgatttccactccagtccagattgggtgccctactttagtcctcctgttgaacagtttgcaaattttagccacagcatgactctcttgggaaatggaacaatctggtgcatattagtgactaagttgatgtctcttaaatgaataaataaccaaatgccattattgcaaagcctgcagattgggtaaattaggaaaacaatctgatgattaagcaaaaaaaaaaaaaaagccaaagtttagtaaaccgaagccatctgcagacctattaaagaaaaaagtatttcatgattatttacactggtcattgaaaagtagcagaataatcaatttggaaatatgataagtaatttgaaaattctatatccattatttctggtaacagaaatcctgatattgtaatcagtatactagatccagaggagacatttccctgaagataagttatcatttttttcctgataggcacatactcatattgtttttcctattttatgagttcgattttaatcaagttattcttatttttcttaacagtgtgttataacctggaattagaaaaaaaatttcttatttcaaacttggttggaaatttaggaacaaaataatttatttaatcagattattttattaagtgggactcttagtaatttaaaatgctttgtattcattttcttgtagcattttcttttcaaaatgacctgcaagtacatcagtgccaaacagagaaagcaagaaagccattaattaattgaagggaaatattctgctgaatacaatactgtttttgaaagaacatgttttatagttccaaaaccagaagggagcattttattcgtagtggtttgaatcttgtgaaaagagtgtctttgacagtcttcaccaggcccccctccccaagcttggagcattaataggacttaagaggtgttttcttcacatttggcttctttttgatttcacagatttcttttagctttgtgtcgaaaagtgctaagtatgttaattattagatatatcattattcacatttcagtgcagacaacatttaggaggattatagtttagttattacagcttttcagaaaacacttcatgatagcacttggaaatacagatagagaatatttccttttatttagagactttttggacctgtgaggccctctgagaatcttaagcttggccccattctgtccatttttcatttcctttgaaagagtttcaaagtaactggttaaagtttctccccatctgccataagtagcatagagggatttcttgtgcagctaccaaagggaaatgaggaaatttaaaagtgcagatgatttgggtattaacacatatcctggcagtggctctgccagaatcaggctctcccaaaccattttgttttatgttaatttttattttctcagctacagtattataaacatggcagaccaacaggttttccataaagattgatgatcaggaggaatccactccttaattaagagcagcagatgccttctgaaaaccttctggaaatgttctacttaatattgaaccaaagtgcttccagctttgttggaaaggttaaggcaataattacatggaaggtatgtctcatttgtcaacagggtttttggtctagaatatctcaagagcagttcctgtccatttccttctagaggtgacagcagccttcttattgcagaagggttatggtgcagggaacataagtgcttaccaataactgcttcctatcctcacacaggatacgagacacagggtatgagaccctcagaaaggaagtctctttctctacacacacacacactcatacacacacacacacacaccgcaggtgcttgagccacactgtggaatgggatacataagaaatggagccaattctttgatatttttgtctttactggatggctttgcaatattttaaaaatgttgaaacttccaggattctttaacaccgggcccctaacccattatttattaggcttaggcattgtgccctgggccttcagaatacaatcccatttcattctctcagcaattctgcaggttaggtataattacgaccattcgatactaagaaaactgagtgattacagcacttactgagggtcacatggttcatcagtggtatagacaagtttcaaaataaggttgacctgacctgaatctgaatggctgcatctgtgaccatacaggcacagaggaaaggccatatgaggacacgggagaaggtagcagtcgtcaagccaaagagagaggtctcaggagaaaccatgcttgctggcactggcaccttgatcttgaacttctagcctctggaactgtgacaaaataaatttctgttgtttaagctagtcagtctatggtatttagttatggcagtcctagaaacctaatacagtggagggtttcttttacatgcagatgaaagcagtccttgtgatacagaaacaaagtattacagaccaaaaatatcagaataataattttggcatttgaacacatgttcctaatttcaaaaggtgatttttttcttgagttggtttagtttagagagtatttgctttcactgagctttcataagagttaatttgtttacaggcagagatgagataaatcatgtctttctttagcctgtttctttatctgtttctttttttctacatgaattgcacatacttctttaaggagtcttataattaaaacatgttaaatgagctcaaatctttttccataattaggaacttgaatcattgcctaatttgtaatttgataagtaatgtgtatttgttgaatttttctgctatcaatgtaagtcctggggtaattttctaaaacaaaataaaaatggttttggctctgttttcttaacatattaacagtagtctaggaaatattttaatttctctttagttagttggtgctttctctttgtaatttttttttttgtgtggggaataaattatcataagacattcattaagtgcattgtagtgttttgcttaatttggtgcctgtcaggaaaaaacccagcagcacaatggaggtgctatgaatgagttattttatttattaatttcaatctaaatttatcaccaatggagaaataaaatatttgtagaattgaggttataaaacagcaaacataactgctgaatgatttatattcagtacattctttaatataaagattggatataaagacatcttcaatataaagcatgacattgatttgctttaaataaaaaaagaatatattttcacaaggtcaggagattgagaccatcctggctaacacagtgaaaccccgtctctactgaaaatacaaaaaaattagccgggcgtggtggcgtgcgcctgttgtcccagctgctggggaggctgagacaggagaatggcgtgaacccgggaggtggagcttgcagtgagctgagattgtgccactgcactccagcctgggtgacagagcaagactccatctcaaaaaaaaaaaaaaaagaatatattactttttctttttccaatattattacttgagtgagctttttaaacagtatggtgctattttattagttaggtaatgcatacatttgattaagtgtgatatattttgtttaaaatactattcagaacctgacatagctacagcatagaatggggtcacataataaaggttcttctcctttacatatgtgcgtgaactttcagtgagtcacatgaaatgaccactggtttggtcatttgagtttatttgaatacattagttatgagctatttagttctttcaagcagtcataattcattctcaaattttaaatcagacatgtactgtagctagcacgtagtaggcttttaaatgtgtcctaaaactaatatgtaagatgaggacatgggccacaaactgttattttgctttccttccttatttcatggttttgtatatcttattttggatttgtatgcattctgctgcttctaaaattagtatctaagcaatgcattttttaacattaattatcaagttttgtcttacttttaaattctgccttatataaggcagcataagtgggcattactgccttgctgacacctactttcctggggtgaaatatattgaccttgactgtaaccttgacatttaagatagttgactagactctgaaaagagaaagaccagcgtgattgtaaatcacacctatttgtataacatcctcaattacgtaataaaaataatccagaaaattgccaagatacttgaacatattatacggggattggtcttagaagcacagacttacccatgggaattagttcattttctgaagagtccttcaccaaactgaaagttgagtttacagtcctgagaatgtgatgcctctttggttattataaccacaaaacagtggaatggctgtttcttcctttaagcaaaatgatatgtttaaactctttttttgagggatgatttaaaatgtgttaattatgtggcttcatttggaatataagagatgatataaattaaattatcactgaaatttttaccctgcctgcctcactcactttgaccttaggaccttacaaagagtgagaaaaagccatcatgatgagaaaaagtgatcatctcaaactcgtgtatgtagatgaaaaaggatatatgtttctgtgtgaggatcccatgtagaaatacctttataaagttacttgcaactacagcatcggtatattgggaaggaaatgaacattttttgaagtgtcttgtgaaggtcaggaactcctctagggactctcctttgggaggaagtttagcaaaatggttgtgagcgtgtatgatgtgcattgtggggtcctggctttgctactgagaagccgagtgaccttggtcaagtcattgacctcgtcctccttatcatcattttttatatctatcctgtgagataggtggcagtatcctcattctacagaaaaagaaactgaggcccatttaagtaacttgttcagggccacataactagcaagttgtagcgcctcagctggagtcagaccctgctcaggattctaccctcttctaccccttccatgtggtcttcccctccttccaaggctgtgtttgcctagctaccaagttgacagttttgatcaaataggttggttgctttcatgttgaatgagctcagattaggagcaccgatcatagggaaaaggtttcgaaaaggaaattgggagaagtgacttatagctggccattgccctagctgattatgtgttcttgagcaagtcatttcacatcaccggtttaaatgaagggcttaggcttctagaactatttcttttatatttacccttttatcatcatgaagtgtttctctttgtctctagtaatcctctgtgtggaagtctattttgtcttattaatatagccagttcaacattattttgcttactgtttgcatgatataacttttttcatccttccaacttatttgtgtgtttccgtttaaaatgtgtctctttgtagagagcatatagttgattcttgcttttaaaaaaatctattccgataatctttgccatatagatggaatgtttagtccatttacatttaaagttgttgacataattatattctgtggttaacattttatgaaatatattacatttgcattttgatatttctatatcttctcagttttctttcagatttaactttatggaaaaaagtcacaagacttattttatactatacatagtatactatacataggttgtatacatagtataattggtttgttggatgggccacacttagtgagacataaacagaaaatagctttattctctcctctcctgtactttgaatgattttttttggcagatcctatagcttttcagtcattttacagtattggaacaacctaattttcaaatattagaaaaacatagtacaatgtaaatcaaaacttccattttcccatccagtttgtagcttctccccttttttcattcttaggcttgagcccaggcttagtgatcagcagtagggaagaaaaggaattcctggtttaactctcctctcttcctctcctacacattatctggctcctccagagttgacacgggggacataaaaggggccaaggctattgcacgtagcaggtgctgtttgttttcaaggccagttctttctcatacacaccctgatggattttttggagagcccttgcaggtccattggcatcatgccattatttgctttgagcactgcaatatcagctcctcatattccagtggaagatcactggagtgtctctgtgtccttgtccaggcagcccactcagatggaggcttttcaggatcattcaaacatgacaaccttccatagtattcacaaggtccacaggaaaactctcatcttaacaccatcagaccccgagggcacagcctgcttctacttctactggggctctgttgccttgcagatggcatcagccagccaatctgatgcacaagccatggtttctgcactgaagcaggcatccaggcagggaatagaatatcagcctctgtcattgcagatagcctcaatttattatggcttttcttttcttttcttttttttttttttttttgccttccttatgaggtgttagagagagaaggaaagggatctgttgaattttctttgaagagtttgctgcagtgcagttcttctcatacacagactcttggaggtgatctctggactggcttggccatgtgtagcaagtcctgtggacatatacaaggaactcatcatatcacctttggcattgaaacattagcagaaaattgaaacaatattcccttttctcatcattagaagaatttagagatcactggcttaatagtaagatgcacagataagtgttaaaccttcagctacatttataattcgtgaactgccacactctgtaagctcctaccttcacagtaatgagaaatactaagtaccaaataaatgcttaatgaatcaagtcatggtgattgcaggatattggtctctgggaaaggtaaaggtgaccaatataataagaggaatgaggttgctaatctgtaaaattctttactgatttggttaaacaatgggtcacttaagtggaaaaaaatagaattcaaaactactgttagccttgtcaaactagttggtcaggttggcctatataaaacctgaaactggattgacaggcacttctgctggaaatctctaaacagtacagatcatataggtatattcataaatgtatatatatgtaaatgtgtacttttttgaggaatatatatatacttttgcatatatatgcagacatataaatatgtattttatagactaatataactgtcagagaaatgacataatgatgtcatataatatataaaatataaaaatatactttaagagttggcaaataataaatagcacagataaaggagaatggtttggaacaagaaacaggtaatttcccctaatttttggagcagaaatagatgaatatgaaatgtatatatcagttcattagttagcttatttcaaagtacaaaatagccttaaaagatttaatgtgattttgtaccagaatttataggtgacaatatgataagaagttactttaaagttataaatttaattttgactagttaattatcaatatatttaaaaatatattaacatgtgctttatcctaattaaaaggagattatatctcagtagtgtctaagatttttaaaaataactttggtacttataaaatatgtgattatgtaaaaaatattggaaaataacttaaaagcacaaagaagaagggaagaaggcaaaactacctttaatctaattataataggtggtaaccaatataggccagaatgagaaacaccagattgctttttgtttattgatacattttttccatgagtgacaaaaattggtcttttcatggtagaacttcctttgatctatatttaatcagctcacttaattttctgtttaaaactaataattcctttcatggctagactttgtatgtaggaagtggttctaagattgtgtccaatatcatcagaaatctgcttaatataactcctaaagctttatttgtagactagatatttgtatactatttggagcctttgtcagctgttaggaattattttaagatgtggagaaagaaataaagttagctggtgaataaggaagtattttcacacttgatcctgtttttagttttaatcctggaattgcttatagcagttaatgtggacctcaatatttcattttgtaaatgagcagtgtcagtatgatggtggggttaaatgcaagggagatgcttttgtcctacttttcaaggtatactttaagcaaggtaagcattcgtaaaggagtcctaatttactagaaagcttgaagttttggagcagagattttcaaagaagttgtacgcagagttctttctgagctatggcctgatagtgtctttgtgaaagtatcttcttcccatttcttttgttatgaagcctgttttttaaaatcattggcctttggtgaagattgaacacattgaaaaataactgtataggagaaaaactgtgagtgttatagtgttatttaattgagaatactatttatgtgtgtgtgtgtgtgtgtgtgtctgtgtctgtcatgggaaagtattgaaatgatgcattactgaagaaaaaaggatttgtttatctttccaaagagaatcgagctattatttgggaaaaaactcaacatccttttaaatcatatttttttcaaatgtatgtgtatgggaaatcttaaaataatagataactaactaatagaaagggggagggaaaaaatggaagtgtgctttgtcacccgataactatcccaaaataagtttggcttctaacacatttttagtgtgtttttttttttttttcaaatgggtattagatagcttccgtggtagaagtgaggacttgcagaatactctgtgttactaaaaaattgctggaaaagttaacctgaaatggcagagtaaagaagctcatgtttaagctaatatactccagtaacttttgcatctctgcacgttcatcacagactgtgagcatattgtgtataaataattaccaaatgtttcgggggtggtgattctatttcttctccatgagaatttataaagttgttaaatttggtttctttggagtcatcacagtttatttcactgagatgtttactggataaatattttcacagaagttttcatcaacttcaaagaggtagtagttattcaatgcaaagtattagaagcctattgcaatatacatgcaatttgttttctttcgacagtagacttgtttctctttttggttcaaatgaattcattattttaaactgcttcaatcaattcgatatgttgtattcatagacacagtgggttttatttgtaagcctccccagagaccagggtccccagggtcttggtgccacatgttctgtaaatgtgacaggagagctggggtgtttgtaccatacatgggagagggctgatttctgagagaaactaatgctgttgactcataagtttctttttatcatttctaggtcatacaagtacatggtagctttaaaaaaaaaacatgccataggtatgtagagcctttataagtctcgacaactgtaaaatgagctagagaaagtcactatctgggtcatgtggaaccacatctggtttatgatatgggcatgtagtaattgtgcttgagattacagtggagcctcacctggcttatgtttttggccatagactgaaggttcctttgaatgttccctcagctaatgtaggtatgcagtttataaataatattttcataaagacaaaagtgagaagcagcattgtacagcagaaatgtgagagctgactttcctaggttctgaccttcctaggtttgagtatccagtctgtcttttgctagaaaagtgacctcaggtgagctccaaagctccctctgaacttgtcctcatgggaaaggggagagactagtgcctaactggggagcggtgaagactgcatgaaatactagatgcaaagtgcctaacacctcacctggtttatacaacaatagctacctgttagttgtagttctgttcttttctttctacagacatttgaccattaaatacacaattatttcaacccattattatatttctagaagtgatgcttacagatttttttttctttttgagaactgcatgcttttcataaagtctcttggaaaagtaatctctatgtagttttgcttcttcattcattcagcatttgtcaatacttgttactggcttgcttcctgaggtctaggagtttatgttgtatcaagagagatctacagataatagaagttactgtagaattttaagttccacagaaggtgcatttctgaggccctataaagcagcatttgaatcaggtcagctcttcagccctcgagaggtattttcatgttcttgttttctgttttttagtgatgttccatttctggtgtttaatctaggcatgccactaaatatttacttttctttgtgagacaggttaagactgtcttaacttagaagattcttcatttctttggtcactggaatagcattgctgtcttttttgtcatcattccgttttgcattgttatcattctcttttgcattgttaatatcagaatgtaatggtccttaggaaagcacagtgtggctcggtagagtgatgtgccttgttgtttctgatgcttttttgattctctctgaagcctgttggtgagcctgttgggtgagacatccttagtgttgacaagtgggaattgttgatgaggtttccactgcaatggtgatgtatctgttactgagcagttatagggtgcatcgcagttagttaaaataggagcagcttctcaggatacagaagggggaaaataagttattgctggtgtatatattagaatatttttggctgtgagtgatagaaaacagcagcctaaactaacagaagtttaagagaaatgcacgcttgggaatctaagcattttgggcagatgtggcatctcagcagtgccatcagggaaccaggttccttctgtctttctcaccactccttatcatttagcatttatttgtcttcataggtgtgagatggctctgcaccactcaggagctatttccaggaaatgagggattgggacttgtttacatcatgagaatgaactttctcagagctctctctcttgtatctcattggtcaaaactgtgtcatgtggctatccctagctgccatagtatctgggaaagcaaatcgtttcagcttagtatattggctcgtaacgctataaatgttggctaaacaaatagctatagccaccatacctgggaattttgtttttgtcacatctactagcttagttttagatttcatgatttggtaagtattagatgctacttcattcattcacttatttgacacatatttattaaatgcataaggccttaggatataccattgcaaatttaataaaactagtcctcatattatggctgcatgaatgtaaaatatctaagtatggttgcgagctaatggatgtttctcttagctcatgtagtaaatggctagaactgtgattttcaaattgaaaacaactgaattttgtttagctgacctccgtcatgtaactcgttcgtaattattaaccctaccctccctcctctgaccctcagtccttttactgataaatttggaagcctgcctcctgaggctgagttgctctggttttcccataatactcccttttccagcttttatatgcttacccattaagtcagacaaatttccttttcagagtttggcattgtttctttattggaaaggaaacagattgttttaggccaggaaagcttgcaaaagaaaatagaagaccatgaactatgttttttattttcttgtttttaatcatcacatctcacgttaggatttagtgttagatctcggtgtgttttctgttcagagggaatgtgaggttcttctggcacctggtttgtctttgatgtggggtaggcacagctttacacatggtctttccccaaaccatgacataaatcctgctttttattttatggcgagggtcaggtttccagtagtggcatctggcggggtcagtaaatcaaattcctgggctgtgaggatgattttacttgtgggtgactttccctgcttgttgtgagagctcagctttagtgtcacatggcccctttttggctctttcaaattttagtcaaattgcgtggtataatccataaagtgcccatcttttgtctgtttcacagtgacagatcactgagctaggataagcaggtagcagatctgataatttatatctgtggccccaaatctttgccatgaataaaggatttttaaaaaaagttgtttcctcttggatgttggcattagaaagaatttgttcatgaaacatcacattgatactaatgatatgttattcatttccccaattacatgaatcaaaggtgtatttaactacctacaatttctgacaagaatgagataaccagtgttcctatgttgatgttacttaattgaaagcaggatacctaaaatcaaaaaagaaacagaagatttattgcaactaaatatatatttgttatttggctttggaatattgaaataaatattcaaagccatttttataatttttttaaaccatacctataagcttttcatttttcctagtgtgatatttgatttttaaaatttttgcctaaagtatttctttttttttgttagaaagtatttgaaaaacagaaaggttgtgatagttatgatctgtgcatttctctctgtattttcacaaataattcccatcaaatgaacatttaaaaaactttttattatggaacattttgaatatacataaaagtacagtgaatatcacagtgaaccttcatatatccatcattacactgtaacaaactcatggcagtttcgtttcatccattactcctccccatcagtgacctcaactggattgttttgaaacaaatccatatttgaagcaaaaatagatatattatttctggttggtcagttatgaactgaagatctataagtggccccaccccagttgttactatgtcatagattatgatttggcttagtgtacgtgcagtgacccatgtgtgcatattgatcatcaatccatcgtggctttcttagctatcttggctttcttttgttagcagagcttacctgcaactgtagtttcagaaaatagaacaggcagctcttaccatcactatactatattggcagtgaaggggaccacagtactgctggttgacatatgaagtggtgaagagcaagagaggaaaggccccagatgctggcttacactggggagtccacatggggcattggtgttgctctgaaggagagaggttctgcagctatctaagcttagccaagaagagtggaactcattttggctatttgcagacatggacatggttgcagggttcacgatcctttcagtaggatgttgtgagaatttcttatttaaagtttaaaaaggatttttattctgaagtgaagcaaacacaagctaatggaggatttctcatttggggagagggactcctctggactgtggtctccttgaatttatgcattggcggtcatttcaaatctttggagctcttttgggtcagaatcctggtcattgtttttgaatctatatatcattatccccattggaagttaaattacagacggaaccaaacatatatcatggtcagagacagaattacattcttgtgaacattatcccatgggtcattttaattagatttgaccggaaacagtttatagtagtggatgattaacttatattaaactaaaccatttactttcttattttggcttgaatatgtaaagttaaaataatttatattaacaagtgattttgaaaagtcatatttagtatttgttagtgactagtaggtttctgtgtcaattgtttattgaaagtaatacatgtaaaataaaatcagaggtatcctgtttttatttaaatttttatgtagtttttttgtaatctaaaagtcttagctaagaaaaatagagcccataaatatagtttattggcttggacaataaaaaatcaatagaaagaggtagcagctcatagttctcttaccttctgctacctacacagcccatcacaaccttttcacatcattttcccactggaaaagcagaaacaagagtggagttttatatatttccttctttgtttatacatttactttatggaattaagcaaaatgtttgaaaatatgtcattgggatagatgtgatgtaaaaactttaattctaattttgagcaattttcatttacttttatccattttccatttgattttatccattttgttctttaaaaagcaaatcattggaattaaaatctgtaaaatgttttatgtagatagaaatgaagaaatatttcaagtctaatttaaagatttccatttgtttaatattataaatgaaacacaacatggtaagattataggctggtcttaaaaattcacatttgctatttattgttactagtaggtagtttttcttctattttttcttcacaggaaaagacaatttctctctgattcagaatcctgaaaatgtgatctcccttaaaaaggtaggtgtatgtgctttttaatttgtgactaaaaaaattttatcttgaataaattacaatccagatgatttaatcgagaagcaattttttatgccactaacacgtgccattgtgaattgaattaaaacctcagattcatctttctaaattcaatatttaactttgccagtctttttaaagaatgactattttgagacaaaagttgatgtctacagcagtcaatgtatgtgatgtataataagtgaatgcttctcagcagatccatttttttattgcaatacatttatttcagctcatcttgatgaaatgtgttcctgtctttttcagtgggtgacatctttctaggaaaccaagacagtgtggaaatgtaaaatggtctgtggccagtaaaaaatgtgatatctttcattttgtggtgtgagatttctttttcagtgtgtggattgtgatttgctgcatactttgtcagctgtaataaggttgggggcattcttgggtgtacggtatctttttgtaatccatacagagcctgcaagaggtttccaaatttcatggagtgaactcatactagcttaggagccactttggctttcttttttttttcttttctgaggcagagtctcgctctgtcacccaggctggaatgcagtggcgtgatcttggctcactgcaacctctgtctcctgtgttcaagggattctcttgccttagcctctgaagtaggtgggtctataggtgcccgccaccacacccagctaatttttgtatctctagtagtgatgggatttcaccatgttggccaggctgatctcgaactcctcatctcaagtgagctgcctaccccggcctccgaaagtgctgggattatgggtgtgagccacagcctggcctttttttttttttttttttttggtttttatctcatactttttattctgaaatatggactggctctcctgttctgaaaggtgtagttggggacttggttctgactagagccatgcgttcagggagtgcctgtggagactgggaaaccgctaggcatgagtggtatggtgggtcccatggggctgtcaccccaaaccacaggactgcctcagagatttggggggtgttttaaggtcacagtggtcaaatctgaccttgtgccattatcctttcatgttatcctctagttggctctcagactgtaagattttaccttttagatcatttctgggctgagaagttagggtatagaaacaatttgtcctgatttaattacaataacaaattcgtgatgctgatggcgtctttcctcattcttctgcaacctcacaagaatgaccattcacctccagcttttaattacccatccagctagctcccagccatctctgccctgggaatggcttggttctctctgacagagctcaccaagcagttgctcacatgttacttataaagcacccacctctagatagcaaaaagtgaagactatggtccatactatatcattggaaatctagtgtggagaacgaacatacattgatttccaaattggaaatagaggagttgaagctgagttgtaatgttcggcccatttaagataaatagagccacccgtgtaaatttggcatttggacataaataaaccctatgagagtatgctagcagagtgaacttacagagaccagagagattgttgcgaatttgcttcaaaattggagttcaaaaacctgctgtatgcaattattgcagtgaattgactgcataatagttaaataaatgttttcttttttttctcagattatttatttaaatgttggcttcaaagacgatatagagaaacatgagttaatcaaagacagagagtgaggataatctttgatagaatgatgactgcaaaagagctgttaagtgtgatataaatgctgagttataaaaatacacttttaggaaatccaaattattaaaccttgatcatcttgaataataattggacttaactgcagcataaatcatctgcatcacgtatctgctagcagatatgtatagaaaaaattcgactttcaactactaggaaagttgctttttcgcatttatccaacattaatctaaaatccctcttgggaataaaaactcacatatctgcaaggtcgccagacagttaggagcacattctggaaaaggctcctcagctgcatgggtgacagagcccaggaggctgtggagtattgtaaaagtcctggagtatgtggcaattaattcgaaggatgtctcatgtgttaaatagtctcatatatatatacacatatatatacgtatatatgttagtctcatatatatgtatatatacatatgtacgtatatatgtacatatatacatatatacgtgtgtgtgtatatatatacatatatgtgtgtgtgtgtgtgtgtgtgtatatatatatgagactatttaatacatgagacatccttggaattaattgccacatactccaggtcttttacaatactccacagcctcctgggctctgtcacccacgcagttgaggagccttttcaagactgtgctcctaactgtctggcgacgtatatatatatatgtatgtatatatacgtatatatatatgactattttaaaactctgtatcattcctgctataaggaaatatatatgaatatgaagtgttactgaattaagaggtgcttttttattataatgtattttcttaatcaatagaaattaaatctactttatactactaccatttatactactattataaatggctaacaattcattttgacattaaacatggttctcataatcaaagaagctcataatcaaagaagttgaaagttgttgctctagaacatggggaaggtatctgaatcatgttaagattggatccatgattcgagcaagacagggccagaatgtttttaaatagtcagaagaaagaaatactcagatgtttattttattagatattagattaggttactaggggcaatagaggaactttcttctataaacttttaaacagtccattttcttgtatggtagcttggttagatgtattcttcagtacgaaagctagcagccacatgtggtcatttaaatttaaccacatatagttattttaattaagaaaattaaaaattgagttcatcatttacaccagtcacaattcacatgctcattagctacatgtggctagagggcagcacatagaacattatcatcatcatagaaagttttttttttttacagtgctggggacaattgtcatcactaggactgctccatgccacaagtagtaccaacaccacaaagctattcctaggggctttgcccctggggtcctggcatggaatggagaagacaaagcctggtttaccctataaatcgtgggagatttttatggacaggagtccttagtgaatgcgtggaaaagaaaattgtttccccataatcttccagctcccctccctttcattatggcccatatcccctgacaagcggcaggggtccatgtgccagtttgaattaacattttattgtgtgtacagtagacatttatccccatttgggctacctggtatctgaatccttttcctgaatttgggggcattcgtcattgtgtgaagctgggtggataaaagtgtcatttcttttaacttcccaagcagaaatgcccacttttgtgtttttcttgatgtctgccagcaagtaggcacactcatgggacttcaggtttgtcacatctgggactggggctctggcgagatgacttagagaggcaatggtttggaattctgcccatcactggtgcgggcaggaggaccatggtggcaggtccagagccacctgtggtgaccagcaccaacagtgcagtaggtgaaacagagttagttactgggaacaaaagcaatactaatggaaacagccttcccatgagtataaggagctggactagtctcccttgttctaatggacatcctccttacgtggaataataacaggacaatttaattttatttgttattgttaattttttttagagacagggtcttgctctgttgcccaggctggagtgcagtggcatgactgcagctcactgtaacctcaaacttcataacaggaaaattaaagaaaaatcaaaagaaaccacttagctgtaacacaaggaagatatgctgacttgtttaatggaaaggaatatactttaatggaagaatacatatatcagaatttcaaacatcccccatggatttagtaatggagcaactccattttttgtttttgatagagaattgtgtttataattctgtttcttacatgcaccatgtaatcaaaactgttgcctgtgaataatcactctttttctgattcctacttggctaggctggtatgcctgttttattgcttttccagaacagatagactcacatattgtttcacgttatgttttgagttcttaagcatattgtctcttcctcctgtgcgctgattcccactttcgtgcacacagcagctgtgtgaccatctgcatcatctcgacagtgccacagcttcctccgtagaatgctacggtgtgtcgcccgtggagggattcctcatcccaagcatgatttttatgtgggtaggctgcccgcctgtgaggtgaagtttctggtggcccatttcttcatatttcatgataattggtcagaggcttgcctggcagtggaaccatcaccccagggacagaggttgcctgctgtccatcatcacttatgctcagccctcaatagaaaagaagtatggtgtgaagcagccgcccaaccagagagactggtggaacagcctccatttgtatgtaggtgagctacatgatttgtcctcaccaacacaatgtgaacagtcctgtagggcaaatctgggacaaggcgtcgaaaccccaggctctatcgtcctctttcctgtggttagattcagatgactgggaggcctgaggggatggtgagagacaggatcaagtgaacctgagtctaaatcattgcgttatggatggctcctcactattcctattcaggaatccacatgttcctgaacagaaaatctttaatagtcatatttgccgtctttcccagtaacaaactctatacaatgaaagatggagcataaattatgcgagcaagaaagagaaatgaggttctattatgttaactctttatgtattttcagatttattcattgcagaggctgacattacccttgtacaccctcattcagccacataaatctcattatttctttttatcaggtattagctgacattttttcatttttcagttgcccattatgtggaatcatcttcttgcactgagtagtagcatggcttatacaagagtatgattatggcctacatacatttccctacatattgcctagtgttgcttacagataggtctaagagttagaggaaagcttagtgcctcattgtaaaaacaatttgccagttttgtaaatcagcttttttttttttttttgagatggagttttgctctgtcacccgggttggagtgaagtggcatgatctcggctcactgcaacctctgctccctaggttcaagtgattctcttgcctcagcctcctgtgtagctgggattatcggtgcctgccaccatgcccagataatttttgtatttttagtagagacagggtttcaccatgtttgccaggctggtctcgaactcctgacctcaggtcatctgcctgcctcagcctcccaaattgctaggattacaggcatgagccaccgcacctggctgtaaatcagagttctgagtgagtttttaatcctcttggatcactacaaagattgcggtaactgagaatgcaagttcagtgactaattttgcttcataaatgtatagaaaatggttgatggtcttattagaaaacatttcccaggcttaatagttctgtatagatgatagaggtagccaatgaagatggaaagagggaaacaattatacaaaatcatcttagattacaacagaaggagaaagtatttgatactcatttaaaagcagcaaatgcggtggttcgagatatacattttgcttttggcatgacatgtaaatgattgcttggcagagatgaagaattagggatttaatgtttttgctttttagtttactgtgtattaactaataacattttcttcttctacaatatggaaatagcaactgtatacctgtaaggttattaatggaggttttatgcatgctgatatatttgaaatgtttttagttctttaggagaaaagtgcttaataaacagaaataactacttatgttaacagtttatttctgttgacttaatatacctactttttcctcttaataatgccagagcatatttgggggggggctatagcttgaacaaaaataagacattattaatatcagcactttgtaacctgagacagatgatttaatctctcctgccatgttctctggggtttaaaggtgctattcagcaagattattatgaacaccaaaaaaagtctgcataaaatagctgcttggctgtcacttccatataagctatgaaggcaatgatgacaattaagtctaggacttgtaggaaccacatatactcactcctactgcctttgttcttcttcatgtctgctctgccattgtacttttttttttttttttgagacggagtcttgctttgtctcccaggctggagtgcagtggcgggatctcggctcactgcaagctccacctcccgggttcatgccattccattgtactttttaacacattggcatatactctgtgctgactactccagtatggagtgcttctcaaactttttggtctaagacccttctatactcttaagaattgttcagagttctaaacagctttttaacatgcagcttatatcataactatttgctatattaaaaagtaaaatgggaacatttacaaatacttattttaaataacagtgataaacccattacatgttaacgtaagtaagaattttttaaatgaagaattactgtatttttccaaacaatatatgtttggtgagaagaatggcaccatttaatatttttgcaaatctcttaaagtcttgcttaataaaagatacgtgaattcccttatttgcttctgcagtttattgagatattgaacatgatgaaggctctggaaaactctttcagagagtgagaataataaaaggaaaataatttcttagtatcattatgaaaataattttgacctttcagaaccctgaacttgtcttgagcacaaaatttgagagtgattggtctacgttaaatccccgaaggttgtctttagagtatttccagttttgccacatttactactttgtactagaaaatccctttcccatccaaaatattagtaaataactatttctatctagttaattcttattcagagaaataactaagaggctaaattataattgtttaattttaggctgcaattttcccatttattaattgcatcttcagaatatgctggcatcttaacccatttcccccattctcacagctgcttttaagtcatttttctcattgataagcactattatgagagcctctaaattggtctctgttccagttgctattgctgtgcaacaaaccaccgtgaaactaagtgcttgaaacagtaacaaccacaaatctgcagttagggcagggtttagcagagaaagctcatctctgccccttatggcatcagctggggatattttgactgcatgccagaggatccacttttgagatgattcacctacatgcctggcaagttgatgccagcagttggctgggagctaagaactagggatttccgtcatcaccatgtgggctctcaatggactgcttggtcttcctcatagcatggtggctgagttacaagagtaagttttccaagagatagaagtaaaagttgtcactttcttaaggtctggacatgggaactggtctagtgtcacttctgctggattatagtcaagcagccacaaagcctaagttcaaggagtgggaatacagactcctacctctcaactggagaagtgtcaaagaatttggggaccatgttttaaaattaccatactctctctgcctcagtccttctcacccgcaaattgcccagtatttgcatcttgtcctcagattcaatttcctagaacatagctctgtttgtcctgtagctccccattttctacctaagaacaaaattagtcttgcattcagaacagtccatttattagtttaccctattccttctttagtataccctgcgttttagcccaaatttatctggatttttcttcttttgcctttgattatactttttttctctcttcccagaatattatccctttaatctcttcacatcctaacattctgtcctcataataaatgctaccactcacatgaagacttccttaagctctccatccttctgtagtatgtctttctgttacctctcatcatacagtttaactgtaccattttaaagacctcccaatttctgtcttgtacaataatatatgtatattttatatgctctactagattttatgttccttggaggagatccatatttttaaatataatattaatctttagttgctctgatatcttgagatatatgtaacaagtgcttgatttttaaaaaaatgagtgaatgaagatatgaatgaaattaacagagtatgtttagactcacctaaaaagctattagaagtactatgattgttgattaaaattgctggttagccgcaaactaaataagtaaaaattgatgatttaattaccaagcataaatattagacaatattattaaaaagagatcacatccaaaataacagtacaaccatacaaaagtttggaatgactttcctagaaatgtatggtaggaactaagtaaggaaagctacaaaactgaattgtaggacataaaatgagtttcatattagtggagagagattctttgttcttggaaagccagattcagtgtagtaatacaaaaatatcagatttgttcatttgaagtgtacactcagtacaatttctatcaaaactagggaacttgacaaaataattccaaagtgcatctggaagtatgaacctattaatactctcagaattacaagaaatacttatgaggggcacttggcatcttagatattaaagaatattttaagtcaatgatgattgaacaatggtattgatacagggatacatcaatgagtaaaatattaaagaaccttgttttacatacacatgtatggtaatttagtatatgataagattggtgtttcagattggtaggaaaaagattaattactcaataaaaggtattgggacacctgcaaagtcttctggaaaaataaagcagggtctctaccacactgctaatatagaaataattctagggatcaaaattatacatataacaagataaactgtaaatttatgataaaaatctatggataaatatttttacaatttatgtgtatgtggggaagtcatctctaactagaaaccatgaaggaaaggatttaaaaatgtgactacatatacatatgttttacatctttatttttcaaaatgtcagcaaccatctcaacttgtttgaaggacagagcatataccgggaaaacatttacaaacaatatgatcaacaaaggctgatatttccaaagtataaagagcttttaaaataaactctgacaaccttatcagcaagatgaacatttaataaagttgtggagttaaaataatgaatatggggccgtcaaacatataaaaagatggtcaaatctgtcagcaatcaaaagtgcaaattaaaccaacagtggtatattattaggttggtacaaaagtaattgtggttttttgcatcaaaagtcatggcaaaaaccgcaattacttttgcaccaacctatatttctcggtaactaaaatgacaaataaaaacaagcaaaaagttcataattgatgatgctgtgggcaaacagtgtagttttttttcaaactgcactgaagggccatattttcccagtctgtttttgacagatatgattgtaacatacagtaaaaataagtagccagaaatcaaaaatcacagatattcggaataaaatatcaaatatgacacacatgcacacacacacacacacacacaaaatgttcatcagacataaaattaactctctcaaagtgcgttaaatatttctaaatgtttactctcaatttctggacctatctcagtggaccagtcaggaacattttgcagtctagcaccattctatggaccactcttagaatagcactcctttaatgtgccaatgggaacataaactgggtcagactttgtgaagggaagattggcagtatgtataagattttaaatgtgcaaacccttctatttctaggaatttgttgtaaggcaaattggatagttgtgtaagattatttatcctaacatctttggtgatagagaaaaagatgaaacctaaatatcctccagtagggttattggttaaatagttatggtagtcagactgtggaatactatgcggtcattaaataattaagcaaatgtatattcatttttcattatagaaaatttcaaatatacacaaaagtagaatgaatgcctaaaccatctccatatgaccatcacccagcttcaactgttacccagtcatggccaatcttgtccctgtcccttcgattagttgtgtgtttatttgtgtgggaagattatcttgaccttttgtaaagaaaaaccaggttatagtggagcatttatttactcgttcaacaattatggattatactcttatgtctgttgtggtactattctaggagctggggcttcagaagtgcattaaagaagtaaaaatctcagcttgcagcttaaattctagtggggaagatggaacaaccaacagtcaaaattttagcatattgttactgattatcattacagagaaaagggggaatagggagcagagggtgtgttgtcattttagaaaagattaacagggaagcctacccaccccggcctgagatggtggtctttgagtcaaggccctaagttgctaaggaaggattacatgtcatctgtggggggcgacctcctcaggcttttgggggtgggaggtagcaaatgccaatgccataaggcagaggtgagcctgctgtttctgaagaagagcaaggaagccccggattgaacatgaggagagtgctgggagattgggcaggagggtggcgtagggaggagggtcttatagtcttctgtgtggacttcgactcctgctgtaaatggaatagggagcctttggagaattgggacccaagagtgctgggatgttacttttgagaagactcacgttggctgctgagttcagagtacactgtgagggagcacgtccagaagaaggagaatcaggaggttatgttcctgtgtaatcaagggagattgggggatattgattttaacgaggtttggagggatggaggtggtttgaagaggtgagattctcgatctcttttgaagatagagtcagtaggatttgatcatggattccacgtaaggtatgaggaaggaagaggtggtgaaggggattccaaggttttgtgcctgggcaattgaaaagatggaagtgctatttgctagaatggggaagactgcattatgagaggtttgaatggagaagatcaggagttggttttggatatgtaaaatcatgattcccattaggtgtccaaaatgaagacagaaccaggagttagttggatattaagagtctggaattcagatgggactaggctgaagatgtgtaaatgtgggagttgtgagtctggatgaagtcactagaaaagtgaatgtggacaagaagcaaagacaagactcagaggactgagtctaagggcacttagagggtggggagatagggaagaatcagtgttagagatcagggataaagtgagctaatgaagtaggaggaaaaccaagggcatatggcgtcttagaatccacctgctgagtgtttcaaggagggaggattaatcagaggggctgtcaaagaagatgaggactgaaatttgactgaacaggaggctggtgcaaaagttggatcagcacaacatgtcagcttgaattccttgctgaggtatgaattgtgaagcatggaaatgatgatgatgataatactaattattattaagaattcaaaaggaacaagatcttctttttttttttcaagaatgccaaatatattccctaccattaaaattggatatagcagccaaaaaagaaagaaaaatgaattaaaattactgaaagacaattttacatgtcctgtcagatagtttaatttaaatataagctggttgatccaggtgcagctgcccaaacttggaataacatgggggaaaagcctagtgagaaagcaaagccaattgcaggagagagatacagagtgatgagagagagaggaagagagaaaacaagagagagagagagagagagagagagaaagagagagaggagaaaggggtagttgaagtaggttgcataggaaaaaccaggtgcctggtaaactttattgagtcccagaaatgtaaggtgccccccaccaaaaaaaagtgttagctgctcttaacactaactttagcctgaatagacttgaaaatgtatacatttttcatagatgaatactttccctgatacttaaacaatatagcacgatcttcagagcagagatgtgaatttgtatccctgggtctaaagtattgaacatttataaaatggtgtggctataagagtaccagaattgtgctggagtttcagtttcttctttaggcagttgatttgattaaaacaaaagaaaacaaaaataaacaaccaactcacacttctggtcctttctctggaaattatgaataaaaatatcaataaaactttaaaatagaattttagcagtctccctatttgagaaggagaatctcacaattttcactggtaggcaattcatgtgggattgtaatgcatgagtgtgggaaataaataaaatgattgcttttttttttttcgtaatggcctaaaatgatagcttcttgatttaataaacctttcccctactccctaccaccacccctctgcaacttacctacaatacacatattctagtgcttatcaaattataaaagctgggctcatgaaataacaggaggatttttgttttctgatatcagtcaaaaattgtttggaagacaggcagaacaagttaaagtgaaagcctaatatagtgaagggaaagatttgtgtgccagccacagatggactaagttcgttctcacataaatattatcctttttttcttgccaggactgaactgcagtcattgtcttaattaactcagggagttttcagttacagcttcaaaatctcagtcttctggaaattgtcatctggctttgtgttgtccctaagtagctgtgtgacctggagggaggcacttaaccaattcaggcctcagtattgggagtcaagggtatggaggcccagtttagctttcttctagccctgatgttctgtgaatctgttattcaagtttatggacaagttcccacagagaaggttagtagagttttttaaaattattattattaagcaatgggtattttactaaacagtactcaactattttttgcaaagtgttaatttgtagaacgttttgaaactccgcatagaaaatgaatgcacaggtcaaggctaacatagcctttcagccatattgtctggaattgttttttttttaaaacatataataaaaattaaagttgaagaagaaatgccaaaaatatatttttgatggaaaataacaacttacactgattagcatttatttcaatgaaatatgaatctttaaaacataggatttaaacatctttcaatggacatatacattattgtctcagattcataaaaatgtcttgtaagctatcatttctcctctatttacactgtcttttgtgggggaaataaaaagactaaacagtgtttagattatctctacacattttacatttctcccaaaggctgctgtgtaatggttggcatctgagagaataaacaggaaattagtgaggctgaggttctccttcatcttttgccagggctggactccttgcttcatttattttcataggacaccagaaatctgagaacagtatttaagctgactacgtttcttttatagctggccttttatagatggtctacatgtggcaatctacagattgccagatctttctccttttctccaacttagtgtgttggcatttgaagtaccaaatgtcctcttcaccaatgaatagtttagaggaagatgaacagtgtagccctttaggcatcgtaaaatactgtattttttttcataatcatgaaggtaatatgtttgttatagaaaatttggaaaattaatataatccaaaatcctacaacccacaaatcaccacttttgatattgtactgttgttctttttggtctttcatcaatttttttgactacttgtattcattaagcaggtattcaatttattattcaaactgtttccaaggtgagctgctaagaatgttaataggtgttctgggtcactggggacattgggaaactttccatgtcatatacgtttgggaaaatgccagattgaacgatgttagacttagatttgtcacagacacccccctcagggatgagcttcctgaaagggctctatgactcttctctacttgggaaggtacattgggcaaagcctggaagttattggacagagaactggctttggccctgcacccactaatgttgtaatgtggtgttcttcagatggcagtgtggatcttatttggtttttgtttgttttacgaaattgagatctcatgcttttgtaacctccttttcctacttaatatattatgaatgttttctactttaaatctgtttttcaaagagttgctttctctcattgttatttttgaaaatattccatttatgaaagttccatttatgaagctggggcctagcccaggtgacagatcatttcagtctgtggggatactcttgaaaggttctgtctgggttataaaatgtttatactcatttgaaatgtttccatcttccacccacccattctgacaaacctttaattttggacaactgctgttgaggctgtggattcacagttcccaaagccactgctaatttgtttgctttggaaagacctgacaaaaatagacttcttttaacacaaatggataattttctcccattgatgggcagttcatttaagaatattttatttattgtattataaaaatagcctctttgagacgaatggcctgctccaagtaactctcataaaacatagggattttcttccatacagaaataattactttgatttaaaatgggatattgccttctcaaagtattttttccactatgaagtatatagaagtatgtatttaatgtgtcttaaagtccactagtggaagtattactatcaccttttttcaaggctcattacctaaaatttttctaaaattaaaagcaaagacaaatatgccttacatttagaccaaattaaaaaaatggatctttattttggatagtccctttacctgtgctttactttcattatcacaaaaatatccttaactcttagcatttcataacaactgtgaccaatttttattatgtagttggaagtgttaagaatctgaagagaaggccttttacagtgattatctttgtgaacagtgtttagatacgttttggagacctgttgaaacaaataccctactctttttttttttttttttgagatagagtcttgctctgttgcccaggccgcagtacagtggatgatctcagctcactgcaacctctgcctcctgggttcaagtggttctcctgcctcagcctcccaagtagctgggattacaggcacgggccaccatgcctggctaatttttgtatttttgtagagatggggtttcaccatgttggccaggcaggtctcaaactcctgacctcaagtgatctgcccacttcgacctcccaaagtgctgggattacaggtatgagccactgtgcctggcccaaataccctactctttattgattgtctcacactgattgataatggtcagttcctcaggcataccatatgtctttaaaatattataaaaaactttgtaaagtcttttgttttataaacagcttatctgggctaggcctggagcatattcatagactgtccctttatgcaattcctgggcaagtgcatggctttgaaaaagactggagctgaaaagcataatgtgtacttttggcctggggattctttatagagagtatgcagatttccccaaggaaaactgattttgcatgcaaaagctgtctctataattataacaatttcctcttgccctttttaaaaaaaaattcagcttctcaaattggtacgtataaaattttaccctttccacaaaagcaggccttgctgaaggaactgactgctgaaaaatctcatgccaagtccctaaagcagctaaagggagacattataagttttgaaatgcagcagtctaggaggtgaaggaatggcggtcctgtgagccttgacatcaatttatgtgagtgtgtgtgcaaggtgccatcccacagcttatacttagaagaaaaatggactctttaaagtaaagcttgttaattgagtttttctttttctgagggttgtgcttacatggtttaaattgtaataaaaattaaaatgcttgaaatgttttagagtcggagccctttgctgctttagctcatgggcacctccaagaatgcttcctcagatagcagcacaaaacactggcagttctccaagagaacattctttgagaacctcactgtgattgggaaagggaacttcacattctgattgtgcagaagtgcccgcgggatgtgtagtctacattctaaggttgcttgttgtcttccatggaaagtgttattttattatatctttcagatatgttataggtgggaaaatccgaataactgcttttatcttggtcaggaaatacagggaattggtgtactggggaagatcacatattacgagacacactttaattacctttgtggagtattacttttctaataaccaaacttgttaaaatgctaaattttatttgtgttttaataacccagattgctaaattgctaaataatctaatatactaaattgctaaaataatgccaaacataattaaactttcatttggttctgaacaattttcagtgtccccaagtcattatcaatattgcattaatgtagaaatctagtcatttggcgtccctattaatagaatgccaaacaaattgagtcagacatatatacctagtgttgtgttgcatgcagcagggtagaaagggagtgcctaatcaagctcacaatgtgatttttgctcaagttgtgatgtctggccaggcgcagtggctcacgcctgtaatcccagcactttgggaggctgaggggggcggatcacttgagatcagaagtttgagaccaacctggccaacatggtgaaaccctgtctctattaaaaatacaaaaattagctgggtgtggtggtgcacgcctgtaatcccagctactcgggaggctgatgcaggagaattgcttgaacccgggaggcagaggttgtagtgagctgagatcatgccattgcattctagcctggggaacagagagagactttgtcttaaaaacctagagggacttactcctgttggaggcacacatttctaacgagataatttgggattgacataggactgtgcttaataaggtgttcagaggggtggtgctgatgctaggaacggagaagacaaagtaagatgatggcaatgttgagttaagctgggcagtgacctgatttgtttatcatttggaggagaagtcagaaaaaaaaagaaacagcctaggtagaggattagagatgagtatgaatattgagtgtgtcagggagggtaatgatagtctgagctcactgcattaagatgaagtgttaaacactaataatgttgaagcttattccaaacccctagcttttcccctttttccttctaattactactcagcaaggtaatgagtgatggctcaaatgtgggattaatcaggggaggaagactatcaagttctgttctgtttgtgcatccaggggagaagctgcttagagcagtagccagttgttgtcagcactcttcccccaaccccaaattaaaggcagctttctggaatcatattatggcacctggggaggattaacatggcttcctaagatgcctgagtaacgacatttcttcctgtcaaagcacactgctgtaaaagaacacacttcctgatgatggccttgaccgacctcacgtttaagggcctgtgcacagttctgttacctggagtaggtgatctgtgacaccggcctttggttgctgtgtttggccatgaatccaccctgatgactatgaacttcacagagtaattggccaggatatcccttcccttactgtcatacttgctgaggtgttagttctgcaaatagtatcctttgtggatctttgtgtttgtttgagtaggtgaaggactttattttatattctttttctctagttacttccttattttaataagtaaaccttattctaagggttagtttctatgctgagaacagtgggtctctagactacttaaaattttccataaatcttacgttattcattttgtaaatcctgaataaattgaaacgagaacagtgctgatggtcctcatagaaactgaggtggaatgtgtacacattttaaaatttatttaaatgaggtgcttctaggtataacacatatataaccctccctatatattatttaataataaaaatacctctacactatagtgctttatgaatagatttttaaaacttcttcttctttttttttaatactttaagttttagggtacatgtgcacaatgtgcaggtttgttacatatgtatacatgtgccatgttgttgtgctgcacccattaactcgtcatttaacattaggtatatctcctaatgctatccctcccccctccccccaccccacaacaggccctggtgtgtgatgttccccttcctgtgtccgtgtgttctcattgttcaattccctcctatgagtgagaacatgcggtaaaacttcttatagtataattgaaatgtaaatttagtgtaattaatatgaatttattcatttaatttggattattgatgggcttgattcttcttaatcctaatgaatacttgcaggccacaggtagttgtttagcattagcaaagtttatcttaaattatttcatataattatattttaagtatgattttaggctctagatttggcctttttcaaatttgtaatatgctttatcaaacattaaacaccattttaaagtaatgtaacaggaatttgggaaacagaaaaacatacctcttttataattttagtactttaacataagagccaatatcgttttttgtacattttgaatcctccacatggaccacacatatttatagctagaaatgtgaatatatatatataattttgtattattcttcacttataaaattagcatttctgatattgtatccgtgtgtgtgtgcgcgtgtgtgtgtgtgtgtatggcttcaaatcttttatgaaacaaaatttaaagttatgaaaatattagtgcccagttcaattcccctcactccactccatttcacattccccagaagtaacttttcagaattctatttttcttttctgtttatgtttttatactcttgtctcatgtatgtgtcccttatatgtacgtataagatatatatgtgtgcacatatatatacattgtgcatgtacatagatacacacatgcagagtattgttgtgtattctaaaaatgtacatatctgcaaccattttgtctgcccagttctattccattagttttgcctcacctatccttatatcagtatcacagagctaagactaggatgaggcaagcaaggtgcgctggacatagaattggtgcagacatctgcccttaggctgtaggagcctcggttgccttccctaatctcagccatgacaatagctttatagaaacttttggtatgtggtaggttgaagtcttggctatttttggcccctttacccttcaaataaattttaaaaaacagcttgtcaagttccatgaaaaaaaatcccagtggaaatttgacttgaatatatgaaatttatagattaaatgagggtggggaatggacatctttaacatatcgagtctacccacctatgtatatgctggctctaactattgatttaggtcatttttaatgtctctcaaaaattactttttctataacatcctgcatgttttttattcaacttatttctgcatgccttagagtttttgttgttgtgaatgtgaatttttaaaactgaattttctaattcattgtggttggtgtatacgaaagcgttggtttttgaatgtccctgctttttctgcagccttgcttaacactccaatttgtccgaatttgtctacagattcatttggatttcttctgtagagaattctattatctgtagttacttggttttcatacttgtaacttaatgactatataatacttcattcatcatttactttgctgttgaacacatgggaagttcctgatagcttctattttaaatacaattatagtgtacaccttcatacattttttcacctttccagttattttattgggattcaattttgtaatttctgtcaaagggtgtgaacatatttttacagctcaggatatgtgttgccaaattgctttgtagaaagctttaaatccttttacactgccaccagtagcatgtgagagcatcagttcaaccacattgatttgaatgatggaaatcgcacctggaatgctgtgagtcttctgactgatttcctgtgtccattcctatccgtgcttaatcagtcctccacacagcagccagaattatcttcaaaaatttaaataagattgtgtgattcccctgctgaaaaatcctccaatggctttcctttagatgtagaatttagcctaaacttccaaccaagattcctatattctgacccttttctttcttctaacctgctctgcttttgttctcctgtgcctcggctacactggccttcttgctgttgctgaaacttgcttaccttattcctaccccagggcctttgcattggcagctccccctgcctagaacattctccagctcattatactactacctctacctatcgtgcatttttcttgctcagctgtcacttccctagaacagacttccgtggcttccctttctaaaataaccctttttggtcacattcttttctcttactttattttctttacatattttttattatctgaaattatataagcttgcttattatttatttctttgtttaccattggcttcttcaagtagaatataaagtcctcaaaaaaaaaagctttgtctaaagtgttgactatcattatatatcaaattttctagtggcatcctacaaacattaaaagaaaaaggttacatgtgcacattgtgcaggttagttacatatgtatacatgtgccgtgctggtgcgctgcacccactaactcgtcatctagcattaggtatatctcccaatgctatccctcccccctccccccaccccaccacagtccccagagtgtgatattccccttcctgtgtccatgtgtaccctaaaacttaaagtataataataaaaaaaaaacaacaaagtgcttataaaatatgagaacagagcaacggtaagtgcaatcttctataaacaaagaatttaataaaagagacggaaataaaaataactttaaaaagttaaaaaaaaagaaaaaggacaaattaatattaacttttaaagcatgacatatctaaaatattattttcatgcataatcaatataaaaattatcaagacattttacattctttttttaattaagtcttcaagatctggtgtgtaatttacacacagcacatctcagtttgaatgagccacatttcaagtgctcagtagccacatgtgattggttccttccatatgtgacagtggagggctagaacagaacaatgcctgagacacagggaaaaatcattagagactcgctgaatgggtgaacaagtgaatgaatgaatgaattttatttagcatgtgtaagtaatgaaaatccaagtcaaattaggagtaaaatcaagatcccataaaaagtgatttattgttagagaaaagtgaggcattagcacatatcctttactggaacactattgtggtatctgaatgggctcagttaactgtcacctttattaaggctctcatgtgctctgagcatcttgctaggatgagaaaaataagatgaaattcttaagatatcggaagtctggtgagttgataagaacttgatgcctaactgtgttgtacattgtacgtgttactgaaacagctgtgggcatcatgaattaatttttcccaggcttttattcatattcaaaagcttagactaatagtcacattttattaagtacattttatgggcccttagcattttgctaaatgctaagggagcaagtatttgccctcacactattttaatgtgtatttctctaggttacattcttaacttacctgcactatcctccaagcataattcttcaaattttcagctgtattgagattctaaatggacttccaatgtggacttttcttcgttttcagcttataattggcaagttcccataggaaaaaatcattattggtgctataaaagtacttcttatctgtcacatttgggaaatgaaagttttgtaaaggtcaaaagaaagtgtgcccccaattatgatgaagacttgtacatcatcacaaatagtttaatagcttggaacttatcttagtctctcttacagtgtataaagagaaaggagaaaaaaaaaaaaaacaaagtagtcactccatagcaattttaccatacagttttaggagagatgaaaaggatcccatcgaaatcatttgatcaacatctatctatatcttctttgtggtttggaactgtttaagttatataagcctacaagtttattagttcacctttattaatttgtcaaggttaatgactgcataatgagttgaagataattaaagatttgttggcaaccatctgctagtgtttacgcagtacggtaagttttataactcatcttgtaatgtttcctaaggagattctttgccaccttactaattttaaaaacacaaaccacgctgttgccttaggcagtgtaagaattcttttccttaatcttttagcatatgacagcctattaggaagatcagatgatacacctctaagaagccgggagtgtgtttgcagacactgttgagagtggagtgataccagccggtcggacacatgacctggcagttcccctttctttcagcaatctgctttggcagccagtctgcctcgggcatctgtgctaattattctgccccagcagcagagctgtgggcactgctctaagaaggatccctccttgctctccttatgtgaaggcccatctgcgttacggaagtgaacaaactgactgagtgcagtcttctcctgagtgcctactgtgtgcagcctcattattaatagataatgaagatagccatgtcagattaaaaggagggattgggaacagttcaaggccctctctgaatgtcttattcaaattcccatttcatctgttctcccttgacacgctccttttctcaaactcctgaactcaagtgatccacccaccttggcctcccaaaagtgctgggattacaggagtgagccaccgtacccagccgacctgctccttttctaaacctctctcttcttcctttctctctcttagcaacatcttgccatctccccttctctctctttatagtgagtaattactagttgctctgtattctagttccaaaatctctcccatgttcatcctcttggatccattgtctgggtcaatactacttctcatctgcagagtgtcatttgcttcctaatgggtttccccatatgttcctgcactcccttgacccaagctcacctccactcaccttctggaagcaccattctgatcccaaggtgccctgctgcagtcttccatgggtttccacggccaggtgaataatgtcaaaattccttaactagaccgtcaggagcctcctcctccatgctatgaggtctccacctcactcccagccttatctgccttccctgaactgaatggtccctaaacaaaatgagctgctctcttttggtgtttccacctgctcttgaggtccccacctgagctgtcctttgccccacatgtgttgttgtgccatcacagctctcagccccagtgccatctccctgaagccctcctcacactggaacctcaccacacccctcaccgggatgatctacccgtcttgaccatctcctggctctttagatctctctggaaggtctcaaagcttttccctttgttggattttatccacacaccattggaggccctacctgtcaatttccagaaggcagtgcgccattgacccacttttgtggccaccacagtacccagagagcacttggaattcacctaacacctggatgaatgtttcttgaatttcttagtccctgatatggaatattccttgctctctattttttttaactagtttttttgtttagtaaccatcacccacaatgaccagaattttctctccttgcttctggcttctccacagggctctgaacgccgcttacgtgtcgtcccacctgttctctatttttgccctaatttctcaccattttctgtttcttctgagttgtccattctccaccctttaatttcaattagtcagtcgtaaatatttgtccctatggcaggaccagcttttgtctggtctaaatgtaggaagtggcttgtttataatttcctagcacaagtaggccagttactgaacacaccgatataaaatgtactactagaatattcagaaatcctttagggagaattgctggttttcctgtgaaagggaaagacaagtcttcagtggaaacagcactttaatatcaagttttgaatgaactgtattcatttcattcaaaactcagctctgacaaatatgggtaaaggacatcagtttcagaaatgcaatgcaatgcttgcaattatggaaattatttcatgttttccaattgcttatattaggttgattatatttaatgtttattcctgacaccaaatttatgtattttagttataaaatttgtgaattatagctgcaaaatattatagttttcaagtcgaattattaccagcggcattcctgtcaactttgctttcctcaggactttcaaatagaaatgttattaaatatttcctttttgtcagtgtttgcacttgaaggtaaatttaaacatgagtgtgttgtttggtttctctcattgtggatggactagctagtttaatatttaatggcaagttttgatgtatactgataagaagagagacaaagaaacattattgtatttaaatattatctttctgattgtaaaagtggtgcttgtcgtagataactctgtaaattcaggaaaacataaaaataaagatcactgttgttttaccacacacaaaaattactataactataactcgatgttatatacattacctattatatactgtattttaaaataaaattgggattatattggacatacaatcctgtttttttttctgttaacattatattgtgattacgtcctacgtgattttgttttaaacatggtttttaatggttgcatacctttaaaacaggaagaattataagttatcccaggaatcttctgttactggatacttaggtgttttgtttcattgctttaaaatcatttctactcctcttcacaatgtggatacttgggaattgtcacatcatagtcaatttcacaagacaatatagattaactagccatgcactcttaatgtacatatgcagtatttcagacattagaagtagggagatcagttttgcttgatgcaggcagttaaaaatcacgcgcatgtaaagaaaggaccaattttacttgcctcagtgttggcccaagtttggagactaaagcatttacagaccattagctctatacttcactcttgagaccacttgttgtaatgagctgtcaattattgtgcatctaagtgtagttaaagggaccattgggcttgcagtttaaaagccaacatttataaatgtgtaggaattgaattataaatgcagtggttcagtaaggatgtactgcatcatggacctgtctggatacagtatctgttctctgaaagattttagtgttcattaaaaacataagaaacagtaaaaatgtactcttgagcatatagctatacaatttttatgtttttacaatatagtttgggaaaaatatttttttaaatcaagagattttaaaaagtaaaaaacatttctttactaaggtatttattaaatatgcaatgaattaatttcagctgacatgttggagtgaggagaaggatggaaattggagatttccatttgattcagtgaagctacagtctattaaaaaaagtatattcttcactacctgtttatcattagtttttgaatagtatttgcctttgaaaatctgtgtactttgaaaatattttactgcagcttgtaaatatggcctgagtaacatttcacattttttcatggttaaagatgccttttgctttgaatgtgccaattctaaatatcactcttttaagaaactcctggaaatctcctctttttttttttttatatatatttcagctatttaattttatcatgttcttaaagtcaatattttgtatgtgaagagtgccccttaaagtttatttcttctttttattttttaacatgaagtaatacctgcttgctgggataaacaatatagatgagtaaaaaatattttgttcaattccaccttctctcttcattttctcatcttccctagaggcaattaccatgaacaatttggtgattatttcttcagatctttcacccaaacttttacaaagataacataggtagataagtaggtagataggtagttgttgatcacagatgtaaaataggttttcttatataaatgacttcatttctttcaaatggtatacaaaacctgtataacacagttatttacagatctatgttgtatgtagctgtcacaagcaggagttggcagactttttctgtaaaaggccagaaagtattttgggctttgtggagtataccgtttgttgtgattattcagtgttgtagcacaaaagcagccacaggcaatacctaagtgagtgggtgtgtgggactgggttccaacacatctgtatttatgtatgctgaattttgaatttcatataattatgatgggagttgaaatattattcttcttttaatttttttcagctatttaaatatgtaaaaaccaatcttagctcttgggcttttgcaaaagcaggtgactggcctgatgtggcccataggctatagtttgccaacctctggtctagaatattaaaataaaaatcatttacaaaattaaatctcaaccgggtgagacagctcacacctgtaatcccagaacttcgggagactgaagtgggaggattgcttgagcccaggagttcaagaccagcctgggcaaaaataaaataaaaaaataaaaattacccaggtgtggtagcacatgcctgtagtcccagctaattgggaggctgagatgggatgggaggatcccttgagcctgggagttcagagctgcagtgaggtatgatggtgccagtacgttccagcctgcgtgacagaataggacctgtctctaaaaaagtaaaatcttatattttgtaagaggtaaatatcacagtgagattggtgaataaaggcaaataaagaaaatacctcttttatagaatagtgatttaacactttacagactgtgaatgagagactgtatttaagaaacaagcaacaagcaatgataagagaaaaaaggcagagaattagctgatgtgaggtttcaagtactggagagtccaagggggtcttagtgttgtgaccaattcacaaactcccttggccattccccagggagaaatattcctgatcccttttaacattatgcttttatttgcatgtatcatctttttatatgaactttgttttgcagtgttagttgataagtctcatctttgtaattgacaattgtttttatctcctgtattgtattttaaaaagtttattatgaagtgtttatattacttataaggaaataaaatagttacattgaagattgcccaggaaatacatttcattttaaaccttttcaaatagatgcattgtaatgttaagcctggccccattaatttatttcaagggatgttctctgaatgcctgaaatacgcttgactccatcaattcaccaggcgtgtctcttgatggcaattctgctttcagaccaatgagaacaccgtgatccagtttagctgccttctgaagcaattgctagttttaatataataaaaataaaacaataggatgtgtattgttctacctgtgaaactgtcatttttccactaaaattacaaaatgcaacatacaattcataaaactaaaaacttatttttaatgaaataagaagcagtttattaaggtatattatactctctgattttatgcttggtatggaacttaatgaatgtgtgtggtaagaagtaaaaatggattagttgtgtgttttttttcaaaccacttgttccacatttttaaatttcattttcttcacctaaagtagagaataaaatagtgtgttatttttccaatgtataacttggcaatttagatataactcgtaatgagggatattcctactagacaatcaaatataagaatctctttatatatgtatatgaatgcacacatgcatatatgaataagggcttatatcttttattcttcttagaggttcatggcataaaatttagaaactagagaccaacataaggagaaaataaaaggatgtgtatttttaccacccagccatagccctattgatatttgtgggactaccttccagtgtctcgtgtctgtctctatatgcgtatacacatataattatagttcagtcctttatttctcagtttatatttgttgcttgtctactatgtgccaggcacaatgtgaggcaatagggacatgacagtgaccagaaccatcccctctttccctgaagtttactttgttgggggagacaggcattaacctaaggtcactatgtgtctagtagtaatgagcactgtgaagaagattaagaccagaaaaggggacaaatttgtgtgtgtgtgtatgcatgtatgtgtgtgtgtgtaaaagtaaagacagtaatgggattgtactatccatactttttataacttgcatttttaaataaaaacaatattaatatttttatttcactaaatatacttctaagcaagtgttattttgaatgctatactctacttttctataaacgaattaagtttatttaacaagttgtctaatattgtaaacattgtttacttttaaaaattgctattttaagtattgctgtaaggaatgtcattcactgaagacacgtgtttttacacatccctagaataaattcctagtagcagaagtactgggtcaaagaatgatcatgtgaaggctcttgatgtgtgtttgatatgttttaaaatgttatatggctccttcatgactcaatttgttttccttcccctagtccccttcactcttccttccatattttaagttttaaatctaagcaaaagtagatcgtatacttcatatttaaagaactctttaacatgttaccatgataacatattactttggtagtgaattttgtgttttgtttctgaagtcagattcttattgtgagtgagagggctaatgcacttataatataattgcatcattgcacaagctaacaaagtcctattgttgcttacaaagttggtatggaatgaaggaaaaaatacattaagcacaacaaaccagcagcagccttggaaatgcaagagattcagagcaagttttaacatgtcatttcatttgctttttttttttttttttttgaggtctgaaaaaagtctaagaatactgaactgcatcacaaaggaagcattcagtcttgagagaaaaccattttagcttgccttatgatagatttttctattccagcaaaataaaataaaatgccctactttgctgtcactttccactggttttctttcagttgacattacctgtaatactaacagtcataagtcacatacttacatagcatatcctctgtgccagatactgtatttcctcattttaaagctagatgggaattactttccacaaaagagagtggacgttttaccaccaaggcactagaggtttagtagctctaacccttttcagaaatcatagacagaagtagaagggcggtgttaaagcaatgctcattgaactctaaggtgtgcacaaatcacccgagtatcttgttaaaatgcagcttcccaggcagcaggtccgggagcctgagactctgcatttctaacaaactcctagggaaagccatttctcttggttcaaggaacacgcctcacataggaggcatgaggtacttcatactgctcatcctgaaagccacctctgtgataaaataatagatgattaaaaatttcttatttttatttttatgtatcttccaagttttcatcagtgatcatatattagtcttataatgagaaaaaaagtgaataaattgattttttaagtagagtagtccctttccccagatttctatggatggttttccttgggcctctctttgaagatctttgaggtaggtctttgagtgggttgttagacacttcaggtgccctgcccatactactcaacatttaacttttaaaaaaaacggtggtaaaattatctatctatctatctatctatctatctatctatctatctatctatccatccatccatctatctaaacggagtcttgctctgtcacccaggctggagtgcagtagcacaatcttggctcactgcaactgccatctcccaggttcaagtgattctcctgcctctgcctcctgagtagctgggattacaggtgcctgccaccacacccggctactttttgtatttttttagtagagacggggttttatcatgttggccagactcgtcttgaactcctgacctcaagtgatctgcccgcctcggcctcccaaagtgctgggattacagacgtgagacaccacgcccggcccatatttttgatatgatatagtttggatgtttgtcccctccaaatctcatgttgaaatgtaatccccattgttggaggtggggcctggtgggagatgtttggatcatgggcacggatccctcatgaatggcttagcgctatcctcttggatgaggggttctttctctagtagtttacatgagatccggttgtttaaaagagtgtggtatgtcccctcttctctctctctcagtcccactctttccatgtgacaccacctgctccctcttgattgtaaacttcccgaggcccttaccagaagcttatgctggagccatgcttgtacaacctgcagaactatgagccaattaaacctttctttataaattacccaacttcaggcatttctttgtagagataccaaaatggactaacacaccatcttaaccatttttttaaattagtttttgaaatagaatctcactctgtcacccaggctggagtgcagtggcgcagtcttggctcactgcatcctctgcctcccaagttgctggaattacaggagtgtacctccatgcccagctaatttttgtatttttagtagaaacggggtttcgccttattgaccaggctggtctccaactcttgacctcaagtgatccacccactgccttggcctcctaaagtgctgggattacaggcatgagccaccgcacccagccagtcttaaccattttttaagtgaacagttaagtgacattaagtacattcacagaattgcacaaccatcattactattcatctccagaactttttcatttgcaaaactgaaactctatatccattgaacagaaacctccattcctccctcccccagctcctggcaaccaccattctattttctgtctctgcaaaattgactactctaggttccccatataagtggagtcatatagtatttatcctgttgtgtctggcttatttcacttagaatgatgtgctcaaggttcatccatatggtagtatgtgtcagaatttccttgtgttttaaggctgaatactgttccattatatgtgtataccacattttgttgatccctcatccatcaatggacacttgggttgcttccaccttttggctattgtgaataatgctggtatgaacatggatgtgcaaatctctcttcacatccctgctttggtacttagcatttttatgcccaatttccaactgcctgcatctgtgtcttcttacctgagggtgtcttctgaccacctgccgtactcacatatgggccgaaaagtcagtccccctcccaccaattaggatagaaattggtgtataactataccaggtcccttgcttctggggtggaataactggagaagtgtattcttcacatttccccgagttccccagtgggatcagaccgcagttacccttggtggtaatctgcttgatatcacattctatactggcttccttccctggttcacttttcctcagtcaccttgtgtttcctggaatatttcctcccaaataaacttcttgttctcaaatactgacttaaggtatgcctaaaggagaacacatctaagggagttaaaaaggtgcactgtgaatatctatttacacccagggatactctctttttggagagcaacagtgagatttcaatatgtgtggtggattcttagttgggggtacatctgccttcccaccccattcaagtgatgttccgaataaaattaaatctgttcatatgagcatttaaaccttgttgtaacattttatacacatgttttcaaaactctatttttgcttcgtttctaactcaacaacttattctcccaatttaattaccatacatggagctggatcccgaagaaagaagaaaaacagctctacaaacaaataggtcttttgttggataggatagttgttttctatatatagattcttgtttcttccttttgctaccatgtttagcctctggggcttctcttggttgtatctagtttgttgttcttggctcattttggcattctctgtgtattgtatttttaatattaaattatgtatttagcagcaagcttagaaacagatgaagtttcttgtactagagctgctactcaagatgaaaatgcaatgcagccgacaatgtaagtcagagctgtgcttcagtgtctttgggggtgtctggcttctagggaggtgtgaagttccattgatctttgggagctgttaatgtaggagattagtttaagtatttacacaccaaccttatttaaggcagctactgcagaaactcagtaaaccatttcaaagggaaaatgtgtgcctttctaaaaactgcagccagcttccacactccccacaccaaaaataaatcttttaattgtgtatgatgcagtagatgcatgcatacttcaaaagtctgcctagatcttcctcttctgaatttaaaagataaattactctaattgctgtgtcgtctagctggtttatagtaaatgaataactttcaacgtagaaagcagttacagctacagaaaatagacagtaatgtcactgcaagtgtttcctctttaaagtcattgaaagagtatcatagcagatgttttctgttttggactgttttcccatgaaacccatggatgacgtttgcacatgataatttatctccttaagttaggaacaaacttatctgatttcatatactggaggttggaaatcctttttgttaacttagcacagtggtaactggaaaaaataagctttttaaaaagtaggatgaattgaagttgtgatcagataagcaagaagtaatatgaagcccaagcaaagcaaacttagtcattgtttctctgtgccaacacagaccatcatattcattatgtccatcaaaataggggaggtctaatttagacagataaaatgaagtccattcttctttgtgaaaggaatcggagagtttcctgggaaaacagctcagcctctctaagcctcttgcatgtccatgggcctcatggccagcatgtaacagcatcatgtgaagttacattgcatgcttaggggtggtactaatagcataacttgactctttttttttaattcaaggagcaataactgactttctactctgggccagatctgctctgttctgaagatacctgagaatgatcagttctttctgtttagctagtaatctttcggtacatctattgccccatcaattgatttatcaaccaattgactaactgatcgatcaatctctcttccctctttctctccctttttccttccttccctccttctttccttccttccttgcttccttccttcttttcctccctccttctgaaacaaaatattaagctaaagctagagtcaggcagcttcctgaaagttgagctctgaatcttaccttgggtcctcagtaataagatattattggatctctgtgactggtaataactttacttgttgaaggaatgagattggctcctttgagtgcagttggtggttaagggcatagcctctgtatcagagtgcttctgtttggcccaggaagggactaacgtgtatggtggttgcagttttaatttgatatagattgattcatatatgtagtcactgatttttaataaatctgttggttcgtagttcaaaaagtctgggcaaaagaatctggtttacaaggaaatcctgttccaaccatggtagactgttacatttggtgaccctgctgaactctgcctcctatcactcatgcccttgtctattatattcctcattgactctagacttggccatataacttcctttggttgatgggacattagtaaaaatgatacaagcagaggcttgataatcatttgggcttgttttcttggaatgctgcttcttggaagccaaccttgatgctacataaatgtttggactagactattaagtgattggccacatcgatagagaccctgaatgatgagaggccgtctcgcatgttccagccccagtcaaactcccaactgactgcagtctattgagtgacctcagctacaccatttacaacagaagaactgcccagctgagcacagccaacttaatgaattgtgaggaataatttattgttgttttaaattactaagttttacagtagttagttacaaagcaatagataactaaaaccatgtcctactttacatggtctgtgcaaaaggacaaaggggaccttgtgtatgttgtggctcatagaagactgcatttcataatgctatagtgccattaagagcatagtcagcaagggcataatgtttgtgtgtgtgtgtgtgtgtgtgtggttgttaaattgtgagatcactgcttctacctttgcaactgaatgtcatgcagtatttttatttccacatagttatacttaaggaagctacctttaagagtaatagctcttttattcattcaggttgtgaaagacactgagaattatgaagaaaagagcagtgactccaagtcctacaacctagagtccaactttaggaagttttcatattgtaaagatggttaacataatgaaaaactatacttgattcttattcataagcctggtgaataaattagtaaattagatccagttgagagtgctgacactcttgatatccttataaaagtgcttgtaagcatggacacagatatgtggattcttctattggatttatcgtttgcgatgcccaccactgcatttcattctctacattgcaatcagattgctttttctaaacggcaaatttctgacttatttctgcctatacaatagctcctcactgcctctagggcaatggttctcaactaagggcagttttgcttctaggggcatctgacattggagacattattgactatacttgggcactactgtactatattgtagtgactaaaatagagatgctactattttctagtgagtagaagccagggatgctgctaaccatcccacaatgcccaggaccaccccccgacaacaaggaattaaccagcccaaaatgtcagtagtgcctctgttgagaaacactgctgtagggtaaggccctaactcctagctgatgcttccctttctaatttcatacctctgacctttggctcatacttgtcatgtatgcttcttatgcagcagcaaactacttcctattttgatatcttcttacctttaggtctttgcttatgttgttctcatagtctgtgggttttatcattgtgctttgtgcatacttctgtttttctgatcacactgagttgcaattacttttttttgttgttgttgagatggtctctcgctctgtcacccaggctggagtatagtggcatgatcttggctcactgcagcccccgcctcctggattcaagcaattcttttgcctcagcctcccgagtagttgggactacaggtgcacaccaccatgcccaacaaatttttgcatttttactagagtggggtttcaccttgttggccaggttggtcttgaactgctgacctctggtgatccatctaccttggcctcccaaagtgctgggattacaggtgtgagccaccacacccagtctgcaattactttttaaaatctgttgtccctacaagcttgtgagttcagggtgagctagcaccaggctacatggctaggaagtatttgatggaaagaatgaatgtttgcgtgagaccactaccggaaaaggggctgaagctgcataagtggatagctgacccaccctcagcgagctttcctcacattgggtgaatcattcccatggaggcactgtggacagcagctctccctgtgcacatgattttaatgccacttcacagtggttcttcctctgtctttttgtgttttaaacctttaggagacatcagtgtcaactccaggtgggcttcacaatactccaggtagctttgagagacaacgtaagacatgcaaagagtgtgaagacaaagctttgtgcctcaaatgtcctactgtaaagaccagggcaggggagaatttttgagaaatgaaggactggttcaaggcactgtcttttgccccaaggcggcattaacattaatttagcataatatagaccagttattctcaatcttgcctgcacatcagtatcatctgggttcctcaaaaaataccattgttggtgtccagccccaagagctattggtataattggtcttcctgagtttcagaatttttaagtttcccacatgtttctgttatgcatccaactttgaggacaactgatatagaaagtagattatagatcttcaagttaacatttccacagtaatttactattttccttcttggtaatgtactgttacttaataattttataatttttagcataagtaataaattagtacttctaacttcattcaaatttataattgcattaatttaattaatatgtaactttttggtaaatgacattgtataaccccattttttttaatatccttctccctcttggccctgaaactcagaagaaatatcatcaagaagcagctgacccgtcttcatgttggtggaagttggaaggaagccattttttagatagtgtgcccagaaagacacaaaattagaactttccttttggttcctgttctgcctcccgtttccaatacccacagttctgtttgcctaagagaaaaagtaggagcatcccccatgatcccagaaagtccttctcagaggctaattgttactttttatgttttttatttgataaccaatgttatacttgttatgaatgtgctagttaggaagaaaagtgaaagagctgtctaatttattctactcatcttccctatttggtggttggaatgaattttggcattattttaaataggaaagctagaaatcgtagttttattcattccatgacactgtatgtcaagcaccaattttttttaaagtttatgaaaatttgggatccaatgacttttgccattgagtaggtaagcactgctgtagaatggctccttttggcagaagataatagctttcaaggcaagaattataatcatttaagctgtagaattttagattactatattgtttcatttcaagagggaatgttagggtagaaagaaatggtcaaaatgatatagatagtgcaaccctcccaacttctgcacaatgtgtgtgtatatatatttatatacacacaaggtttttatttgtcaagtatacctcactagagccaaatatacaatttaactttaacgattatataatttttatttgtcaagtataccttattaacactgaaaaaacaaactaacccccaaacaaaggcaaaagaaaccagaacaatttgtacaccaaaaacaactaaggctcagagtaattattgaattcatcggttgatcattttttatggaatatcctgggtctgcctctcttggaagtgctgtgttgggtgtgaggaatgaggtggtgaaatgatttgcccatggagacatatgaagttacagcagagccagaactacaaagcacgactttgtttcttgagggtattaatttataagaaatttccaggcttgatttttctaatttccccaccttgattttttataggtatatcctataatgggttaagagggtttccaatagatgtttatgcaaggtttgtgagttttaaaatgattggttatatttatgctgtcaaacctagaaaatttgattaaaataatatctaatagccatttggttaataagttaaatctttactttctaaaatttcttttttctattgtatagaaaagcacattttgcttttcctgaattacctatgtctaagaaaatcctctgaagaatggagttgtgcgtaagtcctagtactgggacacataattcatgtcccttttactgctgtaaatttttagcaagcttttaggttggacaagaaacttagagctccccttatctaagttcatttgacagatgagaaaattgaggcctggggaggttgaattatttgatgaagtttacagagctagtctgaagccaagctggggactagaagtcaaaactttttgaccccaaggtcggtacatttttactttagtgcagagtaaaaactgtaggcagcatttcttatacacataaatgcacacacacacacaccccacacacaatatcctcacactctaaagtgagtctattttcagaagtgtgggttgttagttatgcattgtcttaggttggcttctcccaaagctggtttgagtcaaggattggagtgcaagtagctcacttgggaggtggtcctgggaagcacccgtaggggagtggaggaagtgagataaggaaggaaagtcagccagtacagtgtgtgccgataagcagattccactgtgggcaactgaggctcctctgtgctggggcccttttggagactgggtagaatatgcttccgagttgtcccacaggaaaggcaggcaaggagctgggctatttatttaccagctcctaggtcactgcttgggggcttttcctggaagccttactccttgcacttgtagctgaaaagtctacaaaagagggtttcagttcctagaggaaggctttttaagtgtggttgataactgaatcagtgggaatgtggagggattggcagatcactggcaacttctgtgtgcactcagaaagaattgcaaatgggtgtaagtgcatattctacacacagtcgattccaatatgacaaacaccttgtctttgctctttcctctttccatcatatacttactgctttcatatgggaaggatagagctgagaaataaatattgaaactgataccatcagtgttggatattctgtttgccccttgagagtcactcttcactttctccagcctactctcctgaggctgggcattaattgcaacattggtgagcttccttgccctctggctttagaatgggttcaggcagtgggagcttctagaggagactggagggaggagaactgtgaggtcagttgcttaagagactcccgggtctcttcttgccaacatgctgttggttgactctgtccccctcctagaagccacagtcgaccaggaagatctcttctgtcgttctaatactattcttggtttctgtagctctgtcctcttactccttcaggcctaggacacgtcatattccctgcatggtttccctaatccctgcccacacctggtaaataacctcttattaaactcccttgttgccccgtttgagtgttccatctgtttcctgctgggaccctgaccgaggtaacatctttgaggcatttactctctagacagaatcagatgaaatgaaacagctagagatgttatgaaggtataagataatgaggcataaatcgtactcaagccctaaggatactcagcatgtaggatccattaacaaagaagggttacttactaaagaagatgttttttggaggggtgccttaggttgtaattggtaatctgtttttctcctgctctgtgggaagctctgtttaggtagtgaattgaaaattggattctgccttattaccatgtatgcagttaattataatgtatttaactctataaaatggaaaatttgtaattcaaagaaatagaagggtgaaatggatctatccatctggaaatttcagagatttctctcatgtgtgctaattttagataagtaagtattttccccttaattccttatgtttctcatccctttaatgggttataatttatttttctcaagtttttttttttttttttaagttggtgtgaaaggcatttcaagctgcttagaataaggggctagcaacagaaaacacccattctgtatgtatttacagagggcctcttgtgattcaggcactttgcttaagtaccattaactcaataatgaatgatatttgatcattgctttcaaggaaatcacaatgtagtttggaaaatagaagcccaaacaaatacttgtgacaaatatttttaagtgttataagtatgtagagaattttacgtgcatataaatgaggatttataagtaagtctgtcaagaaaaggcagagaggttagtgaatgacagaaatgtttcatagagcaagtgacattgagttgggtcttgaaggatgataatgaacgtatcaggaagataagaggaggaatggcatgaaggaaggtgtgcatttcctggtggcttgaagattcagtgagaaatatgatttgggagaaatgttggtggcctttggagaaatgcctggacttcggccataggatagaatggtaatctgattcttaatatgcatcatcacttaaaataatatagactaaaaatattagttaaaatatactctaaaaatattaggggagtgtaaacaaaacaaaaataatatctttggggatctttagacatttagtgggaaatatattgctagatatcatatagcacatgttttaaatactgaaaaatgtatgattttaattcaggagcatctcaaaacagggagaagacccactggtatcttctgtcactacacagctttgctcagatttgtgtgcacttatactaaatttgccattacacaattaccttctatcaccatagaattacctaaaatatgaaaatatgatgggttgcttggaaatatggtggattgccttttctatttctaatgattatattagcatccatacttcacaatcacctgtttagcagaacatatctggatacaccaaccataagagatatttgtgccttattccttctaattattctagtccctaaagcttaaggggtcagcagtcttgatgttataaggtgggctaattgatgaagactgtcttatcattacaacagttatagatgcaatgaatttttgagtgctgcttactaagtaggaaactgataaacaagaattccactccagaggcatgagcaaaatggtaactatagtacatgggtattatagtcaaagcctttgtaaatggaaaccccttaaaatggtcatgttaaaggtcattatattgtctagaaacttgaggtctcatgaagtacagggagaggaacaaagtccagtcaggtatcatggaactattaatagaatgccaacgtccagaattaagcttatactccctgtcatgcagagaatgtcttcttgtctatctgttttattctttccttatcttgtttgctaaccatgttctatctatattctgttttagttatctcttgctttttaacaaaccactccaaaacttactggcttaaaacaaccaccaccatttagtgcctttcatgagtctgggtggtaactgggctcagctgggcagttcttctgtttcatgtggtgttggctggggctcaaattctctgggggttcatatgagctggaatgctcaagaggactcactcacatggttagtagttgatgtgtttattggatgggagttcagctaggatgccagctggaacatctcagttctgttccatgtagtttctttccatgtggcttgggcttctcacagtgagggagctggcttccaagagggagcttatagatgtgcaaaagtggaagttgccagttcccttaagtcaagggctcagaagtcctgggtgaccactcccagtgcattctgtcaaagcagtcacagggccagcttccaggagagaggaaatagacttgacttcccagcaggaggagtgacaaaccatttaaaaccacattttttttttgcagaaggcccaacatgttccacgtgtcaccagccaccactattcacggaaactttcataagtgttcgtcatgaattgcctatagcctctgtgtctcttagttcaaatgctcccaagggacattcatattggttgctgaccatccagtcacctgtggttgacagggccaagtcttgtgctattaaagattttctttgaaggggctgaggtgggattagtgctctgaagattatttgagagaatgctctgtgcctggccgttcctctgaggcttgagataacttttctttccatggtccagagagctctgcctgacacttgccttctaactttttctggagtaattctctccctcatttttcagctttgcttttttgttttaagtttgtctaatatgcgtctttcctttctgctctgtgtccctgagacaagaaggctgtctcctctctcccggtccctatctgtcagctaacttctaacctgctcttcagatctcagctcaaatatcacttcctgaggggagcatggaacaccctggattaagccacatcccctgtccgtctccttttccctcatcttgctatcacactttgtaaccttataccagtgtggctacttgattatgatctgcctcccactgaaggctctagaaggcagaggaatgtgtctgtcttcctcagggctgcagtggccatgcattgctcctgttaggtactgataagtgcttgctatttgcatgatttaaaaattggaagttgagatggtttggtcatttgtcccttccaaatctcaagttgaaatatgatcccgaatgttggagggggggcctggtgggaggtatttgggtcatgggagcagatcgctcatgactgtctcggtgccctccccgtagtaatgagtgagttcttgttctattaattcacgtgagagctggtggtttaaaagagcctggcatctctcttgctccctctcttcccatgtgatatgcctgctcccccttcgccttccaccatgagtaaaagcttcctgagacctcaccagaagctggtgccatgtttatacagcctgcggaaccgtgaactaagtaaaccatctttctttataaattactctgtctcaggttttcctttatagcaatgcaaaatggactaacacagaggtagttgccctgaagaagaaaggaccaaggggagagaatatttatcttgatgaaagaagttaagactagcctcgtttcagggaatataaggacatagtttattggggactgccgctcatccccattggtgataccatgtgaatcagtgaagtcctattgttaagggtagaggctgcatgttagtttgaaatgtagcaagagttcctgcccagagatggtccataagtgcctgattaaaagccaactttttcttttctttatgcttctaccaccatggggccctaaatctgtactcagagatctcagtgatggctgaactttgtgaccattgggccagaactactcattccattcctatttgttctcccatgaagccagtatcttgtttggctgcaagccaaaaagattggttagattacagcttgggatatgacggatgcacctctgagcataatctccatgagataaccctaaccaaaactttttgtccagttcttctgtggcatgctatttatctaaaaagaaagttagtaagttagtaaaagaatcaaaatgccagatgggaaacataaagatggagaaggaaataactgagattttgttttatttaaagattctacactctttgcatgctaggatttttcaatccccacttttagattgagataaagatgggggcaatcttgtttaagttcacttaatttccctgaaataatttaatgctgtaaatatgtactgaacactccatatgtatctccgtggagggtgtaaagacacatacaagttggtatataatcttgaaatttatacctacccaggaattatggcatgcgtatatgacatgaggtcccagtgcaacaatcagataagaagggaataataggaattaaatgggggatggagtagtcaggagtgtttttatagaaaggctagacattgagctgaatctccatggatgagtagatttaggaaaagttgcctagaaagtagagggagagggcattctaggctgtgaaagccccatgtctgaaagttaaagtgtgagaaggagcaggaatgccctttcacacaccaaaggcagtgaaggtatacagggtaggggtgggaggttagggagtggagggctatggcaagccactgagtgagatccttggaggccaggtgcagaggtggaatgcttgcaagcagaggaagtcatatcataaaacctgtgatttggaacattatttcctttgcagttggtgaggtagttttgatgaggaagaggctggagccagagacacctcctgggagatgttgtggtcagcaccacaagggtggtgatagaaattaagagagagggaagtgcacaaaatgggttcagaggaagaatgggtggattttcatgtctggattcatagtgaggaatacaaagaaggaagaaataaagggatcttgaatctgggaaaattatttccatgatcaccagtacaaagattggaaatggatggtcacgccaaggttgtgtggaccagaggaatggaatagcttataagcaatgttaaataactgtgggttggttgaaagataaaggctggaggtgcaaatgagtgcatcattagatgctgttggattaaataaatccaatgaacacaaacttgggagttttactaggcattttaagcagggaagtgaaaaaagaatgtcccatatcttcagatactgacatctaattcaacagtaaattatgttgttctacattcacaacatatcccaaatttaagcagtttgtattgctggtatcactaccttctggtccagtcatcacccttcttcacctggattctgcagtagccttggagcttgtctgttcctgcttgagcccttgcccatctgcagtctgttctcaacacagcagcccaaatgatgctctgaaatagatatcagatcacgttgccctgctcctagtctaaatggtttcccacctcattcagagagtaagccaaagcactcacaagggccccaagggcctggcacgatcccttcctcttaatctctgacttcatctgttactaccttctcctttgttcactccatgttggcttaccttgccaactgcttttccttacacacactgggcatggctgccccagggcctttgcacgttctccctctgcctggaaacttctttacaatatctgcaggacttgttcctcacctccttcaaatctttgccaattggggcctttcttttagtgttgccatccctgtgacttgtacctgtccctttccttactttagtctttttcctccataacctttagtgtcttctaatatctagaccattggctgactcgtttgttgtccatctccctctttaaaattgaagttccatgacagcagagatttctgtctgtatcatgcatggacatcttcaatgcctagaacagtgcaggtacttagtagtaaacatttgttgagtgaatgaaacaaatgctgttagaaacttctttttgagtggaattttgatttccttgagatcagctgtcaataatttctatctttatattcaggcatagtcagtgctcagtaaatgttgaataagcaaatagaacctgaaatataaaatcctaacatttcacattagctagttccagaaagtttcagtactaaatgtaacatttaaaaaacggtggaggggagggatggtggaaggatagttttggtgcatttagcttagcctccactttcgacttcagaattcacattgcagtttggcaattctttcattattactatgattattaattggatgctatttaaaaatttggcttttaaactctcagctgatgttttaggagattatactatacagggtacagaaattgctggggctgactgtaactattcatggccaattaaggaacagcattggcaagaaatgcagggtggatacacttgtgctttgtgggaatcctggtggctatggcttcatagtatcaggggactagcttgctgggcttccttctgcaaaagggatcttaatttggttacctggtggatgcttttataaatgagaagaataaacagtcttgagggacttaactttgttggagagttaaagggagaaagaaaagaacaaagtgaagaaattactctttatttgggagcatttccttgagaagtctttctgaagtttgcttttagttttatttggtatcacttttatcttttcccaggggatgcagatgtgttttgaaataacgcatgcagaaaaaacaagctgtaggaggcagaaataaattcttgaaagtttagtaagtttctgaaggacagaactgcttggagaagctgggctgtaccacatctttaaggttgatgtctgggagaaccaactactgtgtttcctggtatgaccattgatgtgtttgttgatagatacaactaatggctaggttcttgcttgtacttttatgtgggactttttaaaagagttcaaacaatagggaaatatgacacaaaggaacctgaaaaacataagcagcagattacacctttgcttaactttaaggttaaaacaatccatagaaaattgttttggatttttctagctagtgaaaatactatacagccctttgcagatatagtatctaaggggtttaaagaaagttaaaggctggtgtggtggctcaggagtccaaggctggaggattgcttaagcccaggagttcaagaccagcttgagcaacaaaatgagacctaatctctacaaaagaaaaaaagaaaagaagaagaagaaagaaggaggaggaggagggggaaggagggggaggaggggaaggaggggaagaaggggaagaaggggaaggaggggaaggaggggaaggaggggaaggaggggaaggaggggaatgagggggaggaggggtaggaggagaaggagaaggaagttcaaataaaattaagtcccagagaacaaggccatacacatacgcagccaaaagatcattcatgtaacattgcctaagacttctccatggtgtcagttaggaggatgtttaaaatcagtggcagagctattttcctagctctgcctaaaagtgccggaggtatattgtgttttcagtctgggatccaaagccatgtgagaagaaacatcagagatgaaggcttttttggttttaaaccatcttagctgtgtttgcactcatttctgtcctcattaaagaggacaactggggtaactgagatagtgaaatgtatccaaggtgaaagtgagtgaaaacaaaaatatttctccagtatgtttttgtgatgagaagcaggaaatctgaaccactgagctcttaagaaagtccttcactgcacctttgtttcctgtgtcaaagaggccacattcattacatagcacaattcttggagtgaatccttcactctcaacaaatgagttaaaatgtttttctctaaaaaataaaagatgcatcttcagcaaattttatttttattaggaaaagccactactgcatcctacttttattctgggtgtgttttatatttttgacaagtgctctcacatcaaaaaaatgtgtctacattaattcaaaattcataatgatcactcttatcctgctgatacaattatcaaagttcttttttttttttggtcttctttcccctgctgttgcctagtgtttgtaattatcttttcttgaggttgggcaggggagaggatagggagagaatgttcagcaaaaatcagtcatatatttagtgtggcttcccattcgttcatttcatcttccatctatccatttatctttccattcacgcacccaaccatgcaatattcattgatcatctgtgagccacctaaattggaatagcaaggatctctcctatcaaagagtctagaataaatgccaggcatttacagtgggaaaatgttaatatcaggtaaattctgtcttggggagaggtcttgtgacctgtttttgggggttttagggaaagcttccaggaagcagtactgtctcaactgatacataaagggcaaattgaagttagctggaagaactgcatgtttgggctagagtgtggttaagcaatgaggaagaatttccagcagaagaaactccatgttctagaggtcatattttatgtgagggttgtatttctaaagttcttgcaaatttggaactcccatgattcaaaataattctgtcaaaagatggtggatattttcatttaccagctaacatggccctgtggccactctgtaaacagagtttagagtttcctctgccccagccagcatcaaaactacaattcttgaagaattgtttcggtgggggtgcctacatagatccaaattaatgtgagacaatattagtgcttttgtatcaccttatttcaaagctgcatgattcaggttcacctcaaatatgaccaaactctggagtttcagagcagtagctcatggcccatttgatggtattaaaagtagatcaggatggatagcatgtacacacaagactaggggtgagggagaaaggagataaaatggataaggaatcagggaccaggtcagtgaaggcttgtaaactgtgttaaaaggtaaaatagtcacattaacattttaaagaatttattcgtgtagatagtaattcatgaattgggcagcatcaggtagtaagtggttcagggctccgctgaaagggcacaaggggaacatttttataaggtgttctaggaagcaagacaaaagtatttggttaaagtggaaagtccctagttagaggttaattggtagtttctgactctttacatggtattttgactcacattgattaggttttggtttacttacttaggaacccaaggtgccggagccatctcagcctgatggcttctcagttagtttttaaaagcaattataataagaggatggcaatggggagcctctgaagaatgctgaggaaggaattggcgaggtcagcattatgcttttgtttaagtgtaaatagaagagagctgaaattagaccatatgtggatttcagatatttttggaacatttatcttttatttcttattaaactttgcttataaacaatgtaagcttttgtgatatcaaagtcctcctcttaaggtgttttgttaatttgcttttgaagagtccactaatcatcttgtgagagaaaataaaagacgtggcctgattggcaaaaagattggatagaggttcaacccagaattggggtctaaggctaggggagaatccgattagggaatcatacttggaggtctatggtaaaataggttgtgggaaatatgggttagacaaagttaaatagacttctttattgtggggcttctagatccttaaagacattaatgtatgttaaggtgcataggatgtcatcaacttgtttcacaactaaggaacctttgttccaaaagtagtcattacagtctggctaaggactagtattccaaggaatatgtatccgtttccttttgccacaataatgctgcataataagcaaccacaaaactgcagtggaatagaataacatatatgtatttagcctgtaagtttcggggggttcagctgctcaatgcttgactgatttcagctgatctcattcatgtgtctgtgctcagctatgggttgggcaggcagcgctgggttagttcatatgtctaggggctcagctagctgttagctgacctagggtggcatagctaacatctatgctagatcagggtgactcatccctgctaaatatgtgtctcatcctaagatactagacctagcatatactcctggctatggcagaggagcaagaatgagaacaaactcagttgtgcaagcacttttcaagcctttctttgcatcatgtgtgctaatatttccattggccaaaggaagtcacacagccaattctagagtgagaatggcaccacaaagttacgtagccgagactgtggttacagggagggagaattgtgctctttttgcagtcagactatcctagatcccaacttagaaattgcaggatgagattacagtcaattgagcaaggaatgaggtcagacttttctccatgccatggccacaggactgtacttttgatactgataagcagcctcacaaatagatgtctgagccatgtcaaggaagagagagttcatctgggtctgcacaggtctttattgtttttctatggaattatttcattgaaggctgaaaggattgtggacatcatctagttctagttgcatcgtgttggcagtcgtgaaggagacagtcccagagaggttaattgggctccttcaatccaaacagctatctagaagcaaatctgggccttgaacccagattctcaagccaattgagttttaattacctcaaagaagctttgttgtggggtggaagggactgaaatgtatttgcaatctttatataggaacaaatcacattcctcctggaggaaatgaaatataaatgatttttgaaataggaagaatagagagtagtcatgccttgttagatgtctcacaaagggcaaagggtaaggatagttaagcattgagtgattactgaaatactgtggctggagatccttggtaatagagtttcgttttcagatttttttttctcctgtctcttccctcgccccaagaatttctcctgcatcagggaagtcaacagaggacttctgagcggagagtaagaatttgtgttctagctccttctttatcaaacagaagatacaattgtgaaggcagacccagccttctagaatagctggcacattaacacctaacttacctgacattggtagggaacaatctgtgctacataagtaaaattttgataatgaaatcctaaccatttagcactgtcaaagtagctgttttcgtgatggaaatatttctggtccaacagatgtgtttccctgatttaataaacagaataattgaaacttccagcctcatccttttagacatcagttattgaactgtgcagtaatatagaaacatgccttgtaaagagccatgtaagtgtaaggtgttgttattgtttgcttgggtttctggagtatgtgggccacttggctttagacagatctgctttctaaattcttgtattccttgtttgttttcagagggttcccttgccctctggcctccaggtaggtgtagccaacaggaagcactggtggaaaactggagggccagaagagagagaggtcagggtgcctttctctgcctctctgctttctttggtatctctaggaacacatgtgtctcttccatgtgtctcttccaatcagctctcaccagactccccttttctccacagcagcctgatctccacggctgttgccctggtctctgtcagttggctctagcctctaggctctgataacgtcacatccttccattatcccacctgttagggaagatagcagctctcctcagttgctagtctctgggctgcttcactgtccctctgtggtctgtcagtcattctcacatctgtaacaagtcacctgatttgaaagacctagagtagtttctgtgttctggttgactttgactaataacgatttattgaatttgccttctcttgcaacccttacttccctcctgatttgcttcttgcaacgtactgtgcaggtgacatccacgttatgcagtttatttcattggacataacaatggaaactcttttaagcaatagagcacagtggttttgagcctgcgctctggtgttagaatgtttgcatcgtagtcctggctatgctactcattggctatgtgactctgggcaagtttcttaacctgagactgactttttaatctaaaaaaatgaaagtaatttcagtacctaagttgtctcaatatgagtttcctgggaaacaaactcccaactggaggttggtgtgcagaggtttgtttattctcaaatactcttcagattaacatctgtggaggggaaaggacggattcaggactgggcagagggagaagttgaactgcagtgcaatcttaacaagagccttagttaaccctctgaagcaggttgggcgcttattcactgatgttgaccattggaggcagttgaccgtgaatggaacagcttcctccagctgagggaattttccagagaggactgacagttgagggcattctgcctgcatcactcatagtagcaaggaatcaattcttcagtcctgaagcagtgtctgggcgtcacatcacagtgtccatgacctatatccaggtgtgtaatgtgaaagataaatacagtgattaaaccataagaaatgccttgctaggtgcgtaccacttggtgaatgctcaacactattagttaacattattgatgaattaaatacagaagtttcagttagtggactttatgatgtctagtgtagctattctgagagttttgactgatttcttctccataacccagtcctaaagagttgaggaaaagcagagtaagtggtctgggataaatagggttccatgatttgtatacatatactgtcatgcacatttgtactttcctatgacttttaatgtggtgtctttaaatatggcttacccataggttcttgtatctttattccttaaggtattcaaggtatttagcatcaaatttggtacaaatcaatgcagcttccattttttgaatacttactatgtagccatggtgctaaacatgcatcgtctcgtcagttctcaggatgactctaaggtgctgagattcctagtttagaaggaggcctgaggtcagtgaagttaagtgacctgccccaggtcacccagccaagaagtggcagagaagttctcctgccagggctgccagattcactgcgagcctaggcttttcactacacatttggacgatttaagcagcagtaggggaaaccttctcctccgaaaataactctagcaaagtgtaggtgttgttttggtagaaacatttcagctgttgccataaaaatcttcccccaaatggctttgtgagagcaaagctgtgcaggctctgcttgtgtttatgatgggagccttatggctcagccacaacacaaatgatttgtttttctggccttgttggcaaagtgatttaatttctgggtttccctgaggaaacaatctaaacaaatacagtaggccctccatatctgccagttctgcatccatggattcaactaagctcggatagaaaatattcaaaaaatttaacaatacaacaataaaaatagtataaataaaaacagcataacaaatatttatgtagcatttacattgtattgggtattataagtactccagtgatggtttcaagtatatgggagaacgtgcataggttatatacaaatattatgccattttatataagggacttgagcatctgtgagttttggtacctgtgggggatcctggaaccattcccttacagatactgagggatggctgatatggtttggctatgtccccatccaaatctcaactaaattttatcacccagaattcccacatgtggtgggagggacccagggggaggtaattaaatcatgggggttggtctttgctgtgttattctcatggtagtgaataagtctcatgaaatctgatgggtttatcaggggtttccacttttgcttcttcctcattttctcttgctgctgccatgttagaagtgcctttcagcctcccgccatgattctgaggcctccccagccatgtggaactgtaagtccaattaaacctttttttcttcccggtcttggatatgtctttatcagcagtgtgaaaacaaactaatacagtaaattggtaccagtagagtggggcgttgctgaaaagatacccgaaaatatggaagtgactttggaactgggtaacaggcagagattggaacagtttgaagggctcagaagaagataggaaaatgtgggaaagtttggaacttcctagagacttgttgaatggctttgcccaaaatgctgatagtgatatagacaataaaatccaggctgaggtgatctcagttggagatgaggaacttgttgggaactggagcaaaggtgactcttattatgttttggcaaagagaatggcagcattttgcccctgccttagagatctgtggaactttaaacttgagagagataatatacggtatctggtggaagaaatttccaagcagctcagcattcaagaggtgacttggatgctgttaaaggctttcagttttataagggaagcagagcataaaagtttggaaaatttgcaaactgactgtgacagaaaagaaaaacccattttctggggagaaattcaagctggctacagaaatttgcataagtagcaaggagcctaatgttaatccccaagaccatggagaaaatgtctccaggccatatcagagaccttcacagcagcccttcccatcacagacccagaggtctaggaggaaaaaatgatttcatgggccgggcccagtgtccctgtgtggtgtacagcctagggacatagtgccttgtgtccaagctgctccagccatggctgaaaggggctaacatagagcttgggctgtggcttcaaagtgtagaagccctaagccttggcagcttccatgttgtgttgagcctgtgggtgcacagaagtcaagcactgaggtttgggaaacttcacctagatttcagaagatgtacggaaatgcctgtatgcccaggcaaaagtttgctgcaggggcggggaacttcatggagaacttctgctagggcatcgtggaagggaatggggtcagagtcctcacacagataccctactggggcactgcctagtggagttgtgggaagaaggccactatcctccagaccccaaaatggtagacctactgacagcttgcaccatgtgcctggaaaagctgcaaacaaacactcaatgccagcccatgaaagcatctgggagggaggctgtaccctgcaaagccgtaggggtggagctgcccaagaccatgggaacatatctcttgtatcaatgtgacctgggtgtgagacctggagtcaaaggagatcattttggagctttaacatttgacagctctgctggatttcagacttgtatcggccctgtaaccccttcgttttggccaatgcctcctatttggaacagctgtatttacccaatacttgtaccctcactatctaggaagtaactagcttgcttttgattttacaggctcataggcagaagtgacttgccttatctcagatgagactttgaactgtggactttgggttgatgctgaaatgagttaagactttggggggctgttgggaaggcatgattgggtttgaaatgtaaggacatgtgatttggaggggccaagggtggaatgattttgtttgcctgtgtccccatccaaaactcaacttgaattgtgtctcccagaattcccatgtcttgtgggagtgtcccagggggaggtaattaaatcatgggggttggtctttgccgtgttattctcttgatagtgaatacatcttgagatctgatgggtttatcaggggttcccactcttgcttcttcctcattttctcttgctgctgccatgtaagaagtgcctttcaacctcccgccatgattctgaggcctccctaaccatgtggaactgtaagtccaattaaacctttttttcttcccggtctcggatatgtctttatcatcagcatgaaaacaaactaatacaatggctttaaatttatttgtaattggatgtttaaagaggagccacaagggaaagtcaaagtgggtggcccaggtacgttttcattcagtgagtgatacgataaggggaggaataaggtgcataggtgaattcactcagtgttctttcttcctagtatttggctctccattcttcatcaggaaatgattattataatcaaccaaaattttgcaaacaaggtgggcatttaggtatgtaggtgttcagcattatttttggagaacagagcaaatccggtcattatttctttttattgaaataaaagtaatgactccttttctgtaggaaaaagtaatttttcaaaataggctacatggtactgatgagaagttaggaagctgcatgatattccagtcagatcaggatcccagactcccatctttctggtccactatcttgatctttccattttccattggtcacttgggcaaagttcggtttaggccatcaggtccacagtgcacatgtgcagcgaggagggattagagagaagaaaggaatccttttagttgaggcatctcctgccatttttgtcatcttactcttaagttccatataacactttaaaaaaatttttcttgaccaatatttggtcacatggtcacatctcagtgcaggagagcctgggaaatgtagtcttgttttgggcaactgcctgaataaaattggggctctcttactgatgatggagaggagaatgactattgagttataactggcaatttctgctacatttgggattggaatactaatgccacaaccaaaagttttgaaatgatggagttaacattaaaaggtgaattttgttggtgtgtgtttctctaataatgctcagtcgtctgtggctggtgtgcataatgaacatacacagctcctaaatctgcttcactctggccccctttcctgggggaaacagtgtttggagaagcacactttatgtcattcaacagatattgatcagctaccatataccatgcactgtaccagatcttagcagagtctaggagctacaacattttccacatttatttgaccacctctcccacaaccctctccctccctccctcctttcctttccctccctcctttcctttccctccctcctttcctttccctctttcctttcctttcttttcctttcctttcctttccctcccttctttccttcctttttccctccctctctccctcccttccttccttctttccttccctccttccctccttccctccttccttccttccttccttccttccttccttccttccttccttccttccttccttccttctgcttttggggtacaagtggtttttggttacatggatgaattatgtagtggtgaattctgagattttagtgcacctatcacacaagcagtgtacattgtacttaataggtagttttttgcccctggcccccctcccacccttccccttctgagtctgtaaagtccattatatcactctctatgcctttgcttacttatagcttagctccctcttataagtgagaacatgtggtttttgattttccactcctgtgttacttgatttagaataatgtctccagcgccatccaagttgctgcaaaagacattattttgttccttttaatggctgaatagtattccatggtgtatatgtaccacattttctttatccattcattagttgatgggcacttaggttggttccacatctttgcaattgtgaattgtgaagactcaattctttgttgaaaagagctgcaaagtcactttacaaagggtgtggaaagctgaagaacttgagattcagggcctttttagctgtcaatctactgcagtgtcccagggaggaaaagcttaatttgtatggatgcttgattctttctgtaccttttctttctctgtttccacaaactcacccagttaaaatttctgttcattgaacacgatggcagctaggttgatgggattaaatcagttgtctttacctgcctcagtgtgttgggatcctcaaagctcagtgaaaccaccagctggtgaataagacttctgagtgggtgggtttcctgatctcacttgatgttttttgggacaatagtgatgccccatttcctttgtgctctgtagctaaactcccagggagtaagacatgtggcataaacataacctcatagactatacctacatcgtgcccactttagctctttctcacttttttttgtgtgtgcctccagaacacacaagacaagtaaatacagtatggacaataagttacgagtgaggagagagtgttttgagacagccaatagcaaacatcgtggagaacttctctttataggtcaatatccgttgtcttagtctgttaaattcttccagtcatagactgtgcaatgtatgcataagctatcaacacttaaaaaattatgatggtcactaagaagaccttttttctgtacactttcagtgcttcttcagtcatctgccatgggtacttctgttcttcatctccagattgtttctggaagtcctgtgggcagctctttaacactggaaacatgcagtctcctcatccataaaatgggcaatacctctctcaatgtattcgagaagtcacgtacaggtcacatatgaccattactcataatatgtaacactgacatggcactaactatgtgctaggtacagttctcaacaggcttatgaggtaagtgttattacagtcccattctgagatgatggaattgaggcacagaaaggttaagtaacatgccagtgttgcacagacctgaggtttgcacccaggtagcctagcactgcagacctgtttcatattcatgctgaaggactaactgcctctgtaggtgtgagtactgtacatggaaaagttagagaagtaaaggtctaattttgacagaattgagaggggagggggcattgacttaggttttagaaattaacttagactcttagtacataggttgctgtggcaatttacatagctatttctttcaggtacatttgacattcaaaagcaatcagatcgtattatctgttctttgagggattactgggctctgtgaatcttgaaggttacatttgcaatcagcattaattttattgttaaccattttccttcatgttggttacagggttgcctccctccctccctccctccctccctccctcccttccttccttccttccttccttccttctttccctctttgggctttagtggagcttataactagttgaactagatggatcaactcaagttgattattcaggaggccttattatcccccagagagcagacacggagcttggctggacctcacggatcactagtccatgtcactgcacaatgttcttcctctgttcttcgctattttagtccaaaatgcctgctaaatggagtggagtgaagaaggcacacaatgttaatatgaagtaacttccccagtgcattttctgattcatcaagatgctcacattaagctacatgaacaaatggaggaattcccctggaagccaaggacagagaaaaatcatatgaaaaaaaaaaaaagataaataagagataccaacttgccttttatattcaagcagattttcaaaaagtctcattgcatggaaagtggctataatttaaacaaaaagtcatttactgtgctaacattcatgaagatagcaattcttgggatgctgcatgaattgggcagaatgttaaaatgctgaaggaaccttgtgtctggtttaaatacattttggttggtgtcatataggtaaggaatggcagcctcatttttaactcttagtaattaaaaattggaacctttaagtagggagagaaggaaactatagtgtggaattcaagatagtgcacttgattttctcattcctggggagtcacatgggtttatgagactcctcaattgtttgacatttcatttaaaaaataaaacaacaaaatgagctttccctttcatctatacaagagtccatgaagaagcctccttctcttatgttgtaattcacagaccaaagagttgagtttgagtatataattactcatctagatatatttacaaaatactagtaattttactggtagtagctcatttatgctgggtgtgatggtgcgtggtcctagctatttgggagactgtggctaaggagcctcctgagcccaagagtttgaggctgcagtgagctgtgatcatgccatttcactctagcctgggcaacagagtgagaccctatctcaaacaagcaaaactaatttatgttgaattcttcctatatgtcagctagcctttcggccctttacctgttccaccatttatcttcacgataaccctttgaagtaggtactatccttgtctccattttacagatgagggaaccaaggcacaaggattctaagtaatttgcccaaagtcacacggcaaggaagtttcaaagctaggattcaaacccaggctattataatcactacactacaagtattttcaaacagtgtttcccaatatcagtcatacagataccatctgcatgctttttgccatagttgtattttacttctattattatttaatgtttctcactttttttttttgagacagagtcttgctctgttgcccaagctgtagtgtggtgacatgatctcagctcactgtagcctccaccttccgggttcaagtgatcctcctccatcagcctcccaagtagctgagactatgggcaagtgtctccacacctggctaattttttttttttttttaatagatttgggattttaccatgctggccaggcctgtctcaaactcctgacctcatgtaatccaccctccttggcctcccaaagtgctgggattacaggcgtgagccactgcacctggccactctcacgtttttttttttttttaaccgtacaaaacagtatttaaaagagaaaccttacacctctatcttaaatggaaaactattatgtgtgcaaatagtagatacccaataaaaactaaacagtgaaaaccatttagtgttattcaatcctaagtagatgccactggctgccaaaaaccctgcgtcagaggacgtcctttctttattgagacagagagattttaaaggcatgctctatagggttgagactatttgatgcaatcagttcagagtcagggattaaatttttctactaggagagtctgtcttattccatactgaatttgtaaatcatctaaaatcaccttgtagtttattagtgttaatggctcctacactctgagaatcacttgtctaaaatacaaagatgttgtactgtttttagaattatcttagggaaagtgaagcagaaagatgtttaaatgaattcaggcctgtattattaagccaatccaagtaaagctattatctgaatgattagccctaaagtcccttaccactttatctggtctctagaaggccagtttaggttgctttgtgggaagatgtatgggtgatttttatccaagttattatctaagaaggtgtggttactcctgaattttaaatcagactacttagaaaatggccttaaattgatcctttttttatccttgacagatacttattggttgaaacatcagagagctttaagctttctcaagtacatgttggagaccattgggactagtgtccctttgttaccaagaggacagtgtatgatatgcatgattaacataggattattatatattgattatagtgcaaaaagtaaaaggtgtcttttcatctttgagtttaaaataaagagatttagcatgtttttgtgtgataagagggatcttcttaattcccaagacctctttaaaagcaattcatgaacatacttaagactcatcagttgaacaataagttaatctgcatctgaaggttttgctgattatctgatcatataatttccctgtattctgattatgtttttctgatgccttttacagtatatgaattcttaatcaagatgattccgttagcagtagctcctctatacacagtgagcccaggagggcagagagcttggcttgatgaaagtttttacagacataaagatggtgaatgaaactggcttcatcttgctcagtatctattttgaaatattatatttaaatattaaacactaatattaaatattatggttccaaagtcatagcaagatattaactgtggcttgcatggatggtgaaattattacaatggtcttttaccgttcagtgtgctcgtgaacttcagaaggcttctgatagattttaggcctgtttagttgcccatagttagggagaagaggtggccatactacaggaagacaagctgaacgtccctccacactaaagctgccacaggacctgtgtcgccaaggagctgctgctcagttctagccaggacagcagggtgagctggatccaactccgtttggtggcataatagagagcacctttatgtgcaggtttcatctgttgagtagagaattgtggctgggagtgtggggggtgggtctctaacatttgctgtggcttatttagatgtagcccttaattgtcctgccctgccctgggctaggttttggaaaccagagctcgttagaagtgtgtcctggcttggggaaaagatgaaagaagtccaggatagttaggtcctcaaggaagtggaccatgtctgtttattcatccgtatatacctggcacctgacacagcgccgggagcatggtgggcactcagtagatacgtgttgagtaaatgaacgcacagagttaaattgggcagctgatgtttttggtattttataatttttgcttggtgacaggaaaccacaacaaaatatgtgcctgtgtgtgtgcatgcatgttttatagcttcctgaagaaatagaatcaatttcagtttttgcaactaaaaaagaatgcagaaagtgagcttggagtgaggagctgctttcttataatgacaaagaatagttacaagctgttttctagaccgaggtaatggtggaggtaacttctgctcctttgttctgtgtatctttgtgagaagggagagcctgcaagggcatagaaaagggagaagccttgtggaaaacagagaggtttcttctggacttcgggtttggaggattagcagaacatactagaaaataaggttctttctcttgggaaattactcatgctggcagcctgaaatagcatgaaaaggacttttattagtggcaggtcttcagatagtttgctagagaggagaagtgcttccaagttgagtgaaagcagaaagcgagccagagttgcattagcaagtgattcaaacaatgaaatctcaagcagcaaggcagctgacatctcagcacttactctgtgctgacagataaatataaattatttttgagacagtggttatttgagatatgtaaaagtttttagatagatatcattatcccaattttacaaatcaggaaacaagtttataaggtttgtaattagtccaatgccccataaacagctggtacataatggggctagggtttgaacgcagcttatttgatttgaaaacctaggttctttccacatgttaagtaatcccttgcctttttgagaactgcattttatagttagcatttatcctaagtggttcatggtttttactaattttaaagggaaagttctagttttatagggaagataacgttggcttgtgaactcagtgagaagatggacagtagagaggttaacttgtccaaaatcaaatcgctctgatgccaacccaggtttgttggagtgcaatccgctgctcttacctaccatgttgtgctgtctggctgattttaccacccaggagctgttgattaccagtgtttggttaatcataggaaagtctggcttgcagccattgccagtgcacaaatcatgttctgtgaaataaattttattttattgactcgaagagacaaaagtgaagctatgtcttctgaataatacccagcattgcttgtattggactttgtatattttttttcttggagtagaataaagtatgtagacaaaataacttatgaagcatttttattgttctgtggattctgttctaacttgaaaggtaactgctttttcactttttagattctacaaaaaagagtgtttgttacctggtgaatcaaaacagaggttccattctgtgatacgaaaagataattattaataaactaaaattaaataacactaatactattggcagaatacattaatgccgataatcactgatactataatagatgttcaatgcagccagcatgaagagctggaggaacattgatgagaattttaattcatatgatatttaagtttatatcctttatttctttagcatgttctgttttttttgtcaaatcttttagtttcacgattcattagagtggatgacccaggcagatggaattggcagtgtttattagaatgtcataccctgctttaaaataatgttctctgctaatttgtcccttgttccctgaaacaatgagttgactttaccctgagcatcctgggttgtcagctttaaagtcaatcttttgcaaggttgaaaggatcaagggcattattacataattgttttgtctttaatccatagacttttggaggaaaaggaagcaaaatgtggcgatttgtgtatgttttgggtattgggcaagaggaaagagagaagcagaggtatacctgtacctaaaaagttttcttaactgtcacgtcatggtgaattaatatgttggtgctttcttaaactcctcagtaatgagagtcaaaaaacagattcaatatgctattcggagttaatatgggaaaagatgctgtatatttatattaaagggaattggaaaggatggtatttgctctggaaacacagccttcgttcatgtttactagtcctatagtagttacgttcatcaattatgttttgtttcctagaatgtacaacatcctccatgtttttttctttctataatttacatttatattgtgtttttccttttttgtggtaataaactattgtaaatgtgaataataaatatattataccagtgcctcttgtggaggtgcaatattagctcatttaaaaaaaagcctaaaagccttatcttgttctcagtaaaaatgtttatagtcttactttacatattgttctgaaaagctgttttttaaaatgtacagacctttccgggggtatgctggtatacatttaaccactggtggggtggaggtgatttgtatttttaccaatttctggggtttaaatattcttaccatggccaattttaagctagcagttcagcatcactgaacctggggatgggaatagatgcacacagttgtcttttgcaggccttggaagctggctcagccactgattttagtaccaagagattggaaggggagcagtggctagaaggggtagtggagaggcagaaaactaaagaatgtagaaaataataagaaactaactaaattgggagatgggtttctgttaaaggaacttgagtaaacatgtcgactctgttttctgaaactgccgggatgaaaaaaataactaaaagtggggggaaatttttcactaaaagtagagaatggctaaaccccaaatgttaagcctctgaagaatatctgccaaatttggagcaaatctgagcagagtcaaaatatgtgtctcttagagccccagcaggtggattttttgcaaggtcatggccaaaatccctaattgggaacagagaggttgaagccctaggcgggttcctggagaagcagaacttgttcctcttttgatgttttgtttcgtagattatacagtatcctccatgttttttttttcctttctataatttatgtttatattctgttttttcttttttgtggtaataaatttttgtaaatgggaataataaaatattatgcttatagatttattcactttagacagtatctgttgagtcctaaatatgaaaaatttaaaacgtgaacattcatattttcttccatttttccaatctcttgatcatgctatttattattttttacatgatcatgatttatcacatttttattacattctatataccgtaatttgcctccatttcatatttaaataaattacattgcaaacatcagaacaaaagaaaatatcaaaccaggaagcataataaattgaaataatagaattaagatgaaccacctgcttattagaaatcataatgtaaacgagataagttcatttattgaaaggaaactattttgcgtgagtcatccaaaaaagtgattataggcaaacttaaaagtaagcagtggttataattaatacaaaagatgaagggtatttttacttttaactttattccttctgtggtctgaactttttcaataaacttgttttactttaccaattaatttttaaaacatcccagactgtagccattgattataatgagacacagctgcatcgttttcatattaaacagtgactgtttcactgcctgttttttgtcacatggcaggccttcagtaaatggtggctgaaagaacattttctcaagatgttatagtgttattatgatgtgtatctaatagttgccccaatctttggagtcttttttttttatttgcatgcacccttgtgagggaagtgattttattgctgttttacagatgaagaaactggggctcagggaaattaagtgacttgcccaacatcaaaccatctcatgtcttctgaatcattttttaagtaaaatatttttctcatcatatgacagtctcttaaatacaatattttagttatgattctgttgactgattagaatctatataaactgaagacattttaaaattatattaaatattttcttattagaagcattagaagagtataactcagtttagaaagatttcaatctttcaggggcatgattgggaaaaataacttgtgtgaagtagtttgttctttagtagtcaagtggatgaatatatgcagtgttgacttaattatctttgtggagtagctgtgaaccaccagtctattctgtggttctatcctgaaaactgtcttttcaatataaataagagcaatagactgtcaggagatttctggggaggtggagggaactgcaggatgctaggacttgagactgatggaaacgtttgaggtagagtcaggttttacacgtggtttgctggaggtgccatgactcagtttcttcctcttgagtctgcctgtgtaaaagtggttgaaatgtgcacatatgcatgcaaacactattgcatttgggtggtgttttttatggttacttctagcctgcatcagcattttggcttgggtgcccactctgtatgatatattggctgaatgttcatctctgaggtctgacagtcggcttttgagagcaaatggatggccacagtacaggcacgtgcccgctatagcaactgccaaggttcaaaacaaaaagtccagcttctcgagggcacaaaacatgctgtttcttatatgttctagtgtaatgcaaagcatatactaaatatccactaaatacctgtagggtgtgcttccattcgctatactttcatttgggaaagctttataatagtgtgaaatctagtactgatcacactgtaatttttagagatagtagtacaagttgggacagatggggagcctaataatttaatgattttaccaagtgcgttgaaaacttgtcacaatatcagcttggtggattaaaaattggcaaatgaaatctggagtttttggcattttccaaatctttctcacaaaatacaattctctctggatgcctctcaaatacagggtcccatgattaactaaatgtgggaggcacagcataaaatctcttctaacagatttataatgaaaataagcatactaaaaacttggagaaatcctgcagaatagaattctacttacattagtgtggattggccatcctaaaacatcctggaaccttgttttgcagaacattttacattctctgagcattttgggaaatgccaaattttttattgtaacgctgtcaccgatggatgggtaaacctggggctgtttgtgtgtgtgtgtgtgtgtgtgtgtgtgtgtgtgtgtgtgttaccatgttaatttgatgtagaattaaaatcctcttgagttataccaacaggacaaaagtctcaacattttactatctgtgcaaggcagataatctctagatctcattttagacagtagttcttaattatttttctttatatcagtgctacttgtaacttaaaaatttttaaagttttatttcctttcttgaactctgaaggtattataaaggagaaaaacagtaaaagatgccagcccaactggggaggttggaacagagattatgaatatattataaccaagttactacatttcctgaattgtgggcaatcagttgtgcctttctttcagtttatatcctgaattttttgtagacttcagtatagaaaaaacaaagatttgttttaaggaagagttcaggtgtggccttccaattttactcttcctattataaacaaacacccaacctctgatcaggtggctcttcttgttatgtttggggcctcttactcattcccgggcagtgttcctcggcaatatgcctgtgacaagcgtttgctgtatttgttgttcgacttagggtagttgaaagagtctctctcagccactctctctggatattttgttgtggctgtgggcactgtttgcccagcctctcactttgtagcggaggggtgggactctgcgtgaaaggaccagcgttatagtccctggcttctccggctaattcatcccgaggctcctgccccttcccattctggaaggggcgagcttatcctagacctgtgactgcctctgaagttctccacctgcctcaggcgtgctctccagtgcctgtttctgactgagtgaggttgaaatcctactgactccttttcaggtaaaaaagcatactgaaaaatggctttaggaatagcagttaagatttatatagagggggcagttttgttaagtttatggtttctgttgtttgtagagggctatcacggttttattttcatggtccctgaaggtaagcagatatagctgtatttagtgatagaaaatactatattgcttagagaacccaaacttcccatgaaaattgttatatttattattacttttttctttagactttcttataagagagaaattgaagacaaaattgtgccaacaaagtatattagacactgtgattttgtggtaattttggcatcaattagatatttattttaatatctctttttataaaattttcctaaacctaactgtaactcgaatagagttttccataagacatgtataggtatgatttgcttggctggtaggatttcttggtgtgttttatttatcacactccatattttaaaaattaactgtgtgtggggacaggggatatatgggaaatctatgtaccttctgctcagttttgctatgaacataaaactgctctaagaaatgaggtctattaaaaaaaaacagtcccttgataatactttctgtgaatacttaaatataatgtgataaagcacagatgatgttaaactttttttataaggcataaattttaaaaagctaattcatttttctttttcataattagtaatgaaaatatgggacatatttcagtattttgttttgattgccactttttttgttcaaccatattcagatgggtaaaatgattattttcaagtctcttttcctaaataagaagtgagaataaaaatatactttgaacatgaacgcgtacttattcattgtcttggaaagttaatgagccattatgtaaaattcctttctgaaatcagagagtaaaaattaacaacttagaaagttggtttgtgtatttggtaattatgtttctaaaacccattttttcatataatatgcacatgttcatggacagaggagtgatgctgaagtatgaaacttgtacttagtaccgaataattggctttgaatagctttagaaacatatttcatatttgcgtactttattttttcagttaggcacgccttaaacacatgtagttatgaaacaaacggtgaaaccatgactagccacagatatttgagcataaacaatcttaattataatgactgaagtaaacaaagcatgaccattaaaataaacttattttcgacagatttatacatgaataatatgcaacattctatggcaatttttaagggtgcatgaagaactttcacagctgtcttttatagctgaagcagggacagtggcctaagaattcctttgatagttattacctgttggaaaaaaaccactttatgtgctttttacattaaagagcaattacatataaagtgatgcactctccaaagatacagagaatatttccagacacattaaagcatatgaaactttccaaattttcaacacaagttcaactgtgttttatctttatagactctcccggggctttggggtaagttatcttatacagatggaggctagaactgaagcattatagagcaggagaaggtgcttccaggagacaaggtgtgcaaggcttaatgttgcttacctgtttacctgcacctgtttacctgcacctgtcttctctgaaggtgacgctgttgatgaagctgctgttgagaagacccaagtaattgagactcggtctgtgggcttgttatcggatcactccactgttttccacactttaatgtgcgtgtgaatcatttgtgattttgttaactgcatattgtaccacagcaggtgtggggtgatgaggcctgagattctgcattgctaacaggctcccaggtgctgctaatgccaccatttcagggaccacactttgactagcgaggagctacaccaccagataccaaataactgctcaggtcattgtttttcacttaatggacattgtctgtccatagtgggcagtcagtttgcgaagctcatgactgagatgtgattgaggggaatcgactagctggtgacactggccgctttgtggctgatataactgatgatgtgtggcttgttttctctggtagaaatgtgtgggattgtcacctctgctgaacttccacagcagtcttttccaggactcgtcatccttggcagccccaactcctgcctgtcagcccaagcagccaccaattaagaaagcgttcaagctcaacacccacctttcaagctcaagtctccctttgcggttgctacaaccaccaagggctcatcctcttctcctgtctgccctcatgtcctgccaatcaggagccttttaaatgcattgagtttgatttgcatcttgaacctgagtcttctgtggcatcctctgcccaatctggcttgcaggtgctccactttagctccctgtgaatttaaatatagaaactttatttgtgaggagctgcttccttcctctcacttaacacacaattttccaatgtaataatccagttttgggcatttgattttcataaaaactttccatgtctcagcttgtgagatatgtgtcttgagttctcaatgtaaacactttgccagtctgtaattccagcactctgggaggccgaagcaggaagattacttgaggtcaggagtttgagaccagccaggccaacatggtgaaaccccatctcttaaaaaaaaaaaaaaaaattagcccggcgtggtggtgcacacctgtaatcccaactactctggaggctgaggcaggagaatcgcttgaaacgggaggcagaggttgcagtaagctgagaccgtgccactgcgctccagcctgggtgacggagcaagactgtctaataaataaataaataaataaataaataaataaataaatactctgccagggttctagataccatgtgaattgaactcctgaagggaaggaagtgggcagtggggtgttggtgtgatactccaaattcttcagtgattccttcccattgtactttcctccacaacattgtttgtgaaaatttcaaacatatagtaatttgaaagaattttacaatgaacagctgtgtattcacctcctagattctaccatgaacactttattgcctttattatctgtccatccacttatccctctgtctttcactgtcttatttttgatggatttaaaaataaactgcaggcatagtttgtatattccagcatgcttattattaactggagttcaatatttcttatcagttattcatacgaaatttctattcgatgaaatgcacacatccttacttgtacatagcttgaactttcaacaagtggacgcacccagataaatcagtcctggcaagatatagaacattaccaccaccggagaaagttcctgcattccttccccaacctttacgttcttttttgagtctctccaaagaaggatttactgattgcaagtgatctgtggttagtttatttcttcaaaattgtgctttgatcagttttatttcatgcaagttactttcatacttaggaatgcatgttgtacaacactttcttacaaattaatatttagtttgttaggactaatttatttctgacagaactaaagttttaacaagagtagcttagattatctgttttttacttggtacagatgttttccaatgactttattgattcttatcatgttttatgagatggctggtgagataacataaatagagatgcaaagacatggaggtaaaccatgttctgagaggttctttgggctgacacacctggtttctctggatataaagaaaaaaaactcctctttcaggcagctgtttcctacgaagattgtgtttgaggatacagtaacctcatcatttagcctgaaatataagttggttcacactgcttcttcagaaacagaaagctctatccttgtaataatgataattcatgacattccatgtttgtgggcagtagtttcagtcagctttaccttcaggtacctaacaaggtctggggttgatttggatctgccctgatgtgggttcacagagtcggtaaaacctcagctatccagaaagctaattgtctgaattgccagactctcaaaatggcctggaggcagaaagttaaaatgtaccacaatctctttggtcatgaagaagcagtttttgaatatctaacatagcggtagggatatggtcaaaatgaatgagttataccagcaccataaagttgtttaggggctgtaaagtgctcacattgagttctttgacggtaccatgaaactcccatttttggtttgctccttttcacaaatcactacttcagtggaatatgagactcatctctgaaaactcacacagctccttaagctcttattcacaccttgacatagtttttttgtgtgtgtgtgaatatgatttataaacgatgggtttattcaggtattttctgtaagaaatccacattgtataacttggagttacctatcatatggtaggcgctcagaagcttcttttacagtcccctttagaatgctacaaagaaatatgtagtgattttcaaaggtacatcatttagtagacagtttacgtttccttgctcacaaaagaatgcaagagaatattccagtagtttcaaaaagtacagtatgcaatccttagaaccaaactgcacaaatattcagcagctgtctattcaaaaattaaaaccagagaccatattttgttagggctaatgtatagttgtcaaactatagaccagaacaacaagaatctgtatgtgcatatttattctaatcttgttttccaagttacttaatttatagttgcttttctctgagaggaaaggacagaacaagtattgcaaacacttgctacagtcagttttggcaaaaaaataactcagagagccatgttttaagaaaaataaattcaggttataaatttaagcatcattctactgggttgcaacagtatctgagacttctactttgaatatttcatctgatgatgtaattggaggcggcagaagcatattatctgcatttatttgtgcagttgtgtattatgtaagtggagaattgtgggaaataatgactatttcccccctcctcataattttaagcctcaatggaatggaaagaaatatcaatcgatcttccatatttggcagagtgcttgcagaggccactgtctctgcaaacatgataaacctcattttccccttcccctgtcaacttgtcaagaacagaattaacaggaggattatattaaggcaaaataatttggggttttctgttttgtttttgtctttgtttttaaaagttacttccatgtgtctggccatgtttcagtaataatgtttggcactttaataattcctttcatctgcaaagagcaaattgtttttctgaaataatttcattttgtagaatgactccatagagcaggttgaccccatccatgatctagaatataagaattcatcatataacaaaggaccaccatttaatgccagttttagtatgttttcagcttcaactaaaaacttaagattccataataagagagaagtcaccaagccaattccctgttgagtggaatatcttactcattttctacatacatcctacctatccttgaaagttaagcataaaacctcaccttgctgaagctttcctcactgctataagtcaaatccctgtccatctctccctttcctgagtgcatattgcattggcttataaaccttttggtgttactctcctgtgtagataaagactgttaattactctctaattatattttatgtattagtcttcccatgtcttccaatgtaagtcctctttgcagaaacaccatcttaacacttattttgcatttccattcgcatttccttttcttgtttagtgttttggaaaactgtcatttaataaatattgttggccgagtgcctgaatgttaagagaggccactgtctctgcaaacatgataaacctcattttccccttcccctgtcaactcgccctaagaacagaattaacaggaggattatattaaggcaaaataatctggggttttctgttttgtttttgtctttgtttttaaaagttacttccatatgtctggccatgtttcagtaataatgtttggcactttaataattcctgttatctgcaaagagcaaattgtttttctgaaataatttcattttgtagaatgactccatagtgcaggttgaccccatccatgatctagaatataagaaaaatctcactctgaagttcagtttccaaagacttgggaacagatgatgaactatgctttgcttgcagtgcctcctggctgtaaatataggagctctgtcaactgctgaactcttggttggccttgcaaagctttggtgtggtctgtggtctggggtgtagcgttgagccagtaaaaggcattgcattgttttatccatcctgtgtccttagttagatgcatcgcatgattggacctactcaataagaaaataaagagcagtagtcaatgttttgaccatacttttggtcctgcacagtgttactagttgccaactttatgcaaacagatttacctcatctcctgataaattagaagatctggccacatgcagacttgtgttcttcctttagaggagacacacgctctccagttccacccagcatcccaagacatctgaattagtttcctgttgttgctgctgtaacaaactgccgtaaacttagtggcttaaagcacagatttattatcttacacttcttgatgttggtagtcaaataggcctgcaggaccgtgttttttctggaggttctgggggagataatgtattccttgccttgtccagcttcttgaagttgtgcacatcccgtgactatggctgaatccctctgaactctgtttctattgtcacatgtctttctttgatccttcttcctctctctttcatttttaaaggatttttgtgattacattgagcccactcagataatacagtcacctctctatctcaagatccttaatttaatcttgtctgcaaagccccctttgctgtgtaaggtgactattcacaggttccatgttccacaccccaaattcacttccccacttccaccttcagggaagcatctaattccttcaggctgtgacctctacagtgctgaggaactggcactgatttctatttccctggagttggatatttatccaccaaataagatgagaatatttatttaaaaaactgattctcccccttcacaaattaccgtatctaggtatatcttatttttaaatgctatattaaataatcgcacaaaaataaaacaactctcctttatttcttggcttggttttgctgctactgctgctgcttcttgttttgttttgttttgtttttttctcctggagacagggtctcactgttgctgaggctggagttcagtggcgtgatcatggctcacttcagcctccatctcccagcttcaaggaatcctcctccctcagcctccctagtagctaggacaaagggcacgtaaccatgcctagctaattttttttttattttttatttttgtacagacagagtcttactatgttggccaatctggtctcaaactcctgggcttaagaaatcctctacctctacctcccaaagtgctgggattacaggtgtgagccactgcacctggcctattcttcttttttttttttttcttttcaattttacctggcaatattgtatatttcaagccttttttacattgtagttttcttttcatctacatttcctactaattaagatgtttcttccctccttggtcccttgactattaagctctttaaagcctaattattttcccctgggaaattgctgctgctattgctatttgtggttttcttccttgttttccaacttttaatataacttcttgttaatcactagtccttccttcacaattgtcttatctttgtcatctgacactggaaaatgatatacattttgaacttatgactgtcatttatcagcagaacatagtgtaatattcatgtttgctgataagagagtggcaaaattaatgtcagaaatacagaagctacttagtaatctaagaattgagaaaaactcatctatccacaaattatttgaggcaggaacaatttgtccgtctttgtttctaagaatcatgacattttctcttttgacctgtcttattgttattaatactgatggtgtagctagtgaaataaatagatttctttttagttgattcatagatatgccattccagaactatagtaggacataggtccagaagaccgggtatacagcattggttgtcaccatcagcatcagcattacctgggaattgctggaaatgcacgttgtcagaccccaccccagacctactggatcagaagctctggggatggggcccagaaatctatgttttaacaagctctccaggagatgatgaagtgcaatcaagtttaagaaacatcagtgttttgtattgtcacactagggtgctggggagaagggtgaacccttctaggtctcattctctagatcagtttatgcattcatttgtttagcttccagggatgtcatttccaataaactacattctccaaatattttcagttccgataaacagtgcactaaagattctcagttccaataaattgtccaagtaaccttatttcaccatggaaagaataatctgtggattggcatcaggaagaaatagtccttcttagtttaagagtctacccatactgcttaaagcccaagttgtgccaaattaaatacaaatgttatgctggagtgcaccaatttattcctcttaggtccgtgtctcatccataaaattatggcagttccaataagtgatatgatatcaactcactgaaatctttaaaatgaatagacagctcactctatagaaaaaaactctactccctcccctcatctgcctcctgcagagtcattcaaagtaaaccccacatctaccacataatcccatattcatagcaaatcagatcatccctgacattatctccaaatttggtgaaaggtccattgggcctgttaaaatatcttaactttattgaactataatttacacggaatgatatggatccatctttagtgctcattttgcattgcgtgagtcttagcaaatgtgtacaccaccaccacaatcacaatttaggacctttctggcaccccagaaagcttgttccagtcttcttgaagtccatttttcccaaccccttggccccaggcaactactagtctgctttcctgtcacttttagattctttttgctctctctgggatttcatacaaatggaactatgtattctttttatctggcttttttctttcagaattatgtttcagagattcctccatgctattgtttcctctatagcttttttacattgctgagtaatattcaattgtgtgcacatactaccacttatttacctgttgatgggcatgtgtatatttccagtgtcaggctgttaagagtaaggttcctatgaacatttgtgtacaaatatttgtgtgaacatgtttttatttcttttgggtaaataagaatggaatggctgggtgaggtggtagacgcatgatcagatgtgtaagaaactgccaaattggtttataaaatggttgaactattttcattccatccagcagtatctgagtattttcactaggccatttttacatgtattatcagacaaatagaaaaaaaccttaattttatgttgatatctactgcatatttatttacattatgcacacatatgtaaatgtatatacatacacacaaacagggaaatgtatacatattttattatatcatatgaagaagcaccagttttcaaagtaaaatataagatcttactttatgcataaaattccaacccatgagcatatacacaaaacccttaaactacatataagtaatttctgtgttttccttagtgtttgtttactttagtcatttgctggccattactgacagtcaaatagcaaacttttaagaaaaataatagaaactctaacatgaggaaactgttagaagcttttttccctctgacttgggaaaagataactgccacaattttggggctgtgacttctggtattgtatcatgcaaagtttaagaacttctgggataagcagtgggcaaagggagtgcaaatggaggaaactgagaaagaatgattatataaggagcaacaatgatggactggtggcgaagaaagaaagatttttcaaggaggggtggttggaacttggaaatcaaataaggaatcaaatgaagatggaacccatggctgtggccccatggagacagaaaaagtcagatttatacacaggtcattgtgacactaagcagaatgtgaaaaaatatatccaatagaaataaaagcagcatgttagtaggggcaggagagcagagtaataaaaataacctcgtctctatatatgaaatgctggaattgctgaatagtgttcctggagtgtgggaataaacgatgtggttgaatgggtttgggtttgttttacagattttatcctaaagatatgataactaattaaactactgctgttaatttgtgtcgaataccaagcagagcctcgggactggactgagacagggccaaggtgctggtataaatttcagtgactcatctcttgtgtctaaaatagcggtaggcttgggggcaaagtataatcaagggaggaagtcattttgacacatgttccccttgaaagcaacttagaaccaatgtaagtaattcagtttctcaagctagtgttggaaaaggggtgtagatggataagggtgggaaatggaaagtgagcttgcatcaagtcatgaaagacattgtgttgtatgcaaagacgttttgatttgatcctacttgttttcaagatgactttaggcatacacttgggcctaaatgaaaatattctaatggaatacatgcaagggctcagcgattcttaagggattactttccatgttttaaacttttacgtataccctttcttaaaactgatctgcctaacacctgcctgtcctcatctcattttgtagaaggaagatacttatctcatctttccaaaatattaatatggtacattgtcctatggtataaaaacattccaagtgctaaacagaaaaacaccgtgttctgcaacaaaactgtgcttaaaacatatttgtatcatcagttgataaatcgttaaaaataattttggccaggccaggtggttcatgcctgtaatcccagcactttgggaggctgaggccagtggatcacctgaagtcaggagttcgagaccattctgaccaacatggtgaaaccacgtctccactaaaaatacaaaagcattagctggctgtggtggcgggatcctgtaatcccagctacttgggaggctgaggcaggagaattgcttgaatctgggaggcggaggttgcagtgagctgagattgcaccactgtactccagcctgggcaataggagtgagactttgtctcaaaaaataaataaataaataaataaaaataattttgaatttggatcaccttctgtggtggcataaaactcaaaaggagttcagagattgaaacttttcttagggcaaaaacattttatcagcacttatgtgaagaaaaatgaaaaactggaataaaattgatggtaaaactttgttattttagcattaagtaatattcatagatgtatggattaattttttaaaagccctatccattttatcaaaagatatatttcaagtaaagttttatatttaataattactaaaattatattaatatttatgatatttatgtggtttttgtcaattgcctaccagtgaaaactttagtataacttaattaaaatacattatttcacccttaggggctaaattcaaagtaaatttaaacttaaaattctaaattatgtatatattttgttgtatatagggatatatgatagatcaataaaatacttttagccacaaaaatgtattcattaggataaaattttgcaggggaggtagaaaagaaatagaaaaaaggcattataaaacataaatgttaagtgtgaacttgcttatttttaaataattttggtgtttacattctagatacatttaggtatatctaacagctattatgtttaaattgtcaacatttagaacattctagaaattatatctttaacaacccttttgaacttatgataaaaaatgaagataacttaaaattgacttttggtgagtttttctagatttgtctagaggggtataggcacagattttttgaggaccacaattatgggtaatgggatatcactgaaggattttgaataggggactgtttgataagattggtggctttgaaagggtatttttccattgtgcaggtggatagggtggcacatagaggttggggtgatggtaaaccaggaacaagtaaaacagtgaggagaagagagagggagagttcaaagcatgaaagggagcaggagactcaatattgctggcttcaaaggtgaagtaatagggccatgagattccttggctcatggccccattacttcaaggaatgtgggtggcttctagaagcttgaatgacaatgaaatggatgattcctctagagcctccttaaaggaaagaagccttgttcccatcttgattttagaggtgagatccatgctgcatttctgatctacagaactgtaagatgacatatttgtgttgtttaaagccactagtttgtgaattttattacaggagcaatagaaaacgaatacagcagatttacccaggttttccactgaggaaggagatgagtcatttgatactgagttaagtatgccaaaggttggcagtctagacttgtgggcattttagcctctttgagtacatgcttgttttagtgaatgagagaaagctgttatgaaggaacattttatatgaacttgcttgttttcatttctctacacctcactgtcctcttcctcaaagctaggggttagaatagattatctcaggttctcttcagcttgaaaattctaaaattatttgccttgcataaaatgaaagaaacaaaacacaccactatccccataaaattccttctctggtgagaatgaggggaaaaaaggagaaccacctacaagaattattggtaaaaacacacatagaattcactataaaacacaagcatgtgctgtgcttcagatgccttgtttaggaatgtttagttctaaatgctagacataaatcaacatatgttctggaattttcatgatgaaatctctcactgtgcatcaaagtaagagaaatagaaagttctgaacaggagcatgtattgtcctaacaatcttgtggccccaatattcatcataataaaaatttttctgccttggtattattatggatagtaattattatggataataaaaatgatggtgtattagtcaagatcggctagcttatactctgacaataaacaatttcaaaataaaaaagaccattagtactcattgttcagcgatttaaatctcacaagtagaatcagcctcttgatgggggatttttccattataaagctggtgctacgatctgaattctgcaaattggggcatttattagttagtgatcatatgggattggtctatggaaggatgcatgctgaagtcagttctttagggctacatcttgcctaaactcagtttagcatggctggtgttacaaccctcaattcctttctgcacaggggaataagtaatttctgatataactgctgcctttcacacaaaggtgggactcttgctaagctgctagagtgcagtcaaccttgccacaaagactatgcagatgacttcagtgttctcaattcctcccttggttgaagatcacattcacgcccatttcacccattcaaggactttcaggtgcaaattttgcaagaaaaagctcctcagatttcccaagaatcatctcattagaaaggagtttggaatgtgattctgtctggatgctatttctgtgataccttgaaaactttgttcctacaaaattatttaagcatttgagcacaaaaataaacaaatgtccttgaatttattatcccatatgggcttgccaactgctacagtgagacttgtggagatgataagtcccctgtgagtgaggcacttaagctgcaggacccatatgttgtgcctgattgtaatgcagagaaagttctttggaaactatgaccttaaccaagctttgaatagctgaccaagataaagccatcagagatgtcctaagggttgccattcatagagggtcatcaaaagtctttggcctcatgcactttgtgccaccctcctcactaacattctattcatgatattagtctttttgagacctcccaaatggtgctgatctaattcatttctgcaaacagacttcagatgttatgaggtgtctgtcagatgaggctcagggtaccaagcattgtttttgcttgccatattgatcactgttaaaggtgtatctgaaagtaagtcttgatagtccctagcaatcaaaagtgtttcctcaagtcctaattttttaggtgtttttccctataccttctgagtctcttacttcaggctgctatcacaaaatgccatagactaggtgccttataaacaaaagccatttcttaccgttgtggaggctggaagtccaaagtcaaggtgcctgcagattccgtgtctggagagggccctctttctggtttgtagatggtcttgtcattgtccttacatggcactcaggtcggggggatggtggaggcagagtgtttgtctctgttcttttataatgctgtaaatcccatcatacaggccccatcctcatgacctaatccaactctaattacctcccaaagaccccacttccaaataccattacactggggattggggcttcattatggaaattttgggagtggaggacacaaatgttcagtccctagcaatctcactaggacaacaaagtgagacaaataattgttctgtagagcttcttagaataacaccaatacagtctcccaaaagagagaaagaagatcaataataggggttctaggaaattgctttcagaccttgggctaattttatgaaatgattttgagaaaaggaagggcaaagtgagtaatagattttagcaacagtcatgagagtgggagttgagagggcggtgtctgttttgttgttctttgtccatagcgtctcacctataacctggcccgtggaaaatgttcaaaaaataagttttgtataaatgaattgatcattagctggagtggttttatagcaataagaattaccttgttgaagaattggttcttctttgcctttaaatgtcttcaggtttgggctccattcttgtagctagctgctgactattggtttaccccatgtaaagtgagtaaagggttgagggttttttcttatccttaggctatcaatcacctgcttctggggctctcacagttaaaagaactctttaaagttggctgtgctggaagctacccattataccaggctgaagtgtctacgggaggcatgttcttcgttttttgtctaaaattgagggttttggggaatttgctcaatcatcgctaggcctaactcaagtctcagtaacccgggaacctgtgagctattacagaagatgcatctgtagtatttactgagtgcatggatgggtggtttacagacttctcctcaacaaatagcagggctgtaatagcaagtgacagggagcttctggcagaggtagagattgaagggcaggtggttggcctgttgtctctaggaaatgaactcccagctcaggcgcctaggacatgggacttcggatttttaaactgggactagttgggtcacccagtgctgaaaccttggccctctgccgacaggctaaggggcttcctggtgtagctctcccttctcagctgtctcagccatgtccttcccatgctctgagacaccaccagcagcaacagtttggggatcatgtgaaagaaaagtaataaatacctattctgtttggtcacatctaattgctcattttcatcatatttacaaggaagaatacgcttacagggcctgaagctaccactcagtgacttcaggattcaacgtgtctttctgcaggggtcagggagtcacgctgctctgcctcacagcacagctaggaagaatctgtctgtgtctattaaactacagggagagcaccatttgaaatctcccctgccccggaggatgttgtccaaacataagtggtgtcccagagttttctctaactctccagcccaagtccctcttacagcccagggaagcctggggctcacctatctcgtgaaaatgtgctgtattgttggtgtcccagccaaggtaccccaagcataatggggtaactccagattgggtcactaagcccatctcccactacacaacggccacatttccctccctccctcagttagttctggggaggaggaagtgatgagggctggtgaggcttctccagaacaagatggagatgcaactctaaaaccaggtagagcgggaggcatgggggaaagggctgtgataccacagaggacgtagaaatttttttccatcaccacacataagaaagaagaaaagctgctagatttttaagtttcagttttggagtagtatcaaaaaggaccatcaagctggagatatttatttagataagaatgctggtctaatttatcattattttcaacttctcttgcttgtagttataattagtgataagtaatattttaagtgttttttaatggtttttggaaatattgtatacagacgtttaaagttgtatacaaattgaattagggaaaatggaatctcactttcctgtttgtatgtgttattgaaaaatattattttaattttacatcagatatcttgatacctcactggtattaggctgaaccatacgaaattgctgtttttgttgatcaaaatgattaaatattagttacttcatatagctcattgtaacatatttataccctgggtctttataaccagagacaagtggattaatctatgaagctattaaaaaattctatagtaaatatatttataaactgaagaatctgctttaacgtgagctactttccctgcactatcagtttttgcaagtttacatttttttcctgcaaaaagaggcaaaattaattttaaaaatctaaagccattggaaggtaccagaagatgggacgtttcaaagaaggaattaaattgaaggtagaaggcatcctatttcctacattgacttcaacccccaccaccttctgcaatgattctgaaggcgatccttgctcaaaggtgaccacctcagtattgtggtcatgggaaaaaacggaaaagggatcagcattctttagcttcttttatggctttatttcagctgggttttcaaattttacttgagtagatagctttatttggctcagaatgagtcaaagtggttttttggtgaatgtttcctttaccttcataagcactttctttaaagttccaggtgaaacccccagcatggtggacactgtgtcgtgatgtcattgcaggtgctctatttgagaagccatccatggtttcttcagttctagaaatgcttcagattgataacattactatgctcataggttttatgttgttttgaaattaaattaatatagaaaggaaccatttgagggtggtgacccagcattgtgcctcaaaaaaaaaaaaaaaaaaaaaacctctggtttttatgattaggaggcaatttttttttattcaactagttttgactcttacggaaataaaacatcgccactatgaaccgatttatgagctgtcaggtgatcttatgtgttgtatacatataacacacgcatctaggagctgttttaaaaatcttgacagttgtacattcaatttgtgtaatgctagccctactgtaaaatactctagtttttttgttgggacagaaccacacctaagtgaaacttgcagctagctgcccatctgcccatgaatagtttactacctatttatgtatttatttatttttcagacagggtctcactctgtcagccaccccggctggagtgcagtggcacaatcatagcccactgcagccttgaccacctgggctcaagccatccttctgcttcagcttccccagtagctgggactacaggtgtgtgccaccatgccccactggtaggggtctcactatgtagtgcaggttggtctcgaacttctggccttgaaaaatcatactgccttggcctcccaagttgcttggattataggtgagagctaccacgcccagcctaagactttgcttccttgtggaaaaactccctggaagggaatcccatattaaatagcaggtgctaaatagaaacctagtgtttgactgagtgataacattttctatagttttttttttatttatactgaaatttagaaagggcatattattcagttttgttcttcaaatcatccttgactcctctctctcacactcacacgtggtatggtaaattctgtctgctctaccttcaaaatgtacccaccttcttttcactaattcccttgctgccatcctggcctgagccaggttctctttcacctggatgactggtctcttctcatcctggcttgttccccacactgacccctctccgtagcctgttctgcactcagcaccgaaagtgactgactaagtgtaagtcagctcctgagcctccctgctcagagccctccaaggggtcctcatctgactccgagtaaaagccagagtctttaccgtgacccaccaggcctgtgtgatctgactcctttttgcgtgacctcatctctagctcactgggcttagtcacactggcttcctcgctgctctgctgtcatcctggggtctttgctgtggctgcttcctctcccagtaatgctctgccttcccccactcatccacatggctaaatctctcatttccttagtttttgctcatttataaagctagatttcttattaacattaacccctactccgttctctatttttgctttttccacagcacttaccatcctttaatatatggtataatttatttatcatgtttagcgtttactgcctctctagaatgtaagtgccatagtggtggcagttttgttttatttactgatgttcaccaagcacttagaaaagtgcctcattcatagtagtgattcagtaaatatttgctgaataaatgaacgcccattcaagggtggtgtggtgggtgaacccttattgtcccttgaccttggatgcctgttttaaaaaatcatgtttaacaaatcctaaagccattcttttatggtatgggtttcagacttcacattttacatatctactcatgagataagagtcaaaagaaagttttttaaaaaatagtatttgtcaaaacccattctgattgttttttcttataatgacagattagtctctgccaactcattccagaagcttccatttgatcctcagaggtttttaattggcacgaggctcttttcaggaaagggccactttaacatctatggaaaaataatcatgtacttttaattccacttatctgaaaccaactagtaaacccaaagaaaacactgggtgttttaattttttgaagtggcttgaattgtcccgaggtcatggcatccagtgaattcacttctttgtctttcctgtctggccgtttttgtgccttctgggtgtgaacaactcaagcggtttgccatgtgccaaacgagctgctgcctcttctcctttccagtggtgtggtccaggtccactttgcagactgagttcttttctctctgcaggtgccttctacttctagctagttatcttgtgcttctcttcccagcctgtttatctaaatgagtttcttttcctccagcccagctgcctcctgaaggtacaggaaacccccaatgaaaccatcagttctgcctctgatggtttgcctgtcctttgcctcagacgctgagacctcggtgccctggccacagtgacccttttatttgctttcctgctacttccctacctgttgttttattttttacttattattattattttttgagatggagtcttgctctgtcacccaggctggagtgcagtggcgtgatctcagcttactgcaaacttcaccttctgggttcaggcgattctcctgcctcagcctccctgagggattacaggtgcctaccagcagcctggataatttttgtatttttttttttagtagagacagcgttttaccatgtctgccaggctggtctcaaactcctgacctcaagtgatctgtccgcctcggcctcccaaagtcctgggattacaggcatgagcaccatgcccggcctacttgtcactttaaaacacagccatgcctccacccactgccgtgctctctcttcaagaaacaccagcaccacttcctgctctaaaacatttgcacacccctgctgaggaccctaatgacactgtctgtgtacctcctttatcacagacacttactcttctgtcttctgttttcgtggtgtgcgttgcttcatttcaaggacataactatgtaaacttccatgccagactgtaaaccctctgagggtgaggattacgttatatctgaccctatgtgtaaaactttgctgtgtatgggttcagtaagtatttcataggaccgtgaaacattactggttgaatgggctctggaaataaaactactgtataggccagagttctagaactgtccagatttttaaacattctgtccttttatcttctgaaaattatagttgtatttttccactgatagaaactaagttttagttggaaaatgataatttccgtaggcaaatatcatcctatagtttaacccttcacatgagtgaattgtgattgaaagaagattcaagggtgggttgtccatgttcctcttactattctccatgtgttttacatgaaggcattttgcgttcatttgggaattattcttataggtctctcagttttaatacaaaatgggttataaatatggctctggtagtgaatctctcaaactagaagatttctcccagccacaattcagttacatctagaagataacattcacacatttcttcattcatttcagcaaagagtgactgttatgtgccaggtatataatatgaattgatcagacacaagtccctgctttcgtggagcttacattccagggagtggagacagatgaacaaaaaataaaatgaaaagtgtgccagatggtaatgtgtgatgcagagaaattaggcaggggaggaaggatggaaagccagggaaattgtaatttaaaataaggtgattggcaggggcctgaaggtggtgaaataattagccctataggtaacaatgggaagaacattataggcggatggaacaatggcactgtgtgggagtcacttgtcatgtgcgaggaacagcaaggacatccttcttcaacttggagagggttggggagtaggactggttgattcagagaggtggaggggaattcagaccacttcaatttcttttcagcctcgacactagtgacattctgggttggttaattgttcattgtggagggctgtcatatagtgacattctgggttggttaactgttcattgtggagggctgtcatacagtgacattctgggttggttaactgttcattgtggagggctgtcatatagtgacattctgggttggttaactgttcattgtggagggctgtcatatagtgacattctgggttggttaagtgttcattgtggagggctgtcatatagtgacattctgggttggttaactgttcattgtggagggctgtcatatagtgacattctgggttggttaactgttcactgtggagggctgtcatatagtgacattctgggttggttaattgttcactgtggagggctgtcatatagtgacattctgggttggttaattgttcattgtggagggctgtcatatagtgacattctgggttggttaactgttcattgtggagagctgtcatatagtgacattctgggttggttaactgttcattgtggagggctgtcatatagtgacattctgggttggttaactgttcattgtggagggctgtcatatagtgacattctgggttggttaactgttcattgtggagggctgtcctatagtgacattctgggttggttaactgttcattgtggagggctgtcctatagtgacattctgggttggttaactgttcattgtggagggctgtcatatagtgacattctgggttggttaactgttcattgtggagggctgtcctatagtgacattctgggttggttaattgttcattgtggagggctgtcatatagtgacattctgggttggttaactgttcattgtggagggctgtcatatagtgacattctgggttggttaactgttcattgtggagggctgtcatatagtgacattctgggttggttaactgttcattgtggagggctgtcctatagtgacattctgggttggttaattgttcattgtggagggctgtcatatagtgacattctgggttggttaactgttcattgtggagggctgtcatatgcactgtaggatgcttagcagcatccccggactccacccactagatgccaggagcatactgtctcagtccatttatgctgctgtaacagaataccacagactgggcgatttataaacaacagaaaattatttctcataattctggaggctgagaagtccaagatccaggtgccagtagactaagtgtctgtgaagctctctgcttcatgatgatgccttgttgctccatcttcatatggcagaaggtagaagggcaaaaggacctggctagtttgcgctagcccctttataaggcactaatcccattaatgaggatagacccatcatggctcagtcacctcctaaaggccccacttcttaatactgttacactagggattaggtgtcaacatgaattttggacacaaacttttaaaccatagagcacaccttctcccccacccccgaggtgtgacaactaacagtgtctccagacattggcaaatgtcctcggaggcacaaactcacatttggttgagaaccactgcttcacaccaaagtaaggactttgttaatttgagtggttctttcattttaaggaaagtcctctggctggctgaaggggaacaaagatgggaccagggaagaaaattagcacatggccatttgggaggtgaggatacctagaagctgactggggctggctggcgatatggtttggctctgtgtccccacccaactctcatctcaaattgtaatccccacgtgtcaagggagggaggtgattggattgtgggaatggtttcccccgtgctattctcatgatagtgagttctcacaagatcttataaggtgctcttgtgccttccctcacacttctctctcctgccaccatgtgaaaaaggtccttgcttcccctttgccttctgccatgattgtaaatttcctgaggcctccccaatcatatggacctgtaagtcaatttgtaaacctcttttctttataaattacccagtctcaggcagctctttttagcagtgtgagaacagactaatagagctggggttggtcaggagtgaatcagattttggatatttggaatgattaaccatcaggatttgctgacagactggagaccaggtataaagaaggagtcaaaaataactacgaggatgtgggcctgggcagggaggatgcaggcaaggagcaggttcctggggacattgagagcttggtttgaacattttgtatttgagaatattgattattctctgtattctccctcacaataaccctgagaggtgggtatgctctccttttacaataagaggaccctgaagctcatggagcttggttaattgcccaaggtcacacaatctgtaaaagacagaaagggacttaaatccagacatgtctaactactaaccccctcctccttgatatactttgaagtgattttgtatggtttagaagcctccagtatgaagtaatagtatagtattttataccctgcagagtttaattcagtagactaatttttcatgaaatgcagttctgctaaatactaacatttcaaagcagagacagttgtttcttttgcattttatagcaggatagaacacaaacatgaaccttaggaagtattttgcatacagtagtaaaataaattacatggaatatcagggctatggtttgaatgtgtgtctccgtccaaaattcatacattggaacttaaacactgctgtgtggtgatgggactaagagatgggatctttaagaagtgatctttaggactagtgaccttataaaagggctggagggaactagataggcattttttttttttttttttttttttttttgctttccaccgtgtagggacacagtgttcaaggggccctcttagaagcagagaccaggtcctcactaaacactgaatctgctggtaacttgatcttggactttgcagcctccagaactgtgagaaataaatttctattatttataacttacccagtctgtgctattttattatagaatcatgaacagactaacacaatcagtggttagttggattttaagtgagttctaagttgctatttctccatctgtcctgttggtacctagtcctaccagttatatggcaaatcaatggtctgtggtcagttttgtttggaaatataccccgagtccctctgctagggatctataatacacagactacttctcccttctcccctccagcacctccaaaatatattaagcatctcacaggtacaggtggtgctaaaccatttttccatctcgaatatatttctataggtctgctatggtcatggctatgtccagatattaattcattctgtatgtttttttttttttttaaatatacacatccttagagcttaggtatgatgctagtaggctattttgctcctctgtcatttttctgccaaacccttctgactttttagctgtgctaccaccagaccactgagtgattaacgtgaatggattttcttgaaatagatcctgagaccttttgcatctaaaagcaggttccctatctctttcagctatataattgtgtatttaaacagtgggactcaacaaggtaattgcagtcttggagttcctagcagagtgagccatcgagccggcagtagggagctgtgtgccatgattgattccatgggggtttgggaaatttgaggtgatatgagccgaactgctctgaagagttgcccacaggtatctctgctgttacaccttgtatagttttgtgatgacttaacctaatataaaagatcacactgtcatttctctttgagaataatcagtgccaagggaggtttcttaggaggtctttggcactttattcttgatgagtttttggcagggccaggttcatgaatgtgtgacctgtggaattgcacagggttctagactcagaaaggtcctgcctgtgttttgtgtttggtttaaagatagctgtcagagtcttgaatttttttttctttttttttttttttgagatagggtcctgctgtgtcacccaggctggagtgcagtggtgtgatcaccgttcactgtagcctcgtcctcccagggtctccatagggaggccctgtctctacaaaaacaaacaaaaaaattagctgggcatggtggtgcacacctttagtaccagcaagtcaggagtctgaggtgggaggattgcttgagcctgggaggttgaggctacagtgaactgcactccagtctgagtgacatagcaggaccctatctcaacaaaaaaagaaaaaaaaatgtcaagacagtaatagcagagctttaattcaaacacagagcctttatatgctatagctcaggttggagcacctatccgttaattagcagttttgcccaaaaggggcctatgcagatctcaggcccctctcagaatctatgttctagttggaaacaagggctaatcatctgtatgtaaaacaagctttcaggcaagatgcaaaatgcttcttgatcagcagcattgccaaggtgaaagttaactatgcatgttcactcatcattcaacaaatatttattgagcacctaccatgtgctgggcactgtgctaggagctgggatggacgctatcttgggttccttgtgaagcagacgccatgacaaagatttgagtgcaagtgacttattggaaagatgatcgcaggaaatactggtagaagagtaagaaagtgagacagagacatgaaggaagccaataaatggtttgttttcacagagaaaaactacaactatgtgcaactagggcctaatccactgaggaccagtgtagaacatgcctcggaattttcctgtagaaagacacaggttggttcctttcccactaactctgatccatctggttgagagctgcccagggttatttccagcctgccccctgtgtcagaatgaacacaactcctcagctagagaaagctcttaggcaaagaatcacagcatttgtattagaaagctgtatgtgaatattagattagtgggtgctaagcgtgaggggatgaagagtgacaagttggggccaccattttgaatagattggtaggacagagctttctgaagaggtgactcttgaaaaaagacctatgtctttttaaaattttactatttcaaaaatgggagtcatgcatcaagaaaaataggattcttaagtcatgttgtatataatagacaaataataaacatatattttgatctttgggaatgtttatattcttgaaaacattataactttcagagagtatttggctatttggttggtaattttcttgacaatctctttttgaatactgtggcatcttttcatctatattctaggttttctcagtgttagaccattagacctcatgatcagaatattacagttttcaaaaccaaagttactgtcttctttaaagtatgggatatagtgtctttaagcatgaactgcttttttttttaaaaaaaattggaagctatcactctttttatacacattcattgtgaacttggtgtttcgtgtttttaaacaactgaatgattataagtaaagaaatgactgccttgagtaggatagtgaaataataggaagtgaaatataaattttcacattagaaaaaaatgattcccacttctttgttgggacaagaatgtgaagagtgttccttatgattaaatgactcaaaattgactcactttgtctaattaatagataggccttactgtttagatgtttgtattttacaaatgtattttccaacacaaaaccactggagggtgaactcaggtaattttagctacatttttttttcctgtaaaacatagtttcacatagctttaaaatcaacctttttgggccgggcgcagtggctcatacgtgtaatcccagcactttgggaggacaaggtgggtggatcacaaggtcaggagatcgagaccatcctggctaaaaaacggtgaaaccccttctctactaaaaatacaaaaaattagccgggcgtggtggcaggccaggcgcctgtagtcccagctactcgggaggctgaggcaggagaatggtgtgaacccgggaggcggagcttgcagtgagtggagattgcgccactgcactccagcctgggcgacagagcaagactccatctcaaaaaaaaaaaaaaaaaaaaaaagaacctttttttaatttccttacttcaacccaaatggatgcatctgtaaaattgtatctctcataaatcattctaataatatttgcggtgattataaaaggaaaatacatggggcttgctaattatgagaagacatttgtttgtttgcttgcttaacagttacttcatgcattgtcctaatgcttctttgcagaaatcttttagtagttagtgcctctctttttgtgcagtaagcaatggatcagactgtaagcttttactttactaagtgaggcgatggcaagattttaagaccaaattaggaagtttggtttttctctggaaactatttcatttttagtccaattttagtctagaaaaatagggttacaaacaaagcctaataattcattgcttaacagaagttaaatgaaaaactgcagtttgcatcaacttcctggtttttcgcaaaatcatcccgcatattctttttagctttgtgtggaactggggcttatcacactttaatgtggatatgagtcacctggagttggtgttaaaatgtagattctgcacgtccaacaagcatccagatgatgcagatgctgctggtctgtgggcacctttgaggagcaaggtttctgtgttggttaattttatacgtcaacctgactcggctaagggttgctcgatagttggtaaaacattatttctggctgtgtctgtaaggatgtttctagaagagattagcatttgaattggtagacagagtagaaaacagtgtcttcaccagtgcaggtgggtatcatcagcagttcattgagggggtgaatagaagacaagtgcagaaatggtgaattcttctctttctgcttgagcttagacatccatcatctcctgctctgcccttggacatcggtgctcctggttcttgggctttttgactcaggctgggatcccatcaatcctcctgacctcctatctcaggcctttggactcttattgaattacaccaccaactttcccggctctccaacagattgtgggacttcttggcctccctaactgcatgagccaattcttagaataaatctcagtttatatatatctctctatatcctactggttctgtttctctagagaaccctgactaatacagtctcagacaactggcttcaggattcatcttgcctaactgtgggggcaaaaccatgcctggggaggggtggactgctttgaaaaacaaagaggttttggagataaagttagcctgaaaatttttctgattcagacaaccttgcatcagaaaaattttgatgagccttgcttaggagtgcaaaaagcagacgttacagttttaagcagaaagggctcttgatgttaagtaaaggactggtagagattacagaagaatttcaggtactgtagtaattacagaggcagaactcttttctccttagcaacagtctatgtgtggggagcagaagcttgttatagcagaggtcactacagagaaatctgtgtgtgcaggcagagtcaaaagcaattgaaacaagtttgcactaatgactttggggaccagagtgccctgacaatggaataggagggccatattatcaggggtgacctctaatttgcaattaaaatgacttctgggcatgtaaatggacaactgggtgggaggattgtgtaatgtgggtggcactcagtgaatttctttatcttagactttgatgaaggaaagttattcccctgctccttgcaagctcgatagtgacagatggttgttgcttccttgctggtttctgttcctagaggaataaagtaggaattggtgttcagaattcaggctatggaaagatactgatgtttgggtggacaatttaggtataagaggacattggctgctgttactcaaccaaggcaaagaagggttgtggaaagtcatgaagattaggggtagccaaaactactcatgtgatccttgagcaggttattaacctcttctagcatcaggttagtctgctttcatgagggtaataaggcctatctttggtgggttggagattttatttatgaggggcctagcagaatatttagtacaaaggttctcagtaagcggaggtgttattttagaaatttatcttgaggtatagctcatgattagatttcaagatgagagctagagttctgaattgaatttaaacttgaatttcatcaatacagtatagcgacaaagcccagagggaatataagagatgtaggcaatgtaaaatgcaagaaagcaagatgctcagtgtagtaagaaaactggtagattaatattttccacaaatgtgacaaaatacaaatttatttacagagctcttggcacattaatgggtgaaatgcctggggctgtaatgattagaggagagttaaattcttgtaataaccagaacttagagaattattagatgcctccaggtaaacgaccatgtgggcctctccagttgtctttcttctgatcacctggttgtaacagagagattttattattgtcaacccataactcactgcctacccattaagcaattccacagattctttcctaggacctgtgctgtccaatatgggcaccacttgctgcaatatggctattttgcactcaccacgtagccagttcaagttgagatgtgtctgcaagtataaaatacacatcagatttcaaagacttagtatgaaaaaataatgtaaaatatctcattaatttttgtgtaatatatggaatacatgttgaaataatatttagaatatagcggattaatgaaagatattaatattaaaaattggttttaccttgtcgaatgtggcaactaaaaaatttaagttatgcatatagttcacattttatttttattgaatattgctgcctagaccaccctgggacctgtataggaattttctggagaggcttaaatcaaactcccttgttgccaaacagaaataaaactaaaccaggccgggcgcggtggcgcatgcctgtaatcccagcactttgggaggctgaggttggtggatcacctgagatcagaagtttgagaccaacctggccaacatggtgaaaccccgtttctactaaaatacaaaaattagctgggcatggtggtgggcatctgtaatcccagctacttgggaggctgaggcaggagaattgctggaacctgggaggcagaggttgcagtgagccgagattgtgccattgcactccagcctgggcaacaagagcaaaactccatctcaaaaataaaaaaataaaaaataaaaaaaaaaacaaaatcttatgctgattcaggagaacttctgagctgagaaccattgtcatttctcaacaaaaggactctgcatgagcaagttaactgaattcctgtggtaaacatgttaggtccctctaggtgtagtctcagagatataactaaggtttttatatcatttatacttagctttttcttaactttgttttaagtcagtatttgccaactattatctagaaagcaatgttttttctcaaaggtgtctgtcactagaacacattccccccctctcaaaacaaatacagtagaagaacactgaaacaaaagaaaaatcacatagtgtacttttggtcaacatttatcttgctgtaaaaatagaagaaagagaagaaggtaggttggcatctattaaatggtattacaattactggttctgtttctttgtggaatatggggaatcaacaaagtaaatttattctttctgatcctaagttgtcagggagttattgaaagggaattgcagtcctatttctgcagcagaactaatgtgaaaggagaatggtaaattaaataaggtcaaaatgatttagctagctgcttcagtctcctgaatgatcacatgtaagatgcaaataaatgtagggctttgtgctattaaatagagttatggtttttatcttggaatggatactgtgatgtggctgagtagtcatattaataggatatttttggtcactcacttgtccttagattatctcagttccagagatgggaatgattaagattgtaccctactcatgaggaatagaggagacagtgtgtcaaattggaatagaagaatgagcaatgaattctttcaccagcatatcactgtgttcccaaattttgatttaccattgtattctcttttttaaaggccacctatgaaaatagtagagggctattttgactctcatttaatctttgctgtatcttcaaagttgagagggatatcacatggcttgtgatttcataggagaggtttaggatttcagaagtgcttggataaggttggtctatactcttaacatggtgtgaggagcaggaagataatattgccaatggggactctattagtaagtgttaataaatgttgaagtacttttaaaagaaattccaaaatagtctctagtcttttttgtgtgtcatttcttttggaactataggattcaaagctctggattgtaacactaaatcaccttgacaagtccctagaatcataactagggaagtacattgggtttgccttgggaaagaaggatataaaaatggaggtgtgtttttcttcctaccctccccatcccaacagtggtggaaagtttcatttattcattcaataagcatttattaaacagtgtagaaaccccatgttagataactttgagaataaacctaaaggacggtacgttgagtatttgattccaagttggctttttcaatgttcccatcactgatggaatcctgagaaccctgttagcctagcactgactgtttctttcactcttggatctcagatggtggggacactgaaatctaggggaaggttgtccggtaccacttacaattccagtttctctggttcttcgaaattgtcctgaatttctttaaaatcattattcttagtcttgaaacactaggttatattcataacaaatggttttgatcttaacagcatccttaattttctgagagaaatgaacaaaaattggtattctaaatgccaggtctcccagatttttattatttcagacaattgttgcagcatgcgaaatttttaaaattacaatttacttattttgagtcttatctcttcctgcatgttgttcatgctctccactgcattaatcttcatctatttacatttcagtcaacctgtttatctgttgttaatccatcttctggctgattcctgtcaatctcagcctacaatagctcactgggaatatattacataaaagtcatcaagggcaggagagagagaatggtattctgattttgatctttactcagaattctcaatgactttccctctgtgatagcagcagatgttcccaaagttagttattgaaaatgacagtctcagtttcccgtttttcactcttgactctcaaaaatggataccagctacttagtatgtcactgtgttttagcttcttaaagattcatgttaaaactattcattgtttttcagactaagtgattgtagtttctttaactttttcaatgctgggtttgaaatcatttccctttcttacacgtctgaatgcaatccatcaaccaatgctgttgtctctgttttcaaaatctgtactgaatccaacagcatttcccaatgttaactgttaccgcctttgaccacgccactgtcatcactcattcagactcttgcagtagcctgttagctggtttcggtgctttgttcttgccctgccgtagtcagttctccaaaagacaaagtgttcctttaaaacttaggtcagaccaggcaactactgctcagaatgttctgattgcttcccatttaattgaaaatcagatccaatcattgtctttttctgtgatctgactcccttttacctttctgatttcatcccttctggtgtcctcctccttcacttgctgttttccagctacgttggtctcttcacccttgcagaatacagcattcccctcaaggcctttgcatctgctggtcccactccctggattcctcttcctctcagtcttcttgaggctgactcactcacttctctcaggtctttgctcataagtcacttcatgagtgacacccttgccaaggccagttatctcaagtggtaaccactacccctcccctccccccagcttgctaggaatgcaataaatatttgttgaatgagtaaaataactatttttcatggaaagacatttaatttcctgttccatctatgggaatagataaggaatgcataaaatgatcctcagcagcagaaggcaggtaaacatgacaacaaagtgggaagaaatcagacatggtaaaaattccatatcatatatttagttttcttaaagtacaaacagtaacagaataaaaagtgaataagttgtttaaaaatggaaatcttccttggaacagctaatatttataatcagatcattattatgcaattatgtaatgttactggtataattttgtgttttctaaatattaaatgctcctccctttgcaattaaatttaaactatcaatatgcttgacaaactgccttttataataaaatgtacctgtgtgtatagtactgtatatatataattgcatatgcatgtgtttgcattatcaataatgtaggatttttatactcataaaagttatgatgtattagaattatttcctattgctaaatgggaatctattgtgattattattattggtgtaatattaatattggtaggtattaggcacatatatgcaaccttgtagagggaatatttcttctggaatcagatcttctgcatgttataactgtgtaaatttacttaactgtctgggcttcttgccttgtttttaaaaaggacataataatacattacttatttaaaggtagaaaggtagaaatacatggtactctaacatttgacagattgcaaagagtcatcattttaaaaatcacaatgagatattatcacacacctatgagcatggctaaaataagaagaaaaaaaactagatggtaccaagtgggtgaaaatgcagagtatctgggattcccatgcattgttgggaatgcaaaatggtgccaccactttgaaagacagttggacagtttcttacagtgttaaacatataatacatataacccagccatgccacttgtgggtatttacctaagtgatggaaacttatgcataaaccaaaatctgtacactagtgtttatggtagcttcatgtagagtcatcagaaactggagacaatccaggtatctctcaactagagaatgaaaaaataatatctggcatatccatacaataaaatactactcagcagtaaaaaggaacaaattagtgatgcatgcaccaacacagatgaatcccaaaatacattacgcttcctgaaagaagctggagtcagacttggaaggctacatactatatgattccatgcagtaaaggcaacattgtaggaaaagaatacagatcagtggttgtgtgggagtgggaagagagactgactgtcaaaggggcagcctgagggagttttgaagtaatagaattgttttatgtcttgattgtgtggtggttacatggctgtatgcatttgccaaactcacagcattgcacatgagagagtctattttattgcatgtgaattaaaaataaaaataaataattatcttgatttttaaaaccagttatacctctgatgccaggcattgatgaatcctaaatgtcctaggtgggtgatcacatctgctcttagttccccattttattttactttagttgccgtggtttcctggtgtggctttgtcctgcttcagttattattcatggcatgatggactttggctctgatgtcagaggtagcaatggtggaaagctttcccacattctcccagaagcagtttcatatccttagagggaccttgccagctgactggtctagctcagtggtagtggtgctgacaaaggctgggatcttgtcctgcaacttcgaatttgtagatatatcagctgctttagttcctttataaaaaccaaatagaaatgaataggaaacagaatcagagcaggctgtttttcaaagaaattactccaggctatgcatctggggcccttgttttcaatatggtacctgtctcagggctctgacatcagcagctgtgttctgggtcatgaaaagtttgcagactccagctccatcaaaaaaacaaaaacaaaaaccaggtaactgctgtatcgcactgtgttgtgccccagtgggccagcatatgaggtaatgtctcatggaacagatggttgaccagttgtctttggtaaaaaaaaaaaaaaaaatatatatatatatatatatatatgacaaatataaatactaatctaaacatataatttataactagagaactttaggcatttgggggttcttgtaagctgtacttactcttcttctgttctcacttactggctagtagatacattttatgtttgttgagaatgtgactaatgtaaaggtccttgaggtcatgaatctcttgtaaaaccagcctgtttccagttttctagactattttggatcctctgttttaggtatatcaccctgcttctatacagctgtcttaagagtgctataaacctagattgaacaggaaaccagcttcctaccagcaggttagaagtgacttacaataaactaaaatgagatatttttctctctggcattattctggagcaacagctcttgagtttcctatgctactattcttagtttaatttgcacagatcattttctctatatgcatagttatgtcagtgcagaaataaaggagtgggagaggaatgtaattgagtactcactccaggtttcaggaatgtgataggcacttttcgtgtattattccatttaacttcacaacaatgagttaggtagataattttgctgctttacaaacaaggaaactaggtccaggagaggttaatttacttatattctcaaagataggtttctctcactcccaaaaccactctatattccgaaggctccatttgggaatagtgttttttttttttttttttttttttttcccatttctttgtcacttgcaatgggggatggagattgcactggtcttttgagattgagacctggagcttcttcttagacctggtctgagaaccatgtctgttccctgttttacttttcagagtcccaagagatttggcctaattttatgtatttcttaaaatctgccattacacacgtttgatcacttggttctttctcccccatgactgcctttagaggaaaattgagtcccacagttgcgtggctctgaacaggaaacccataaggctttcttattttaataattctacttctaatcaccacagggaaataggaaagcaaagagaagaaaaaaaaacaaattaaaaagattcaaaatagttaaaatcttagtcgttgagtcgttgagcccagtttacatagtttctgaaacttagttcttatttcttaaaagatactaaaagtcttttttttttcatagagattacttttatttatcattggaactgtagttcaaagcagattcaagttggtaccacttgtgaaattttccagtcactatccaagctctaagattttttttgcgggggtggggatcgagtcttgctctgttgaccaggctggagtgcagtgacacaatctcggctcactgcaaacctctgcctcctgggttcaagtgattctcctgtctcaacctcttgagtagctgggattacaggcgtgcagcaccatgcctggctatttttttttgtatttttagtagagacggggttttgccatgttggtcaggctggtcttgaactcctgacctcaggtgatctgcctgcttcagcctcccaaagtgctgggattacaggcatgagccaccgcgcccggccgctctaagactttcattatgaaccagtgacgtaagaaatgtctaagaagtaaagctatatgtcatgttaaagagactgccactggatgggactggggaatgtatattaggcttaaagaacttttgccgccccgtaatgaaagccagagccacgtgtgatcattgaacatttgaaatgggggtaatttgaattgagatgtgttgtagcagactatacgttggattccaaagactcagaatgaaaaaaaaaacccgaatttaaaatttctgaataatttttatattgattacatgtacattgattatattttaaaattctatgtatactgagttaaataaaatacagacagttcttgacttatgatggttctgcttacaattttttctcttaacaatggtgcaaaaatggtaacacatcctttagaaatcatacttcaaatttttatatttttgcaggctagcatatgtaatgagtttctcttgcaatgctgggcagtggcagtgagccacagctccaagtcagctgtgtgactgcgagggtaaacaaccgtgagatattcaacgcttaactataaaataggctttgtgttagatgattttgctccactgtaggccaatgtaagcattcggagcacatttaaggtaggctgggctaagctatggtgtttggcatgttaggtatgttaaatgtatttttgacttaccgtattttcaacttaggatggatttttcaggatgtaaccttattctaaatctagagcatctgtatattattaaaattaaatttacctttttaacttttaattttgaggtaattacagagtcatatgcagttgtaaaatataatacagagaaatctcatatatcctttacccagttttccccactggtaatattttacaaaacagcagtacagtggcagaaccatgcaactgacgttgatgtaatccactgaccttattaagattttaccagttttacatgcactcatttgtgtgtgtgtgtttttagttctatgcaatttaatcacctttgtaaattcattatgacacgaccacagtcagaaatggaattccatcccaaggatctctgtgccacagccatctcccttccttctctcctctctaacccctgggaaccattaatctgttctttacctatataattttgtcatttcaagagtgttatagaaatggaatcacatagtatgtaacttttgaaatgaggttttgtcactcagcaaaattcccttgagatgcattcaagttgtgttatcaatagttatttcctttctattgttgagtagtatttcgtgtttcttttaacctttgtaatgatgccactagaaagctgaaaattacatatgtaatttgcatttctggctttcattgtgtttctattggacagcattggtttaagggaatgtttgttagaagtaattaaaaagcatatttctgttaagattttcatggaactttaggtattcctgtgttaaatggtgtattttgttctgctaactttaaatcaggttatttggaaataagcaagggagcagtggctttaaaaaaatcatttcaagagagtaaaattatctgtgtccctcccacatccctcctcctgccttttttttcttttttctttttttttttttttttttttttggtcagtttttcagtaagaaaccctttgtatttctatccacaaaagaaacttttcatcaggttaggcagcagaggggcatcttgcaaccactcccatggcattcagcacactggtttgagactaattaaatggctcatatttatctgatattttccctcttgggagctccagaaacttttttctttttcaactgaagcttcaaaaagaaaccagctcagttagcttatgaaggagggaagaaacaggacacagggacacttcagagcagattagaactgaggtaaaggagactaccattttcaattaaaattgcctggggaaattaggtaggcagagaataattacctgggttggcacacatccaagtttctgaaactaagaccctgcttggatgttctgagggatcattgacaaacacaagtagccaaggaccttgaagtttatgtgtcatctcaaatgtattcaagagttctggatacaatggatggctattttaagtcaaattatatagcatgagatgttctaacaaaaccctataaaaaccaatacccttgggaggctgagatgggtagatcacaaggtcaggagttcgagaccagcttagccaatatggtgaaaccccatctctactaaaaatacaaaaatcacctggcatggtggtgggtgcctgtagtcccagctactcgggaggctgaggcaggagaatcacttgaacccgggaggcggagtttgcagtgagccgagatcgtgccactgcactccagcctgggagacaaagcgagactctgtcttaaaaaaccaaaacaaaacccaaaaaccaatacccaaaacaaacgataccacaaagcatcagattaaaggaggtttctgtgacaaaataaatatacatttctgtgacctcagccatgtaaccaacaggacactggggctgagattgaactgtaggagaacatgaagaggactgattaaagtatagttttagtctcttacctccttaggcaaggggccctagtacattaacagtccttggttagcatcttacaagtaccaagaaacatcactgagtaaatgtcctaacacaaggacttgtccaacctagtcgtgcaaatgagtcattgaaagcaaatctgccttgaatgcaaatgtcaagatttagtattgtactccccaccccagctctacctccagtgacctattactattatacaactgctaagcatggtttctcagggtctgtgctgcctgtggctggtggcacgtggtgccgtgctgccattgctatggggggatagaatcgatggaaaaggttttcggttattgaactatagattttttctttctcattacctagaggagggcccaccatctgctccacaataggaaagggatccaatcatgtttcttacttgcttctagtgttagcttttgctgtgttttcattgtttcataatctctcaatttcaaaatggtgcatagtggaagagggtttagaaggaagaaaagagagaaaaaggaatcaattatatttttttctctttcctctttcaaaataaaacacaggggtagaggaatacttgtattattttcttttttaaagagattttcatagacttgctgaacaaggcagctgctggtatatagggtattttaacgcaaattacagaaatgtacccctttccagggctgcaggcctcactcacctcttggtcatggacatgagccgtatctgtctgagtgcaatgcatgtgtgcttggccaccatcttgtgctgtataatagatgcagaaatagcccctattttatactgtggaagcacagatggatgcacagacagttgccttaagaggaagggtcccagggccagtgcatcaggggtgaattcatgctcctttgcttacctgtcatatgactctggataagtgagatgactactctgtgcctcagtctgctcatctataaaccatttctgtctcatagagtttgatgagatataatgagttaatatacataaaacactgagagtggtacctggacatagtaatttctcattgattggtagttattactatttgcttctgacagttttgctgtctaaccaaacatgtttctgaagggagatttcttgaggattctcatttttttaagtcttatctaataagccatgtactagtggatatattaagcaggattttaattatatttaaacttttacttttttttttttctttttttctgagacagggtcttgctctgttgcctaggctggggtgcagtggtacgatcacagctcactgcagccttgacttcctcggttcaagtaatcttcccacctcagcttcctaagtagctgggactacaggcatgtgccaccatttctggctaattttctgtattttgtgtagagatggagtctcactatgttgacgaggctgatctcaaacttctgggcctaagcagtcctcccatcttggcattccaaagtgttgggattacaggcgtgagccaccacacttgacctgcttttactttaaatattagtgtggttatgtatatgctgcctctgtgtaacttcccaataatcaagtcagttgaatgaaagagcagtttaaattggttaacaccatgtacaaaatataacctaatttaattaaaacattttggcccatgttattaattggataccctgtcctaacaaagcaaaacaaaggaaacccaaatttttggtccttctaggtactgagtgtgtgtttgctgctgcttttaaagaatgtcacttttctagacatctagtttcataagatttagtttaaggtcaagaggagaaacatctcttatagatttagaacttggtagagtacagatattctttgcagtagatgtggaagtccaagaacatttgggagaattgttaaaaatgtactgactggttttatttagcctctttgctggtcagttagcttttcttgtgacatagctgcagagtcaagcctgagttacatagatgacaaatgcatgctaagttaggtgttaacaggcagaattctaaggtggccccccgagactactgccccttggtttacatctcctgtatgatccccaggactgtgactatgacgggatgtcactcctgtgattaagttatgttacatggcacagtttactttaagaataaaagtttgtccttgatggaccctaaaaggggttggagagaccgattcagagagaaagattccatcaggggagattctccatgactggctttgaagatggtgggggccatgtgacaaggagtgttgatggcctctaggagctgagagtggcccccagccgacagcctgagtgaacttgtaagcacattatttctctgagcctccagaaaggatgaagcctagccaacaccttgattttagccttgtaagatgctgagcagaaaacccagaaactcctggttaacgtggtgaaaccccgtctctactaaaaaatacaaaaaattagccgggcgtggtggcgggcgcctgtagtcccagttactcgggaagctgaggcaggagaatggcgtgaacccgggaggcgaagcttgcagtgagtcgagatcgagccactgaactccagcctgggtgacagagcaagactctgtctcaaaaaaaaaaaaaaaaaaaaaaagaatgaaaaagaaaacccagaaacgatgtctggactcctgacctacagagctatgagctaatgaatgtgtgttgcttcaagtcactacgtttgtggcaatttgttatgcagctgtagaaaactaatacacgaaggaaaccaggcaaaagaatgtaggttagcaattgcaaagccattaccattatttagagaaaaataacacccataaaaaacttgtaatgaactcctctaaagagccctgttttgcattgtagagccagttggccacagtaaatgacagatagaggtaagttttctgggcagagtttagatgctttctcgggaggggaaatgaatggctaaagtagctctttttcttggtgtttactgcatgacggcaaagaaaaaatacagaataggaagttggaatcccctcccttccatgcttatacatgttgctgatgagggctttcatttagggatcactcacttgggtcggtgagaggagaacataggtgacggagttggctgggtggaagtgctctggagggcgggggctgtggggatctgaaaacccaagctttctctgaggggacagatgcctctcagctgtggctgagttgtctgcagcattctgttgccacatcatccaaatttctaagagaagctgggagtctgtatatttatgtgtagtctctcattttttaatgttaataaccggctcaaactctaaaagatcaccatggattcatataaacatatatgtggccagatcaggcccatgggcagcctctctgtgaatgcagcctagagaattagtatatgggggcagttccagagactgagagaattggagggggtgagtgccatgagttctagaagttttgtctgtttttttcactgccatatactcaaactgagaacagcatctggcacacagtaggtgctcaataaatattgtagcacgaacttgaggaaacataaacatattaataccttacatggatatagaaaatatgactgcattggtgaaacttgtttctaagatttgattacttttaatgtctaggcatggtatgatttgggctaacacagtgtccttttggcccacccactttctttttttaacctgcgattcattcgagggcttttatggaagtcattaggtgctacagaacaaagcaggcattgatcccttctgtgttgcttgggtgccttgctcctcttatctcgtctcactctgaccctgacttctaagatgagtcctaacaccgcctgcattttacagataggagctggtttcagagaggtgaagacagttgcttgaaactgcatagctggtcaatgatggtgctcagctcttctgactgccaggtctttgcccttcatctctgtgcttgatactcagcatgcattggaaccagtcatgtcagcatcacctgagagcttgagcttcacacatgctgaatctcaggccctgcctcagacctacagtcaaacagaatgtgcattttaaccagatatgctggtgatttgtatgttaaagtttgagaagcattgtcctaccccactaggttctaaacttgggttattcctgaatcacttttatggatttggccaaatctgagttttacctgaacttatgactcatcttttccacttaaatgtatttgcttaaaaagaaaatacaaccatgataatgatggtaatgtggtaacattactattataagtagctgtaaataattatagttatgtacccaatagaagttatgtacccattcaatagaagaatgattccattttctataaatagaaggtaagtgctaatgcccatgcattctacattacctctccatgtaccattgtaaaatatctgtattttaagatggtacatggaaactgtaccattaataataaagtgtaataaaccataaaatatctcttcatggaccattagtgggagagtgttccgctttgggaaataatgctatggtcgattgtaaaaacgtccacaaggtcttccccactgtacattcatggctttgcagtgtgcagtgccccatcaagaggtgggaccatttctctatcttttgaatgtgggcttgaccatgtaactagttttgccaaatgatatattagccaatgcgatacaacagaggcttggaaagtgcttgtgctttggggcctgccttcttgcttctcttgcaaactagagaacaccaaaataagtggttattgatttaagctacaaaagtttgaagtctttgttgtactgcacaatctcactgacacaactgctttccaacattctgtttgcttgcaaaacaatcatttccatgttcagtattaagtcagagtaaaatgatctgtttttgttcaaccttgcccagttactcttcactttaaaacaaaatctgaatattgaatatcttgggggaggacatcacatgctagtctttttgtgttcagtacatatatagattcactaaaacaggcatggcaatgtcacctttaaatatttgtaggtttcttcctcctctgagaaataaaagcttcacccttggctaaagttccccattgctttgaaataagactatgtaaaacactgtggcatgattagtggtggtttacagtaaaatattggtgttttcttatggcttgaaggcagttccatatgtatgcttttcttttgtcagggtaaaataaaattggatgttttccatcacaaggaatcccctgaagaatcacaataagactttttaatatatataaattttatcacttactgtgttttcttgaagaatgtgagtgttttctcatttttggaaaaagctgactggcaaactcactatgtgtattatagcctttttttaaaagactgctttcatgaagtataatttacatatcataaaatgcactcacttaaaatgtacaattcagtggtttttagtattaatatattcgtggcattgtgcaactatcaacacaatctaacctttgaatcttcattaccccaaaaagaaatcccatgctgctcctctagtcatagagagccactagtcagctttctgtttctgtggatttgcctgtagtggacatttcatatacatgggaacataccatatgtggtctttgtgcttggcttctctccgttagcatacttttttttttttttttttttttttttttttagacaaagtctcactctatcacccaggctggagggcagtggtgcagtgcaatctcggctcactacaaactctatctcccaggttcaagcagttctcttgcctcagcctcccaagtaggtgggatcacaggtgtgtgccaccacacccagctaatttttgtacttttagtagagacaggatttcactatgttggctaggctggtcttgaactcctgaccttaggtgatccacccaccctggcctcccaaactgttgggattacaggcgtgagccaacatgcccagccagcgtaatgtttctttgaagttaattcacgtagtcatgtgtatctgtgttgcatttttgaattgctggataatattctattatgtgaacgtactacacgttttgttaatatgtttatcagttgatggacattgggattgtttacaattgggctattatgaataatgctgctatgaaattttacatgtaatttttatatggatatatgttttcattttttcttgggttcatatctaggagtggaattactgggtaatacagttacttcatttttaaccatttgagcaactgctagactgttttccaaagcagcagcatcattttacatttccaccagcagtgtatgaagtttccaatttctctaaattcttgtcaacacttgttatgtcttttgattatagcttttctagtggctatgaagcagtatctcattgtggctttgatttatatttccctaatggttaagtatcttttcatggttgtatatcttttttgggaaatgtctattcaggtcatttgcccatttttaaattgggttatttgtctttttcctgtccagttctaagagttcttacatcctggataaaagttctttatcagatttcctgttctgtgggttctcttttcacttttttgacggtgtactttgaaggacaaaagtttttaaagaggttcgacttatcttcttttttcttttgttcttcatgcttttggtgtcacacctaagaaaccattgttctggtcacaaggatggtgccacccaagatcacaaagatttactcctatgttatatttacttttaagaattttatagttttacttctgtgattcacttggagctaatttttgtccatgttgtgaggtaggagcctatcttcattcgtttgcgtgtgagataccatatgtggtctttgtgccagttgtcctggcaccgtgtgttgaatagactgtctctccccattgaatggtcttgatacctttgttgaatgaaacagcttttgtttgcattaacactgatacaactctgggatttgcaattttgtttacctattatgggaaaatatctttcttctttgaaagatcaaaacacgtgggaagacatacataaacaccccagacacacacacacacacacacacacacacacacagcctctgtctctcacacacacactcatgcacacagtcccttctttaccaaagccccatgtaatcccttcatgacccagaataatagtatttgaaaggaaaagttggtatgctggagtcttcattcacatattactacaactccaagtcagttgcaatagtttggctatgatatgccagtagctaaatagttcatgacaaattgcttatactgcttaacttctttgtagttaagtatttcaacattgccttccccacatgttgcaatatcttatatatgcccagaattagaaaggtttatggaacaatgaggcagtttatgttagatagttgctagggaattaaagaagagaagggaaaacatgtgtccagtctctaagtctttgattacgaaatgacttgggcagcaagtggtttctcaaaacgaggagcatggtatggcaggatcattaatcaatgagctttttgggaactcggcctgtttcatagcctcaggagacataaaagagtcatatagtttaacattccagctgtaggtaggccacctaattattcagcattcaacaaagatttattgagcatctactctgtgccaggcgttatggtaggtattggggaaatacctagtggttttcaataacacataatccctgtcttcatgggagtcgtatcttcattattaatacataattacaaatataaatgtaagattgaaaatctggtaaatgtcatggaagaagtggcactgtaggggttaaacatgggcgagggtgcctgggtttgaatgccagttttgtgggattcttgaatattcaacttcttcattcccttttctataaaatgagagtacatacatttttgagtttttatgtggattataaatgatgattcaatccatgcttagagccagcctgcatcatagtaaatagtcactaaattagtaaagtcagggtacatgatgctgtgtattccctaattctgtatatttgaagtgggatgttgctttctgtagagactttggagtgaattggctttttttccattttaattataaaaattatttgcttcatggtaaaatattacataatggttaaatgttaggttaaaatcaaagaccttaccctttaaaaatctccttttagtactggtcccctagagggagctagaggtagccacactcagtgtttcttgttttccctccagatgcgttatttgtgtataacgatatatatgtctgtgtatttacatatagattagtgaggtttgtcttaacacaatggagccatagtatccatattactacactacttcagactttttaaattaataaaatgacctgagaatttgtttctatgtcttttcatataggtacagatttcctctcttgtttttcatggtgtagtcttgtattatatgaatgtaccaacctacctgagaccttattaaaggactgtgctgtagtcatctctatacatagatcgtgaccttcacaaatttcaattcaaactttatagacacagttttcccaggtgtcatcagttgcctctgccttcttaccatatggaaatgggcttccccttacttttgtgtacttctttttttttttgagatggagtttttgtttgtttgtttgtttgtttttgtgagatggagtctctctctgtcacccaggctggagtgcagtggtgccatctcggcttgctgcaagcttcgcctcccaggttcacgccattttcctgcctcagcctcccgagtagctgggactacaggcgcctgccaccatgcccggctaattttttgtatttttagtagagacggggtttcaccatgttagccaggatggtcttgatctcctgacctcgtgatccgcccgcctcggcctcccaaagtgctgggattacaggcgtgagccactgcgcccggcctgagatggagttttactccgttgcccaggctggagtgcagtggcatgatctttgctcactgcaacctctgcctcctggattcaagtgattctcttgcctcagcctcctgagtagctaggattacaggcacgcaccaccacacttggctaatttttgtatttttttgtagatatggggcttcaccatgttggccaggctggccttgaactccactcctgaggcaagtgatctgcttgccttggcctcccaaagtgttgggattataggtgtgagccactgcacccggccacttttgtgtacttctgacaccacctggaacttttcctcccactccaccttgaaaagatcctgaaatctagatttcagccaaatcagaaatccaatgtcaaatccagaatcaacataaacaacttaataacaaagacaatacggaaacagccataaaaaaagactctctttgcaaatagatgtaattctgttataaaaagagttttttccaattacagttcatctaaggacattatactgctaatcaggaaaagataattatatttactttgagaaggttttagatagccttgttgttctattgctgcttaattattttaatagattaagagggtgagtaggatattagcagcattgtagagagagtgtataaactctgttggctgagtatagcagtaataattctgatatgatgactgtgtgtctgtgtcatttgtttgcaacttatgccactaatttttttttgtttttctgacgtttttaaatttacattagattctgattttgaagtgcaaaggactgtttttctccatgaaaactctaaaagtcctttacatcgatttgtcttgtctgtgtctgtttcagaggacagtgctgctgtgagtttgacgaagtggacatcacctgcagtcagtccagagctgcccagtgagtactttaccgcctgtgtggagagtctttggttgtaggtttctagaactttcagtctgtaagatgaatcccttcattctggctgatgctgcttctgaaatgcctctcaaaactgattcacagacatcttccttgatgcggcagagcattaagcaggatctcccagcactttctaggttcaattttattaatttcactactaaccttgggcactttaccctttgctagattttctacttgctctctgcaatagtgttgcccgcatttagtaagcatcacatgtttttgaagtgatcattgtctacaattctttctggggagaaatgtttctgtgacttgttttcagtcctgtgcagattttgcttaagaagattcccactgatgtgaaaaatcacaactgtgtacattatcagcaaaaatcctccattttgggggaactaccaggggatgatgtaaataaattcttccagtgctcccctaatggttcattttacaaacttttaaagaaacgcaaaaaggggaactggaaatatctttatatggctgatttgttttatttataaactgtaacttgccaatacttgtattccagagccagaatcctagtgaatatgagacatgttcttttataatcccttgatcaaattgctgtttgtttatttatttatttttgagacggaattctcgctctgtcacccaggctggagtgcagtggcgcaatctcggctcactgcaacctctgcctcctgggttcaagcgattctcctgcctccacttcctgagtagcattacaggtgcatgccaccacgcctggctaatttttgcatttttagcagagacggagtttcaccatgttagtcaggctggtctcaaactcctgacttcgtgatctgcccacctcggcctcccaaagtgctggaattacaggtatgaaccaccgaacctggctcaaattgctatttttaaattgctgttacaagtaaagcatttggactatgtatcatttcttaccttcaggaacaagaggtcattttatagtaatggcgtgaaccagcaactttattgtttctcctaataggtcctcctggaggatctgttcctctgggctgttggcatttaatggctgagtgttttcctccagcgttttgcatatcatgtgagatacttcattatcttctggcagtgcccgtggctgattttcttccggcctttccatgaggggaaggaagaatcgcacaacctgacacttctctaagtgatcagtgtttaatgatgacaagagatatccagaaagtagatttattattgaatgttcctatctatttttagtcaagtgcgctatcttttactactccccaaggatgactcataaaccatgtcttagtaggcaaagaggagttggggagtaggagggactgaataattctctcgggactttaaatcagtgtggacacatcatctgcttttcactccttcatcacattaatctggactatccactttctctgtttaagagttgtattatccttaaataggtcatttttcatcagctgtatttataaatggttcctatgacgagttatgtgcttattgaatataaacacttgattcaagagtccaaaaaaagaaccccagcagagctcagaagttttgttaaatattttaagttcaaagaagaaattcctctacattaaggagtgtaaatgccatgcatttaattttacaaagccttggctgggcgcggtggctcacgcctgcaatcccagcactttgggaggccgaggcgggtggatcacaaggtcaggagattgacaccatcctggctaacacagtgaaaccccgtctctactaaaaatacgaaaaattagccaggcatggtggtgggcgcctgtagtcccagctactcaggaagctgaggcaggagaatggcatgaacccaggaggcggagcttgcagtgagccgagatggcgccactgcactccagcctgggcaacagagggagactccgaaaaaaaaaacttttacagaggctttggatggctccagatcctggggctgaaacagtacatgggcagtgtactctcgttctcacccaataggacctgattagacttggagccccagatgtcacctggtggttggttgcttatgttacgcttgcctttcttccagagaatccttccatatgtccctccatcctctcctaaaaataaaaccatttggcctctactctagcatcattcacttgctacatatcttgaattgtgagttgtttttaaaacactgaactaaaatctgattcttctataatatcttcccatactcaaaattggaaacatctaaactctggaacctgagcatttctggttttgtcttgaaatgcctgctttacttccccacacttccaacggtgagcagctctgactctatgttagttctaaatgtattttttaaggcctatttatatgcagagtaggcattcagaatatgttcttatttctataaaggcaaaaggtatattttgaatcttgcttatatgtcacgttcaatttagcttttttttttaaacaaaacaaaacagtgttggtcaataaactcctaaaatagaaaatatttatttagagaacaaaatgactgtttttggatgaattatcctcacccttgcattaagtgacctttgcattgggagctttagattggctcttgctgaagaggaatgccttagtttagtccaatcaaaaactgctttcaagtttcaggaaaagaaagtaaacaacccttgataacttctctcctgtggcattttagtttggaagatacactgttcttctgaaaaacctatctaatgttgggggtgctttcttccttttaaattgttttaattaaatattcattatagaccgggcacggtggctcatgccacccagcattttgggaggccgaggcatgcggatcacctgaagtcaggagttcaagaccagcctggccaacatggtcaaaccctgtctctactaaaaatacaaaaaaaagttagctgggcatggtggcacatgcctgtaatcccagcgattcgagaggctgagacaggagaattgcttcaacccaggaggcggaggtttgcagtgagccgagactgagccactgtaccccagcctgggtgacagacgagactccatctcaaaaaatgtttgtattaattatatacagaatttataacattagtgttaggcatgcagctcaccaaacttaatgttgacttttctttcattttgcctctactttagagccttactcattgtcctgtcttctcttacaccttggagacatagatatgttgtaccagctattagcatatttttttcttgatctaagatctgtggcctagggttgctgcagtgctctataggaatgaggatccttcttattaccctgtaaatactttagttatttcaaactcttgagtgttacagaagctcttatccatggtacaacaatagcaagcacaaaaacctgtggtttctttcacattttcttagagcacattcatgcatgccaagagtcgtgagatgagctctccagaagcagactgagaagaggatttctgcacaagtggtttatcaaggcagggctcccaggagaaactagtgagtgggggaagggaagggaaagggaagaagccaagcagggagatgattcaagcaatgtgcctgccccagcctgatcctgggggcagagttggggggtgcagtgggccgctctggaacataattgctccctagagtctgttccacatcaaggcaatggagctgggcttttccactcctgcatcagtcactgactgtgggcaggtaagagagggctataaacttccaagcacctctgctgtcttcatctgcatgtgaagcagcttcggtggttgaagaaggtttttcttaagaaatgttggtaccatcccttagcagcaaagcacacaaaagccgggaaagggcacacaagacgattaaagggacccagtgttatctgggcaggacactagagtgtctgctttaccaatccacattccatcttcctccttgcctcactcctgcgggcacatttttaatccttagcccatttcctggtgtaggttaagcactttcagaggctgcataggattatttttcctcctctgagaatggagtcagctactggttcaaagagctaagtcctaaagtaattgcagtgttgggagacacctaggtaattttcagtgagtagaatttctacatatattagagttttagaaatagaaaacttgacatttcaaagctttccttagtaaaatcatggataatgatttcagtgccctgaaagaagaggtgaggatgtcatgtgattgtatgattggagattattcttactaggaacatttccaggcacacaggttaacttcattattcttcattctcatctcttttagccatcctttattttatttcctaatagttcacctttgcctttggaagtattttcttttcataagcttttaagggaaatatatagtgtttcttgggcaccttctatttatttattttattttgttttattttattttattttattttattttattttattttattttattttattttattttattttattttattttgacagggtctggttctgttgcctaggctggagtgcagtggcttgacatagctcactgcaccctggaactcctgggctcaagttatcctcctgcctcaacctcctaagaggctgggactacaagtatgcactaccatacctggctaatttgtaaaattttttttgtagagatggggtctagctatgttgacgaggctggtttggagttcctgacctcaagtgatccttccaacttagcctttcaaagcgccaggatgacaggcatgagctactgtgcccagccctcttgggtgccttcgattcagtacagcacaaaatttcatgattgttcacctgatgtcctagaccagccaacactgtccaatagaaatattacgtgaacaacatagaacattttgaattttcttgtagcttcattaagacagcgaaaagaaagaggttacagcagcctaaactggaggctggaatgtccaaaatcacaggtgaaattaattttagttacatatttaacttagcatatccaaataattatttcaacatttaatcaatgtaaacattatggaggttttacctttttttgtccactgaatattttgtacttaaaacggctttcaagactagccatatttcagtgctcaaaagcaacatttggctcgtggtaccatattggccagtgcaactttagaatattatagagaaactctggtaaaaggccttattctgtttgaataagactcttagtcagtgcttctgaatctcccagcttggtaacactactcagtaaggaaatgaggcagcaccgtggtccagagagagtgagctgatctgtccttgaggtgctattgctacttccatttttggatttagtgccctgttgtacatgaattaggattaaaacatttaggtttggcagctcagatgtcactgataaccttcaaaggtcacttagaagatagtgggccttgaatggagggtagaaagtagaaaaattttaaagaggaaagggagggaatttcaatgggaaaaaaatctatatatgtatatcgtgtgttttgggggaggattctagaaaagtttgggtataatacttttatgcaaactcatggggctggagtgttacatatacaatgagaaaggtatagttagtggccaaactgataccagactcaaagagtcgaattttgcagtacatgaaatgagatatcaccatgatatagtatatacgttgggacctattctggttatttattgttgtgtaagaagtcacttgaagatatagtggctgcaaacaacagcagtcacctttttacctctcagtttttctgtggtcaggagttagggaagggcccggctgtgcatttctggcttgagttctttcatgcagttgcagtcaggtggcagctgacgctggaagagcaggcagctggtatggctcagcgtttcttcctcctcacccagtctcatgtggtcttttctatgtggtctctcttcatgggcagctttattctcatagcatggcagcttcagagcagggggacagcctgcctgggcttcagtgtgattattctgtccaaccaggtggaagcagcattgctttatgacttggccttggaagtcatgcatggtcacgtctatcacattacagtagtcctctcttatctgtaggggttacgtcccaagacccgcagtagatgcttgaaactgtgttaagtactgaattttatatatgttacatttcttctatctgataatcaagataactactagtggccaatgagtgggtagctagagtgtacagcatggataagctagacaaaaggatgcttctggatgtgagagattgcattgtgttcctcagaatgggatacaatttaaagcttatgaattatctcgggaattttccatttcgtacttttggactgtggttgaccttgggtacctgaaatcatggaaagcaaaatggcgtctgcccagtttcaaagggaagagacttatgagttcaactctcagagacaggagtgttgaagtcacaatgtgcgaagataatattgcaactatttttgggcaatatcatctgcctcagggaccctctccattgccactcctgtacccatcttgctctcttgagctgtgctctgggagcgctgtggtatgagcacagctttcattcccgggcacccttctatacagtggctctctcttctctccttacccagtaagctggactggacagtccttaacaaaatgtgaagtcttctgcttaggcactaaatggccaaccctggccctctgtttatttttcattatcttccttctttattgttagaggccttcccaagcagtgggcaaacaccaaccccagctgttctcctctcattttttaatttgtggagcaattgagagagaggagagagaaagagcaaaaacaaaaaggaggaagaattttctaaccccttactggtcttactgaaaagacttgtcttaccttttccacctaaggatgtcatctccagaagacagaattcttcggtttggccaactgccaggtttttctcaccatctttccatttctaggttgattctcctttgctctgtctcttgctgtccctggccaactgggtttctcttcccaaggtgattagaaggaaaggggaaaagcatggggccaacaccatgacctttgagagagaactttcctaacagttgctaagctcaacattctaccaaatactgttcgccctggttttcataggaaaatccctctcctttgccacaatctcatctttacctcaacatgggctctgaaactaggtgcatagtgagcattgacttgctttcttttccctcctttcttttgtgaagtcatactttcaactggaaaagattgaaatgccagctgtgtaagagtttaggtgaagcatgctgagttctgcaacttatttactatgaaatggattaaaaaatgctgatggatggatagaccgatgaatgaagggctagatattcaaaaaagctagtagcataaagtgttcattgtagaatctagctggtaagtatatgggtatactacccatatatatcacatagtatatacttacgctgtataaatatacataatattaatttttttcaactttgtaaaagaaaaagttagagaagagaagcattaaccataaattatagtagtgggatacatttgaaaacaaaatgttcatttcctacttaacaaatgcttaaggcttgtcttggttttcaggtgaactttttaaaaggttgtattagcattgttaattgttctaccttcagtttaccttcaaggtttaagggacctggaaaagatgtaacagtcgagtctagaaaaatagtctaaaattctagccgttgcccttagattttgtagtttctttgagcttgtcacatattgcttgtgagtatgctattgaagtcattgtattacggttgtttttctgtgtcatttcctgagggcctttgtggtggcaatagtaagaacttattccaaagataggatttcttgtttcctcacctgttccacacactcccatgttaaattgggcattctgaatcttttccagaactgaaatatggattttttcccctgcattgggcatgtttgctttgttttatctgcttctataagagagagggaacaatataaatccagttcagctccctggattattttttgatatatcaataaaatgtttaaagttattggaaattgttgcatttgaaaagttcttaactattttacttttctgaaatgaaaagaagagcaggcatcttgtctttgctgtcctcaggtgggaaagggcagcttgctgaggactgaagactaaaataaaccctcccaggagaggaaccggccggtgaccttggctgcaaccaccttgcagatcagctgcttcattcctttccatattttgtggcctgtggggggaatcaagtgtcacaaaagcaggaagagagcagtttgaggaagactccagaggcactgctggtaaaagtgctgacgtgatctcctgaccctttccgtatggctggaggactggtggttttatagtgaccattcaggtagctgggaggaggcaatcctcctgtgaaaaataagctgtaagaaactgttgcaacagttgtgtttttttatactcctcatgtaataataaagcggtctagaatttggatagatgccgttacatttttgcattggaggtatgttaaagagcccatactgagctaatagaaaaatagaagttaactcactcttctgagcaagtagaagtttattgaaaaactgaatgattttggtgatttttaaatttgtcacctggctggatacatcacagtgtggtgggaagaatgtgagctctgaaacctgggacctgggttgtcccatctgtaaaatgagcacagtattacctttttcattggttttggaagtattgacagggagatggtgaatctataggacttttcttattgcagatactgagaatcttcgtccccattttccttcctttcctatagatgctgatattataaaacaagattttcatgaggctcagaactaatttctaatgaattcacttattcctcctcttctgtgggcttctgctctttcttctgtacaagtagaaaggaattaagagtctgcaaggcaccgatgttgaggagctcactgtatcacattattctcattttgggacccttttcctacctaatagtgctctgtccctgggactttacacagtgacatttctgtggattctaatcattttaccttcccattagcaacagcaagtgttctgatttctttccatcctcaccaacactaattttttgttttttttgtttgttttttttaaattagagctttcttagtaggtatgaaatggtacctccttgtggttttgctttatattccctaatgactgatgctattgttcaccttttcacttgcttgctgatcatttatacctcttctctgccctttgcccattttttaagtgggttgtctgcttttttgatgttgttgaattcattgtaagactttttttttttatatgtactgggcacttgatccttttcagatatatgacttgaagatattttctcccattctgtagactgtcttttcattttcttgataacatcttttgatacacaaaagtttttaatttgacagtcaaatgtatctattttttctttttttcccacttttcttgtcatatgttagatcccttcatattttgttgttatatttaagaatccaagtttatgaagaattaccctaagatttacaccctgtgttttcttctatcagttttatgatttttagcccttatatttaagtcatagagccatcctgaatatgatgtgaggtaggggtctaatttcattaattcgcatgtagatatccagttgccccagcaccatttattgaagaaactattctttccaagattgaatcatcttggcacccttgtcaggagtctattggctgtagatttgtgggtttatttcttgattctaaattccattgcattgttctgtatgcctatacttatgtcactgacacactgtttttattactgtgtcttttgtagtaagttttgaattcaggaaatgtgagtcctctagctttgttctttcccattattattttggctacttggggggctcctcttgaaggaagagttttattttataaataaaaatgtaatacttttattattgttttgtcctgcagtgatttttcaactatggtattatagctcaggagaaagcaactccagtaaataatcatgtgattgcatatggggttattataggcatgctacaatccaagggcttcttttgcttaaagttttacattctagaagccctggaaaccttgatgagaactacatcagtggtattcaaagcaaagccagcgcacagactgctaagttaaagctgcttgttagaattccaaggggccatattccagcagccttttggaaaagagcaaatgtatgagcttctcatttgcagtgataactagacactgtcctgatttatgcatatgtttgcctgtactagttattgccttcaattatagaagcaattttgaaaacaactttctcttatgtaaaagaaagctgtgatacaggcatcaaaatcaggaaaaaaatcagaattgtgatgagagagagtaaggaagaaggcaggtgattttcctgggataagtcacatttgtttccagtatgtttgacctctagaccattcctttttgagtagaggagactatgtaggattttccttttggaaagaacttttgtctgtggatccttagcaactactctttaagcacttccagatggtctttaaagtcctcatctaatggaagctgagagattgttcctgggggttagggggtggatagaaaagggctttaactactggataccttgacaatgggaagctataagaaggagacacatgtatttttcagctgaccctcatcaaaatacaattagaagtaggtacatatgtgtgtttatgtgtatatgtgtgtttatgtgtatatgtattagacactgctgagcctagagcactgagtgaaacacttcagtaactataatgggagaacttcttggattagacaaactaaaggaggaagaaagaaatgggctagggcagaaggcccagggccatcttcatgggtagagaaggttgacttctgggcccatgcagaacctcctaaagctgagatggagagaatgctgagaagcagattcctaagaggcagctgatatcaacaggcctgactcgggccagccagaactcaccactaggtccttggtcttcatggtttggcaggagcttttggcatcgctgtgaggataacattctcatctggtgcaaacaacaaaataaaacaaaccccatgctcttagagagtgcctaagacattgtgagagtttaataaatgatagctattatttttgtttaatatacaaaaagagtggttcttaaaggtcatcccataaagcagccttttttaaggatctccagaggaagtgtggactacagtctcctgtctgattcatccactgtgagagtttatttccctacgggcgtggaaggactagcaacactaaaatctcattaaacgggtacagaatgaagctgctttcagtggatgtgtgctttcagatctatcacaagtgtgagtagttgtcattttttagccactaaaattgattcagaaattctgcaaacaaaggaaggattttaggatgcagtgcagccagaagaaggccacatgtctcctgcttgtgctcagtgcctttcatggaggttattgtgcagtatggaaggtcagtaaccaaagtgcatgctgcagggagaaataccaaactgtcaacagggattccctttcaaggttccattggagttggaagttttacctctttattttatgttttctcaagatgtggtgaacttattttttttttatttggtaccttttaatacatctaaaaacagtttttacaacaaatctgggttctttgtgtttaaaacttttttccttcaaattttaagttcaggggcatatgtgcaggatgtgcaggtctgttacataggtaaacatgtgccatggtggtttgctgcacaagtcatcccatcacctagatattaagcccagcatccacgagctatccttcctgatgctctccctccccctacttcctgccctctaacattttttttgaaggttaaaaaggaattatcagagtgattatcagggaaaaaagctgggaaatgtattacactttttttttccactggtaatgaaaatgaactaggactgataacaaaataccatagactggatggcctaaacccacagttctggaggccagaagtccaagatcaaggtgttggcaggtatagtttcttctgtggcctttctccttggcttgcagatggctgctttctttctttgtcctcacatggtgtttgctgtgtacactcacattcctgatgcctctttttgtgtccaaatttccttttcttataaaaacaccaatcacactggatttgggcccaccccaacagccttattctaacttaataacctctttaaagatacagccaaatacaaatacaatcatgttctgaggtacttgggggttaaggcttcaacatatgaaatttgagggcagtgggggataaaattttgtccataataagcagtataggggtaaaggagaacataggtaaagcaggaactaagaaccagaaaagtgggtcaaagttcagggccatgaagttaagaaaaagttttaggaggggaatctgtagactgaaaatggcaaagaaaggatttccctgactgaccagtgtctcagttggctttcacaaaataacaaactaccctcaaaatttagtggcttaaaacagtagcccctcatttaactcacaattcactgggtcagcaatttgggctggccttgattgggaagttcttttggtctccattgggctctcttatgggtctctgttcaactgccaagtatgctgagggctgggtggtgtagggtggtcttagctggcatggctcatttcttctccatgtgtctcttgctttcctgcagagtagtttgggcttgttcacatgacagcagcaaagtacccagagtacgagagcaaaaccatgccataatttctgccacaattctattggccaaggcaagtcacaggccagcccagagattcaagaggtgaggaaatagacctttttaggtgatggctttaggagacaaggattatttgactgtcaaagtcccatggcctattatattttatattaataacagactttgcttatattcatgtatcagagaataataacctggaaaggaattacaagcgtatttatttatgggtggtacttctgtattcccaaatttggagacatagtttaatcagagcatttcttaacaacgttggttggcttttattttcctgtgttgctttgtcatccagaacactgggagagatcctaggagaactctgggtgatagtttccattttcagaagtctgggtgatagttcccttttcttcccatatcttactttgaatgaagcctccatggatgaggtagcccaggggaaacctccagctattatcttgtggggttaggtcgtatgaagctcttacaggagaactgggtctttagggtgttgtgtaggggggtaacttaggaaaattcagccataacaccttatacaggagattatgctgcatataaaccctcttggagagagctgccaccttcttgctgtattcactagtccttggtatccacatggggctctgttaagggagcccccccatctaattagttcaggtgttatataaaacatgatgtatatagcagtgctccttagcctcgttgtgggatagtgcaccgaatttctatggagatggggaagaacatattagcattttatagggcagagagaggaaacttgtgtgtagagtctgaaaatttcagtattaaagttttatatttggaaagcaatcataaaattttcagtacatttacataaaaaacatcttggcagattcttatatagttaaacatatactaaccatatgactccagcaattttacttctaggttttgtttcccaagagaatgaaaacttacatccacacaaagactcgtaaacgtatgttcatagcagctttagtcataatagcaaaaactggaaacaaccaattatccgccaacaggtgatggataaaaaagttatgatgtgtgcatgccatggagtactgcttagcaataaaaaagcaataggtcattgatacaaacaacaagttggatgaacctaaaaaacattctgctgggtgaaagaggcacctcacaaaataataaatgctgggtcatttaatttatagaatgttctagaaaaggcagatctaatccatagtgatagaaagcagatcagtggttgcttacatctggcatgtgtgtattgaaggagggtgatgacaaaagagtccaaagaaacttttgggttgatggacaggcctctaatatcttgattgtgatgccagttagcatagatacattttattgcatatagcacataccttaataagtttggcaatttgggaggaattgcctatgtttcttgtaatgcaaggcatcattaccctagaacaatataaaatctttatgatcatcaaaagggaacatgggtttgattaaagattaaagctttgatctacctttagtttagggattattcatttgtctctaaattgtctattgttgaaaacagtgggcaggaataaacaagaaaaccattcagagtctcatcatattatatacctggctcctgtgactaagccaatatcttctaaattaaaaccaaattttaggaattcttcaacagaagtatggaaacttcacttatttagttgaattatggtagctacagctgggtaaagtttgtaggtaattttcaacatttgatgcagtgcaaaggactaaagatcaggtttatggtttatagatcatatgtttatgtcaatcaaatattatttctttgatgaaaactgagtggtacaagtgggtaaatttttgtgtatgctatgtgagttctggaagagacaaaagtaaataagaacaggagaaaaatagtcccttagaattatcaaaatcctattttggctgttcagtctccgatagtttaaaagataaagctgagagaaaaaatatgattgtaatatgtttatttgggttgaatgcttgatgtaacttaggaagagaaacttctttgcttttagcatcaaagagtttattagttcccagatgtcattcattccccagagtgctagagacagtgatttatattgtcaaaggctgacaatgccaaaatggaagcagattttgttttacttcttaagccaaatcatagtctagttgaaattactcaaatgtatctcattttagtttcattttgataatccaaaaatgagtttcagatttcatcttctaaatgttttaatgttaaatgataatgataatgacctaaaaaaattttatgtttccgtcctcattagtgtttgctaaatagtcacttttttgtaattttttttctgtcatttgttcattcatttagcaaatatttattgagtgtctaccatgcaccaagcactgttctaagcacttggaagagagcaatgtacaaagacacatccctgatctcataaaggaacattttctaatagagggaaatagataataaaaagaagtaaacacgtgaaagaacaggataatttcatgtagtgataaacattaagaaaataaaaggaagtggtatggtagaggctatggtaggataggtgattcatttggatttatggtcaaagaagattgtactatgaaggtaatgtttgagcttagatccaaatgatgagaaagagccaggaatgtgaactaagagtaccactttctagatggaggcaaaagcaagtaagtttgcttgtaaataaggttgcaagtaagtttgagaagaacttatgtttaactaacagtggccagtggggagcaagtggtagattaagtcagaggggtagacagcagttagatgcatgatcacctttagaccttcgtaggaaggagtttttaaaattgttgatgtttcttgtttgttgtttgtttgttttaaatggaatgggaatttatcgataggcatgctctgatttctattttagaaaatcactgctgcagtggaaaatgaattgggagtgtacagttggggataaactggaagcagaaaagccagttaggtagctattggattaacacaagagtaaaggcttatacctaagtgctggaggtggtgacgtagagaaaataagcaagtttgggaactattttcaaggcacttcagcagcagatgagttggatacagatggtaaggtgaataaaaaaaggcactgaggatgactcccagggtgccagattgaacaataggtaggaaatttactgagatggaaaagactagaggaaaaatatggataaaaaatcaaatgttctgctttaaactttaaagctttgtatgcttattgagtgtttgagtgtaaatggcaagtaagcagttggatatatgagtctggagcagtcagatccatgagagctggggatgcagaagtgattaatggaaatagagacagcctctaaagctttggggccatctgtgatcacctaggaagagaaaatacatagaggtgggtcactcaaacatgtagaggttaagcaaaccaaaaaagatcaggattgtggacaagtggtgggtgaggtcaggaaaaacttggagattgtagaatcactgtcactaagaaagagaatgtttcaaataagagagagtagttcattgggtcaaatgctgtcaagatgattgatggagtcagaaaagtgatggttgaatttcaaaacctggagatcattgaggaccttgacgagaggaaagaagaattgtaattcgactggcctgaggaaaaaggaaggtaaggaactgaaattttcataggttgacacttgtaagatgttggattgggggtaattttatcattgagaaagggcataggaaaaagaggctggttctttgaggttactatatgatataatcattttagagagtggaaatgtaaatacccaaagaagggttactggacaatgcttgagtgttcatttgagatttgtcctcatgcatttaaagtaaagaccagtttgtttggccatcagttttctccagccaaactccattactgcagttgcttagtagagaatgaagtgtaaccatgtttggggaattaacaaagcaagtattctggaaagagaatgaggcaagggagtgaagagtggttgtaagatgtgatggacaatggaatataggatgggtaagaaggaaagggacacctaaggactgtgatggataatgaaagtgtggtagggtcagtggagtgtaggcctcagattggtcattgatggacttggagttctaatagagaagaggacaatcattgggcagggaaggggtgcttgcatctgattttgaaaggaagtacagttgctggtgatgatgatgtcaagcaaatgcacatagacatggctgactgaagttgaatggacaaatacacaattggaagttaaaaagtcaagggtgttgacctcacctgtgctcctgttaggccataaatgttaaaatgtattgatccatagtattatagaaaaatgtataatagtgtctgtttcctttgactgtagttgatgtaaactgactctttttctgtagtggacaacaaactatacatattgtagcctcaggcattcagaaagactggtctctttccaaatcccgctttcaaaaatctcagagaagacaatgactcgctcagcattgattgtgaggcctctgcaggagcagtcagctctgactggcagaattctcagatgtagaagtgggttgttgggcagataatcctgtaaatgccccttgcagacaccagctggtttacatcaggaagtgagtaagaaatgcttgggcaagacacacttcatgaaccaactcttattgaagagggatgaatgtaatttaagctccacagtcattgtttttggcatcttcacgagtggtctggattttgttattaacttacctttccggtttagctcagcaggaaacttagcaggctgtgattgtctttatctattccaggccagatatctttgttgcctagatgccttggcttgtctgtgatttgtttgtttataagagttgtgcaaatcataaggggatagcttattggatattcagaaagtgaatgagcccaggtaacctgataaagaaacaggacattcccaatatgcgggatcccccttcagggctttccatggtcaccatcccttccctaagcgtaatctctttcttgactttttataccttagattaattttgtctcttgatgtcttgatgtttgtacaggaaaatctgcttatggtaagcaggtactctggcacagataaaaccaagaatgtttaagtgacctataggttagtgcttcctccaaggcctgaaatccttgctgttctccacccctccaaccctgccaaccgccgccttccagaacaaggaagaataaccttatagcataaagaactactttaccttcaaagtctgctggtaattatgtaatgatataaattgataggacacaagatcttttcaggcttttccttttgtgtgcgtgtgtttttttgcaaatacgactctctggaacattcatatcaagagtcctgcagagaagagcctacttagactgagcctaattgcacaaggcagtgtctaatctttcgtgtgtgtgtctgtagtggagacctctctcctgataatggtaacagatgctgatttttaagtgctgtctgtccttctgcaacagatcagtgctgggagatgtcagacaccaaggcagagctttcctggactcattttggattgatgggagaggcacttatttcagacaagcggtagcattctacgtgagtttctatggaaactaacaatgtcagatgagatcaacagctgaatgctatttaatccaaaggcagcttaggttatgtgattttggataaaagttgtcctgtaagaaacaaaggaaaagatcatttctttcatgggaacagacaactgaaatatgatttatttacccagccacatacagattactcttgttatgtgttgaacacataggacatcatgacacctatgtgataggttttattctaataacttatctaaatgataccttcatgatactgtgtcacagaaatacagattgtggaataatgtgacattctcccacaggtcttaagagagaatgaatgaaaaaaaagacggcttttctgtattatactttatttttcctcacttttctttactgttttatttattgtggtataattcacatgtgggaaaatgtacaaatcctaggtcaagacttttcatatgtaggatacccatatcaccacttctcagatcaggatgtgtgtgtgtgcatacgtatgtttaaacgactatatgcttgtcacacacatccacatcccccaacccacacccccatatatcctaatctttattagctgcagcatgagataaccaaagtgaagttattggaggaaaggtgggtgatgaagattagattaaagcagcaatggccctgaatgaaacgctaaggagtttggactttttctagtaggagcttgctcctcaaggtattgtccaaggaccagcagcatcactgaggagcttgttagagatgccagatcttgggctccacctgatctactgcctccgactctctgggatgaggctcagccatctgtgttttcacaaacttgccagggatttctgtgcacactcaagtttgagaagcatgacagtagaccacagatcctgagaacataaaccagtagtgctaccaaagtttgcacaagaaaagaggaattttaagtggtgttaatagatactttgcacagaagtgaaatgctgaactaaacacagttagacacttttctttaccatgacattctcagaacccagagtatcctgatatagattgtgaatcccctaaagggagttatagtggaatctttttttttctttcttagtattttttataagaaccaagggaggaattaatattgcttggaactttggagacacatcatggtgggcagtgacaaggcagagaaagcttttcattaggagaggaatggagtagcatgatgaaagcagtgctctgcgaataatcacgtagaggcatgcaggtttagaagactggcctggttagggatagggactgcgaaagaaggaaatgattaacttggacaccactggggaggctctggagttttccagagcagctggaaagagagttctgagcagctggattagaatggtgattctgagaagtatggaggtatggctgttgtaggaagaactaggtgcctatggatatagtgccagcatatactgttttaacattgaactctgaaggagttctgttgtcacttcaatacaagcaaacatctcatggcccatgaacatggtttcggaaagaaatagtcctttgccaacagcctgaggttactgcctggtcagtgggtgcaggctgctgcacaggtgtgcactgtggaggaggaagtggagttgacccccccccgagggacaccttatccatatgtgggtgtcatccttcagcacagcaggaacactggtgaacagcatagcctttgatttccaaatccagtcttatcatttgagtcctttctgatatcacgctgtcaccaggcaaggccacctttctgggtggctgctgtgttgactgattttgatactgcaatacctgtgtctgtgattttccagagcataaaaggaaagtgggcattgttaacagttcctcatgactgaggcttttagtacaattttccatgctgtaaataaatgatgttactcaaagacaattaggttatatttgagaaactttctgatttgtatcaaaaagtaccctcctgtgcctctggatagccaattgggctggacctatgttgaataattattcagtttggaaagtataacattttagattttttaataagagtaatgtatgcacatgtaatgagatagatcaattcctgcatctccacttaattttttggaggcgatcactatagccgtttctgtttttaattcttatggtggtcattgctgtaatctaagttaaatcttcagtcttccagtactcagttgatcagttttaatattagctattgacttacttaatgaataaagatttatataaactacaatcttgattttttgatacttaccttactatttatagttctttctgtggcccgtgttagtttaaatagcatttttctgtatcttattcctctaacatttgaaggtctgtcttgactccttaccctgtaagatggtggtatttgctccactatcctctcttgaactttcttccttccactcccacttcttaacagtcctcttttacgttgtcaagtatccaagcattttctttgtcttattttttcatatcttacatcatgatagctttcccatgtcagtatagattgcattataaactggatttcaatggatatatcctgtaggggagaaaaagcagtatcttttccacacccatctcacagttcatggctgacccctataacaaagacagattagcaagagaaaaacgtaacaaatttatttaaccaaacctttctgtgatacaggagtctttggaaatgaatgcccaagtatccagggaaaactgtatttttgtggacagttgtgctcaagtatgattgaaggatggaagggtacgctatcatcgtatgtattagtcagggttctctagagggacagaactaacaggacagatgtatatataaaggggagtttattaaagagtattgactcacacagtcacaagatgaagtcccacagtaggccatctgcaagctgaggagcaaggaagccagtctgagtctcaaaacctcaaaagtagggaagctgacagtgcagtcttcagtctgtggccaaaggcctcagagcccccggcaaaccacagtgtcagtccaagagtccaaaagctgaagaacttggagtccagtgttcaagggcaggaagcatctagcacaggagaaagatgaaggctggaagactcgcaagtctgctcttccatcttctcttgcctgctttattctagctgcgctggcagctgattagatggtgcctgcccagattgagggtgggtctgcctctcccagtccactgactcaaatgttaatctcgtttggcaaaaccctcacagacacactgaggtacaatactttgcatccttcaatccagtcaagttgacactcagtattaaccatcacatagtaataaactggggtgaactcagcaaggcctatttgttcagattcttcttggtgtctgtacagaggagtagccctctggaatgagggtcttatgacctactttcaggggaggtaggccgaagaattttttttatgaccatgcttcaagggagagaaatgagagaggattagagagtgacctccaggtgccatattttggggtagtgtgttctgagcccaataatgatacctagtgttaagtaggtctcataatttttgtaactatattatttctctctgctcaccttctgcccagttttccctttcattctctctgtaaccatcgtatattgtaaataactttacaacttcagccttctagcctgtgaattttcctaactattattgtgttattgtgttctgtgctgtgtctgagcttgattttttcctgctattccctgcgccagctccaagccatgcccacttcagttccctctgggcatattctggtctgtagcattccctgccttggtctctgattgcacatttgtccttgcttttttgtctttatcttctattcttgtttgttcttgaccctttctcttctctttggttatctgtcagttctctttgttattccctttcatttgattggggggttgggaggatgagagggaaaggagagagggggagatgagtaacaaacacagaagttcagtccaacaaccctggccacttaggtaaaccgttgtctgctctgatggatcatggtacacaccagaactttgttactgcatttcctggtggtagcagagatctcaattgtttgatttgcagaaatcctatctaatacattgaatcagtcatatttcttcttcaattctctgtctccaatggtttagaaggaaagataagacctatggaaggaatatttaggctcagttttctttgaaatgtatgcaaaactggaagtaaatgaaaaattaatttgtggtgggtttaggtttattgcttaactacaaaggaaatgcttacttgaatgaaggcttctctgatttctttgttaccagtaatgattttatggctggggtaaatactgttacctttctcccctttctctatttatcttgcccatttacacacctcccttgtacttcctgctgtcagagaagctgaaatcagcaaatctgtctgtagatcattttcttttattcctctgatggcaaaatggtaacaacagaggcatgcatgcatacacacacacacacacacacacacacacactcactcactccaaaccacacaagagaaaccaatgaaccaaaagcagaatgggaaacaaaattggcaaagcataaaagaaaaggaaatgaaagaaatgtgataattgttgaccaacactgaatataattttccaagtcaggatacttgtgtgatgaatcaccagatgcattcaagattatgtctagagtagcaatggaaataggaggctttaagccaagggtataacctgcaggagccaaaataaggagagctccttccctagagagcaggtcatgggaaggcaggcaggagccttgacaaagtcagtagaatcagagaatggagctgaagcatgaccagaatgtcagcataatcaactctccagaaccttggtttatgacaataaacatttatttttggtcacaaattaatgggtcagctaggctttttttgctggtttggattaggctcatttgggcttactcatgcatctgtggtcagctagtgggtcagttgggggctggccaattttggatcacctctgttgggacaactcagctctgttccatgtggcctctcagcctctatcaggttagcctgggcttgtttgaggcatctgaacaaggttccaagagaaggagcagaagcatgcaaggccttgggaagtctacatttggaactgcaggtgcaggtgctgttttctcattctgttggccaaaacaagtcccaaggtgaaccgtagagtcagaatgggaagagatgtcaaagttacaggacaaaggccaagcatacagggaggttattaaatggaggcatcaaagcagtctgccgcaagctgggcagttattgagtcagattcatgggtatggtagactccccagtgctcgcagagtggaggaagttcagagaataaaacagaaagagtcattatgaagagatcagctttaaagaaggggatttgggatagaaaacctcacaggctccttcctaataacaaggggcaagttccttcagggcaaatgaaaacaaagggatggctcctttgtcccttgacaagcttgcctcagggtgataattcatgtgagcaataaaggggaccatttcatctgggggaatctaaccaatataagcaatggctggaccttcttaaatttaggcattttctgatttactaatagggttgagataaggggccctgaatgtccaatggacacagatgagactctcatgcccttctcttggcttaggctgtttagctggggattttacaggattggaggtgcctctttcttgtgctttaccctaaatcagggaattagagtagtggttttcaaagtgtggaccctggatgagcagtatccatgtcacctgacaacttgttagaaatgcagattctcaggctcaccccagacccatggaatcagaaactgtaggagtgggatctaggcatctgcgagttaacagccctccccaggtgatgttgatgcgtgctcaatttggaggcagctgaattagggttctgtgtggtattgatgggttcaaagcccatcaaagaagtggaatggatagatggatttagcaaataaaaaatacaggacatccagctatatttgaatttcagatcatcaacaagtaaattttttagtgtaagtatgttccatgtaatatttgggatgtacttttaatactaaaacattatttgttgttgatctgagaaccaaacataacccaatgttctgtattttacctggcagccttggaaagaggtatagaaaaactgcagaaagttcaaagaacatcaagattgttaatagaatagaaattctagagagaaaggttaaagaaattaacttgatgaacccagagagtacagcactggtgggattaataggttggaggattttatttaaagggaatgctgctgagctgttcttcatgaatgcccaaattaatcgagaagaaatttattttagaaaaaggcaagacttcctgccaataaatgacttcagtgggggttctgaatgattctgtgattctcaaaggaggtcagatccatttgggatttcatgggattgcatccagccaatactccaatttgtgtttgtgaaagagcagtttagagaggcatttgccaacaggaggttggagcaggtgatttctcaaggctcttgatgacttctctgtttgaagctgcaattttttgcatccttcttttttgaaaagcgcatagccttttgattatttttcaaatccgaatgtatctggaagtttggttttttaaaacgtggatataaaggggaggcagcaaagcagaggtgttaataggatgctttaaaaccagaccgcatggattcaaatcccagctgtgccacttcctagcctcctgcaacctttggttagtttgtgcctcaaatttctcatctgtaaaatgggaattattgtgaactactcattattatctcataggtaactgtgaggtttaattgagcttattcatgtaaaatataagaattgtgcctagaacatggttagccttcatgaaaagttattttatattattaaggactagagtctctttgtatatcctggacattcagaggttgttatggccagaagccattggtgaatggtcagtcctatgacatgtatggtagaagcattgtcccttgtgagcagtaatgtcctgtccctctccctgatccctaatcttgaggtgttggttaagcttagagtgatgttattctgtggtcgtattgctgcatcctaatcatgaatcatttctctttctctactcagatgaactttcccacattttctagaaacccccaagataattgggtttcatttcccattgcatgttgaattcaattaaaaagctgtaagagaataccatataatgtggctgagaatataatgacatttccaaaatattttttaaggaacttgaactctaaatcaatttagttctgctagtaaggacagagatttagtcatggaaaaatattaatctgatgactagtttttatcaaaattaaggatcaattatgactagttactttcagaaacttagttttggagatgaaaacaagtgatttgttttctgaactcctgcagggaacaaaaaaaaggtaatattggccccatacaatacataatttctgtctacgtgtgattgaagtgtcaaatgataaatcccaatcccctgttagaaacaacagtttagtcagtctgttcaggactttactgtatgtacttgatgatcagttaagtaaagagtgtttaggtggactttttttgttgttttgctgaaaagtttaagtttgttctttaaatgaagttcccttttgaatttgcaataaatagtaggcacccaattttgcagtgcttgaattctgatagtaaatagtgatggttgttatttttcttttattaaagaaaatgcagtataatgcctacatcatggcttaaaatattaagtatttagtcttcttcttgagtctgtgaacgctgggcagttctgagcaagtggaccaggcttgactgatctcagctatgctcatgtgtatgtctgtcagctgacatgttggctggtggctgtctgggcaagagcagccttctccttcacacctctgggagttggccagttgtaggttgaggatgggacaactgtgccatgtgccgcttatcatccagaaggctagcccagcctgttcatatggtggaggcaggagttcaggagttcaagagagacagagaaagagactggaagtaggcaaagtctcttgagagctaaactgggaattggcaccaagtcacttctgctgcattctgttggccaaaggaagtcccaaggtcagtccagaattttggggagtgaggaaatagattccacttcttgatgggaagaaccacagtatcacaagacaaaggtgtttgggggtaggccaaaaaagggctcacaaaatccatgtcaaatccctggaatctgtgaatgttaccttctatggcaaaagatgtgattaagttaaggattttgaggggaagagtttatcctggataaacagataggccctgccctaaatttagtcacatgcatctctacaaaagagaggcagaagaagtctgagtgagacccacaaagaggagagggtgatattaagatggaggcagagataggactgaagcaacctcaagccaaggaatgcttccaccagcagaagttggaagaggcaagaaatggagtctccccctagaacctctgtagggagtatggccatgccagcaccttggttttgtacttttggtctacagaaccaagaggcaataaatatctggtgggttttttttttttccagcctcccgagtagctgggactccaggcacatgccacatgtcctgctaatttttgtatttttagtaaagacagggtttcactatattggccaggctggtctcgaactcatgacctcgtgatccatccgcctcagcctcccaaagtgctaggattacaggtgtgagccacagcacacggccaatatctgctgtttttaagctgtctagttggtggtaatttgttaaagcagcccgagaaaactgatacaggtgtggatacagggagggataaagaattgaagacatttttgcaacaatctacatataccataaacttagataattttatatagctctttttcacttaatatgacaaaacatttattcatgttattacagtactgttaaacactattttgaataattgtataatacatactatatactgagttgatctagctgaacattttattgttattgacaattccttccatttttctgatgaagccctgtgcataaaaaaacataatctctatgctctgaatcaccattcagtttctcccttaccactatacataccttcaatggcaaaaaccacaattacttttgcaccaacctaatagttctgggaattgttataaccgccctgtgaatggtctcactctccctccagcagatgtacaaacccagctataccagatttgttttctgatgaaaaacacagttcaagttagctaaaaactttcaaagtttgctttcaaatattagttctttaatccaacacttaatactcctgtggtaatgttgtctaagtacaattgtcatatagcactttttttttttggtaaggctttggcatcttgaggacagcactgcttttttcaactttgtgtatcctaacatcgtctgccttggtgttttggaggtatgggtcactctgctatctgctgcatgatgagtgaataaaggagttaaaaaagggaaacatacttataattgtcttctcttgtcatatatgatcccagttattcaatatgactggatttgaactcgactgggtaaattgccttgttttagttgcttaggggagtcttaatattttcataccattgacccatttggcatctggagaagccttctcagaatagtgtttattaatacctagaacaaaacatataggattaccaaagaaatcagttgtattgcacaatagttcaaagtattatgaattgcaatatagtaactgtgtgcatctttatattaatacataaaataatatatagcattaggcctcttagttactattatttcaaagtagtgatgacagtacccagcatattaagatacttcaacatcataatgtgatattaagatatctgtgttttttattggtggcagaatcacagatctttttagtactactgtagtttgttgccaatgcccataattgaagaaaactctgcattttaatgagaggtagtataaatgaaattgtaactttgttttcattttagttcatgaattacctgaattctgtagaccgcaggttgagcacctgaaaagcttttttagaaatagctctagcctctgttttccccagttgtcatcacataagtttgattaaatattttgagtagtttatgaagttatgggtaggcaagacatttctgaacacttgcatgtataacatagcacctaagatattgtagacattatgtaaactctttttgaataaaaatacaaccctcttcaagtgcagatggaaaataaaaactcactcacttggacacatttctgttactaaccttcctgggtagttgttttgttaagtttagttgtttagttgaatcctttccctgttggtactaaattgataagttgcttgcatatagtgtagtctatgaataattctctttgatttttatttgttgagtttgttcccacttccaaaggggcttgaggtagattgggttctgaaacaaagtgcagaatagagcaattatgtaaacatagatttcctggaggtcctgaggaggcaggtgctccaggcacctggtgatctgatttccactcttgggcattgcactctggtctgatttctgtaggtggagataaaatgggaaacatttaatgcagcctccatttcctctcaatagaaattatacaaaaatattttttatttcttaaaaaacatttttctttcaaatttaaatagcctgtaatacctttcttcattttacaaagccccgacttacagcagcataatatttattaatagagttaagcagaatcaatgcatgtgtcctgtcacactgagaactgtagtattgtggacaatgtttctaatgtattgtgatcggttagctctcatgagaataagatgaatgtttatattacatatatattatatatctccatctatacccattactatatctgtgtatatatatgtatatatacgtatatacacataacatcgaaagtatgtgtatgtgtgtttatccatgtactgtgattaatactcatgtacaatgatgttcacttgaacgccagcatttttttatgtggttgatctttgcatttttctgtcttcaggccatctaaatcctctgactttgaggttttttgatttggttgaaactaataccaaaattggaaatcttttattacaccaggttaactcaaagagtttcttaatatgggataaagggatagtttgtaagattaggaataaatgtgataatcacttgaagttcctggagcatacatagtgttttgattattaattttggcatcgcttaaacatgttagaaataaaaagggccagcagccttttgtgtcagattaacttagtaaaaattacataaagagtttgcattatttatttctgttttctgtttcattgagtggaaaatttaaatctgacctactgactcttttaacacactgagaactatgtatttatttctaatttattgagtgtcagaaatatgtcttcaaattccctaaggctcaacttcaaggcaggttcctttatgaggttttctctcatcccctgcattaatttcctattgttgctctagaaaatcctcacaaatttagtgacttaaaacaacacaagtttattttcttataattctggaagtcagaagtccaaaatcactgggctaaaatcaagggctaaaatcaaggggctggcagagctgctttcctttctgggggctcctgagggggaccctttccttccatttccagcttctagcagttgcctgctttccttggcgtgtagctcccttctatcttcaaaaccatcaagtctttcttacaatgtcatctctctgtttcttactcttactcttcctttccccctgtttaaggacttttgtacctttgtgattccattgagtccacgtggataatctgggataatctctttattttaaggtcagttgattcagttgattagcattttaatgccagcttttttttttaattttattattattatactttaagttttagggtacatgtgcacaacacgcaggtttgttacgtatgtatacatgtgccatgttggtgtgctgcacccatttttgagacaaggtatctctctgtcgcctaggctggtgtgtagtggcacaatcacaggtcactgtggcctctaactcctgggctcaagggatcttcccacctcagcctcccaagtagctgggacatcaggtgtgtgccaccatgcccaactaatttttatttttttaaattttctgtagagacagggccttgctatgttgcccaggctggtctcgagctcctggcttcaagcgtcagtctcccaaagtgttgagattacaggcatgagccaccatgcctggcctcttaatgccatttttcatcttaattctcctttgtgatataacctaacatagtcacaggctctgggcattaggaaatggctgtctttagggaggtatcattctgcctatcacatcccctaaaccagaaatgatctatgtgtctttcataaggtgttagggaaacactatctcaacgtgctattattcacgtgcatgctttatctctcctttataatttaacctatgggaaagacaggaccctgtctatattatatttatgttctcctcagtatatagcaacactgaaagaaccaggtaaatattttttgagcaaatgaatgattctgtatccaaggaatgcattagttataagggagagaggtcagctatagaaagagagaaaaagaaaaaaggcagaaattgacagactattatcagcactactcataagagaatagtgtcttcatatgcaccattgcctctaagcagcaaataatttaacttgttaaagttatgatccacttaagagttatcctattctgtctcactataaatcagtattttggcacaaaaaaatccttcagccttgtgttggcttactaagaataagttccttgaagccttgcaagctctgggcatcctacctttatgaaagtgacggacacactctgtgatggatgccctgtgcagagagacctattgggtagccagcctgcacctgtcaggtggtacccacaaaccttccttaaactctgtgagctttacagcattaaaacacttctaaacacatgcagcttttctatgaagcactcttaagaacaaaggacagtgaatgaattcccctaagatgttcagaaagccaagatttcccccaagtattaccttaagactgcatatgagttatatattttactcccatgatgcatttgtatagttctaaatacataaaaattgtttgtttgttacacatccaggaagtgtccttttgagatgtgtgagcacatattcttaccatagttctgtaacgtaggcaggcattatttgcctgtcttgcaggtgagggattcaactcacagaatggaagtggcatgcccatcatcacatatctggtatgtgatgtgtgcaacacagtgagtaatgaatctagattacttcacctcaaactccatgcttattacacatttagtacctcacaaactacatctcatgtggcatcatgatttgtaggccatcaggtgttctgttaacttatgaactgaataatgcagcattttctaaaatgtgttccatgtcacattactccagtaatattctctgtgaagagttttgtaatcaacaatactttcagaattaaagagtgtgttagtatagtagtgactatgcatgtccaacagagaaatgtgttttaactttgtttttaccccagtgtcttccaaactgatatagccacagaacccttgctttctgccctcttgctattatctgttgggcaagggacaaatttctaggtcctggatccccagttgctcagtcatgattatgcatccagccatggtgtgcaaattgagctgttgttaatgggcaaaggttggctttgccacctggttttgttaggagagctttcaacagcaagaactagaatacctaagtcattttgtttgagcccttgctaatgaaagtgtggtcctcatatcggctgcatagatgtcacctgggagcttattagaaatttaggatttcagtccccatccttgattttgtgaaagggaatctgcatttgaacaaaatctccaggtaattcatatgtagtgtaacatttaaaaagcactgattttaaccataagaacaattattttttatctaacaagaaatactgaggtgaagcgttctattttattggcaactcggtagtggcatcaaggacctggatgcttgtctcctcatggtggtaaaatggctgccaaagctccatacgttatctcttcccccagctgcatttaatttcaggatggaaagaggcagaggcaaaggactttgttcttatgtggctccctttttttactaacttcttgctcagaaggtcacttgcagccttccccttagttcttacccattagatggattactggcaataataaatgactggcaataataaagacctcaattccctttgatcttgaccaatgttgtttaaaaaatacataatgctagccacatacataatttaacatttcctaatggccatattttttgagaaagcaaaaagaaaacaggttaattttaattatatattttattaaccaatatattcatactattatcatttccacatgtacccaatatataaaaattgtcagcgagatattttataatctgtttcttcaaagtctttgaaattaagtctgtattttatgcctatagcacgtctcaattcagatactaaatgttcatcagatattcttgatctgtatttagatctcataaaagtcacaattaaaagtgttcataaacctaagttgttccatgtaataattaaccagtaaccaaatcagtagcagattttaaatgtaaatgcaaattaataaaaattaaaataaattgaaaactgggtccatcacatttcacatgttcggtagccacatgtggctagtagctatcatatgagacactgcaagtataggtcctcactactcaaagtgtggtccaaggaccagcaatgtcagcatcatctgcgagcttgttagaactgctaaatcttgggtcctatgctagagctacgaaatcaaaatttacattttattttaatgcatattaaagtttgagaaattctagtctaagctgttctcaatcttggctctaatttagatttaatgtgggaactttagaaaatactgttgcctgcaccctatcccagaaccttggaatcagactttctgtagtggggtacaggcattcatttttttaattgaagctttctaggttattctaggatgcagctgtgatggtaaattttatatgtcaacttgactgggctaagggatatcagatagctagtaaaatattctgcatatgtcaatgaggatgtttcaggaagaaattagtaaagaagattgccctcatcaatggagctgggcttcatcatccagtctggggaagggctgaatagaacagaaaagcagaggaagggtgtgaatttgctctctctgcttgagctgagacatccatttcctcctgtctttggatcctgaagctcctggttctcaggcctttgcacttagattggtacctacacaaccttggcttccctcgtttttaggccttctggtttagacaggagtgacaccactggctttcatgggcctccacttacagacagaagattgtgggacttctcagcctccgtgatcatgtgagccaatcagtctcttgtaatacatctgtctgtgtctctctgcatatcctttcattctgtttctctggaaagccctggtaaatgcagctgctaagtttgagaaccactagcctagactaatcctgatccatcatctccaatcagacacactgtagcctaagcagtactatggtagaagctctcgggtgagtaaccaactgtgacttccccactgggttttgcttccctctggcctgtgcacatttccagcagagcaagggatccgactagaatcagctatacttgctggagttgcacattcttggtctttgtccattcactcactggctaactccttcctctccttgcctgtcagcagtttcctcattcttcaccttcctcgttctccaggtagcaaacaaggtagggctcctgctctgtgctgatacctactcagacccaatctggaaggccatcagtgactgccagtttctttcagctcctcatccccactcttgccccagtgaaaatgggtttcccttccctgttgccctgttcccgtctctttttccacttctagatggcatcttgcacacttccagtctttgtttccttcaggtgctcataattctgcagtcattttgcttattatgttttgcctctttgttgatgataagctcaaatgaggtatgcataaagtctgttcatagaaagcagctctgaatctgtgaggccaaacttagatgtgatttaatgaccatatttgggtacactggaagctgcccatgttcacttcccaggtttcctgaagatttagaaggtgcacatacctcaaaacataggcttgcaaatttacgtgcctctattgccagctggatctgctgggtttctctttggagaagggaattttagcaggacacacatgaaaaaataagtgctcctctgttaggaatcttcaactgagaaggtgccatcagtgcaaacaaagccatgttagagcaaaagtatgtttggtctgcccagctctaatagatgatgttcatgtcccttgggctcaagaacaaaggaactgcctgacagtcttttgaaatctcacctgtttcttggtagagaagcttctgtgcagtatacatttccatgataagtaactgctgtcaaatctaataagaagactaatctaaaatttaggctgtataaaagttaggctgtgtaataaataaaataaccggattatattaaaaaataactgtttttatttgaagactgagcacttggagaaatataggagttagccaacaaaatcaattcttcagcttacatttgaaaatgaagttcctgttttaagtgtataaatcctatgataaaaatgtctcagcctagaaaatgcaatttttgaaatgtaaagttttgatgtaggattaaaaatgttattgtcttggccgggcgtggtggctcatgcctgtaaccccagcacttcgggaggccaaggcaggtggaccacttgaggcccctaggagttcgagaccagcctgggcaacatggtgaaactctgtctctactaaaaatacaaaagttagccaggcttggtgttgcatgcctgtaatcccagcttcttcggaggctgagacacaggaatctcttgaatctgggagttggaggttgcagtgagctgagatcgtgccactgtactccagtctgggcaacggagcaaaactctgtctcaaaaaataaaaataaaaaaaattgtcttatcacatttacataattattctctaatatttatattgcaataaaaatgaatctggtaaaattcccttgaaatgtggggatgtttattgcaaatggtccaatggcttttcggagaagctccttgagaaatatccatatgattcaaattatgtgcagaacagcaaagtagtaaaagtatactatcaactttctagtattagaattaagaaatgtcaagaagaaccacctcaaattttggaaggccagagaaattttgattcttctgcaatcactctagtcagtaaaagagataaaccaaataataataataaatacacatatctagtaaaatatatatttatacctgctcatatagtgaagtatatctaatttatccaatactatagataagacatggatgtgttgtaccttgccctgttaatggtgcgctcaccaataatctcatcatcctctatggccctaggcagagttcctaatacttttgtttcatttgacagatttgaaaacactcagagaaaagcagtatatacccaaagtcataagaattgtaagattcaaagtcattcttcttgttagcttctgttcttttcactgcagtatgctgcctctttattccttgaggccctcagccaataggattttgtaggcgtgctgggcttttagacattaaagaactagccattgagttgaacattccatggtggattaaaccagcctaattaacttgtctctcctctctactacaggtcttcagtcttttttttttctttattctggaagcagtaaaactttgaacttagtttttttttttttttgtaagtttagcataaatttaatggcaaaatcatgcccaaaccaacagatggtaatatataatctttatttatcccacttagagtgaatagccatagatttcactccataaatacctatgtatttgataaggatccacaaacattttctgtaaatggccagatagtgattattttaggccttgtggaccataccatctctgttgcagctactcaactctgcattcgtagcatgaaagcagacatagatagtacataaatgaagttgtggctgagtgcaaataagtctttatttgcaaaaataggtggcaggctggacttggcccattgaccatagtttgtcaactgcctagactaaaaggtgatactcagatctgttgggactattgcataacatatatatatatatacacacaccatattacctttctgaattctgaaatatttcagacttgaagagtgtttagtaagggatcaagagtgtgtacctaagatttaaaggaagttttataaaggagaaagtcatctctattatggtcaagcattaaagttctcgtatacatatgtctggaggggcaactaaggttcagatattgctagtgcgttaatcaggaatgagttttgtgaacagcaaagcattggaacacatagcttctttgttgtcccttgtaacaagatcagaggtaggcagtccagagctggttcaagagctaagtgattccctcagggatccagactctgtccatgtttattctccagcatccttagttgatgagccttcaccctgatgctcattgtctcatggttgcgagatacatcctgtacctccagtgtcaaatgcacactcccagcaaggagaaaaaaagaaagcagggagaattgtctctcttagagaagtagaaacttacccctgcaaatctcgacattcctcttgtcggctaaacaaggttacaaggctactcctaattgtaaggaagactcaggaagcaagtatttttagttggattcattttcatcaccctgtaaaaacaggagaaaggatgttgggtgggcaagttgcacaccatctgctgaggcatctgttcttgtttggtggctgttatatttcgttacagatacttaacatcatattgtcttctcccttgaggaacatatctttttaagtatccccagtgttagcagcttgttttccatctgagttggaaaattaaataacattattcacatttttatgtaaatgttgtataatgtgcatatataattacttgagaatggttttcttcagaaatacattttcctattttcctgaggattttagttttggaggactttgtttacatgtgactctagtatgctgagtagcaaggcttgagggaagagtgaagttgacataaatggaaggcaacttgcacattgaggtttgtgggcaagtgattgttctcatggaggatgattccatctaagagcaagattttatgaactcagagaatcttaagaagaaacagttactcagtaactttcttaaaatatagatctgatacaggtatgagagaagagcaattaaataggcacacagagatcattttagttcttaacttgaatatcttgggatacttcctttcctcctagaggtagtatttattctgtttctggaaacagggcatgtaacttgctctttctttggtgtagactaccataataagaaaggatggaggtaactgcatgattttaattgtgtctttttgctttagtagaatgtcctaaaatgacacaagtgagaatagtgtgaaaataaatacattcatttattggttaagctttaaatgtgagtgaaattttcttcaactaattataatactaaattaattctagaatctgtttcaatgtagccatataattatgtagaactataaccctttattgcccagataaatcttgaccctgaaataatgtacgatagaccctcatctgctataattctgaaaactgcagtaagaaagccaaattttaatccaaatgtttcatggttctttgggcttccaagatgacaggctcatcaaaaactattcctgacttggccagaaatggaaagatcttcattttgatgggtacaaatgaagaagccacatagatacatatttggaccaagattccttccttttggcttcgagatctttcactaacaggactgaacgaaccagaatcaacagtattgggaaaagtagataactaaaatataaattttaacatgaacaaatttaccaactgattcagaagaaacagaaatcagagaagagatggaactttaaaataaatttaaattttatcagggagttgtggacagactcctatgaaaaggaggacttcaagagcaagaagggattcttggaaattaagtctgattgttgacttttaaaaacagcatattagctgaaagaaaagatgcagaacttttctagaaaacagaacaaagaaccaagagttggaaaaaaaaattaatgaaagtggagacattagagaatcattccacgtggtcctacatcttctaatagaggggaaaaaaagtggaggaaataaagatgcgcacacacacagatgttttaatttagcattggatcatcatctcccctgggcagcatgtcttttaaagtatctctagtgttagcagcttgttttccatctgagttggaaaattaaataacattattcacatttttatgtaaatgttagataatatgcatgtataatcacttgataagtgataagaaaaagaatttgagtggaccagtaactaaacacattttcacgatatttcagaatagcaaggaaaaggagaggatgttaaaagagtccagaaatgggagtggggtggaaagttgaccacaaagataatttctaggccgggcatggtgactcatgcctataatcccagcacttcgtgaggccgaggtgggtggatcatgaagtcaggagttcaagaccatcctggccaacatggtgaaaccccgtctctactaaaaataccaaaattagccgggtgtggtggcgtgtgcctgtagtctcagctactcaggatgctgaggcaggagaatcgcttgaactcgggaggcggaggttgcagtgagccaagatcccgccaatgcactccagcctgggtgacagagctagacttcctctcaaaaaaaaaaaaaaaaaaaaaagataatttctagaggactagaggacaagggaatgacttcatggtttggaggtaaaattattctgaacctgcaattttgttctcagacatactgcacatttaccaggaaggtgaaataaacacattttcagacaagtaagatctacattatttgatcaccccagatcattcctaaaagaattaatgcagtgtaagctcaataaaacaaaagaaggaaatatgggtttcgagaccaggtggaaaaactagaccaaggaatgcaataaaaaaaatctaagacaatagttatttggcaaatcttttaaagcagaacaaaaagttggcaaaattacaataggatttttggggaactcagaaatcctaaaagcaaatgacatttccctaacaggaagtgtgatgaaatggaatggtctgagtgagtggatgtagtttatactgtttaagagggctccttcttctcagtttttctttgttaatgttttttgagcagcacaactttagtgataatattgcatggctttctctctgcatttatacttaccacttgtttctgcagagaacaattatgtaattttcatattgtaaatgttattcatccaattttaaaaacgtgtaaaaaatagatagtacagaacatgatatcaccttgacaaagtaaaagtaataattaatggagaaaggttgggaagtagaaaggggaaaagaaatgaagagaaatacagggactctaatctgttattttacagagagaggatttaagagaaactcagtttggtgaattaagaaagagaggtttaaatacaaggctgtaaaagtcaattaaaaaacgaaatattgaaataaaactggcagagatggagagaaggagggaatggcatactgtggagttaaatgataatttctcagtaaacaaatcaagaaatagaggtttgagcatattatctaaagatacactcttcaacccagcatcccaaccatgtgtggttattgagccactgaaaggcagctagtccaaattgagataggctctaagtataaaatatatacccaacttttcaagacttagtatgaaaaaaaagaatgtagaatacttcaataatttttatattgattacatgaattgataatattttggatgtatttggttaaataacatttaatttattaatattaattttaccatttaaaattgttcttaatattactactagaaaatgtaaaatcacaaatgtgacttacactatacttttactgagcagtccctgatctagagatttggaggtacatttgaagaatggaaattagaaatgatttatgtgttcataccatcccagaagtggaccagggtgcaatgggaaaggaagagcctttatattatattttatatgttttagaaaattttcatactaaacactgagcagtttcaaagggctatttgtaaagtatatgaaaagcatgaggaatactatgacaacaaacacccttagtcaccacccagtttaagaaaaaataaataaaataccatagactttgaatgcatttcctccttctacttcaggctagtgtactgttttgattttcattttcttaataaacatagttattctctttttgtaaaaagtttctaattgaaggatatcttgtgtagttttttggcaggggttgttgaataatttgtcagtattaaattttagaatgtgtgtgccatttgatggcacagtggttccctttgagaaatgtattctgtatgttttgaaaaatgcagactgcaaaaaaatgtatagagtgacatcatgttaatttttaaaagcatgtatgtttatataattgtatagttatagatctacatatacatgtatatgctgacattgatgtatacatttacttgatatatatgtgtgtatatatgagcttatgcatatataataactaggactagtgcttgtgtctcagaagtcttattggattggcagaggagggaacttcatattcttgttttataaattttcagagagagagatgatcatagaattatgattttatttacttagatttgttcattttctgtatttttcaagtaaaaatcccttaaagaaataaaatacatgttgaaatatgttctagccccggagactatcttagaacagaacacattgccttagaaggtaagaagcaatatgtttacaaatgaaaaagaggctaagttgcatgaaagtattaaagccattatttttcttctctcccaccctaagtatattagtccaagaggcaagtgttcgcactttcaaagcaatactaaaattgattctttatcccatcctttcagtctaagacacttttaaagaaaccaccagtcttcctccagtgtgcttcattttctaacacagtgtaagaagcatgtgagcagatcacattaatgtaatgatgtgtgcttccagcaggacaatcaaagcaaaggggatgcatgaatctctctttttttttttaatttgctgagtgtagaccatgtataatttttgttaatgtttacttcttctctaatcatatatgtgcgtgtgcattgaaaagattttaggaaattcaaattccaaacaagaaattaaatacttacagtaattctgccatccagatataaacactaataatattttgttgtatttatttctagaatgtctagacatatacatataaccatttttaaaacttaggaaatatgctgtgcatatgattgtttttctcatagaatattgtgagtgctgtttcatggcattgaatgttcttcataagcatagttttaatgactgaattagatcattttagagaaatcaattaaaaatattctaagagtttaaattgggaatgaatatatctttgtggtgaggactgaacatacttcttcttttacttgactttgagtatgtaattgatttcataagtaaaaagataatgaaatgtttaccttgtcataatcaatagtgatttcctaagctgttaatgttaggtgaatggaagtcttcccctgtggatatggaagacatatccaaggacacattgttaatgagaacagactggctgtgcacttcgatactctccaataagtgaaaaaacagaaacttcattaatgaaaaatgacatggagctatatacccttgcattttaagacaaagatgaatctatattctgtccttgtctcaaggaggcagaaggttgcagattccttttggctgtgttgtttacctttaactaatgactcatttggcataaaccagcattatcaaggtgaattccacctgatccaagtctaatacatgtcatacaagacaggataaggtgatcattctggaaagtgggaatttggaattgtgtcttctatcgtcagttgaatgaatgggataggctgagctggaggaggaatgattcttttgggatatggggacccaagaacgagtgccatctgagaaccattaactttttttaaaaagtggaagatcagagacattcacaaggactataataagaaagagtatgatagctcaacatgagagaatagatgaggtagtcaggtgagtaggtgagtgagcgagtgagtgagtgagtgagagagagagagagaagagggcggaatttataaagagcatagctcccacctcctggatgccttctgcaggccagccacttgtctcccatgggttgggaagggagttacctgcaaaaggaagagcatggaggatgaggcaggatttcttttcacttggcatgtaaggatgatgagactggaggagtaggaaggaaggaagtagcttgaggtaaacagagttttaataatagaggagtttgaagagttgacactgtctggcattccatgaggaaacgaagactccttgtaaatgacttgcagaaggttacatggtttttcacaggaagctccaggaagctgcctggtactgttggatatggacatgaactatttattcctctaagatcctgacatctgagacaaagccaggatgttttatacaactctggactagatgtgttctctgatgaaaagtgaaactgcatcctctttgcattggaatttgcaggcactctctcaagctgctttaagtgagaaaaaggggaacgtattgaaagaacacaaggctgtgtccaggaatctcagagtaagcaggggaggatctaaaaatatgaactggaaagctttaaagaatccaggcagtgattgattttcagcggctctcttatctctgctcttccagtgctgtttttctctgcccttgtttctctgtatacatgaggttgggtgactgtcctagatatttacatgcctatttcaggcagctcttaactagcatccctgaagttcaatcccaaactctcaagagaggaagaagctgatcggctcatgtgctcagctttgagcacatgtccctccttggtccagtcagcactggccaggggcaagatcccagcacaaatatgggtgccatggatagcgttgtggataggggtctgataatacttgtcaaggaagaaaattgtgggctggagttctctaaaattgaccactacctaaaattgaccactaccctatgatatcttagcaggtctgggacaggggacatgatctttcaccatcactgtcttttcttttctaccaacaagaatatctagtcccttgctattgaaagtatggcccatggaccagcagctttagcatcagctgggagcttgttagaaatgcagactctcaggcccttccctaggcctattgtgttagagtcgcgtggtaacaagataccctgataattgtagagcactgacttttgagaaatgctaattagatggaggagagaattaggaaccaacacagaccagggctactgagatggcttcttccacaggtacctgtctccttttatctggcagctaatttgttttggccaagcttcagctaagagctatcccctgccctcactgagctcttatttaaggtgtttctgctagaaacttgagttcaggatgagctggagagagctgcctgtgttcaagagaaagatagtttttgtgtccatcttattgtgtattggtaccaaaggggtgatcagtgggatgaaaaaaggaaagagaaaagcagtaaaggtgttaaaatcatgtccaaaaggcaagtatcagcaagttcatttttaattagttattaccttgaggttacttatattcaatcattatactacacctgttttcacttctgcctctgaaagttttttaacgtctttaaaaaggcatcttttcataaagcttaagctctttgtgggctaaataacaagttttgatttaggagaaattactagataattctgtattaagtctatttagaatacagactccctcaagaaactcaccaggtagaacatctgtggcagcaattcagaaatccatgccattaatatttcggactttgaagtctaaaaagataaatttctgacactctaccttgcaggaactctgttttccttcattttctcttttatactccctaaaaggccctgggaactaatgtgtgtcctacaacctgccattattgttaaatcaatctgcttatttgcaggaacgctttaattatttagtaacctgattggaaaatccatataaattattttcttataaaaatccttactttgtaatagaagtgatcagatggaaataacaagaatttctaattctgtgggcaatcaggtggcctctctcaatggggcccttctgacatgaattcagaactttcatcagtgtttatgttgttggagtagaaatgtatagtttcactggatcatgttggaattgttgaagccaattgctgtaatgcacttgattttttgtgactaaatttctgtatttatcaaaacagtttcattttgtctggaaatgtaatgtccttttcttgaataggcatgtggaagtatttggaaatctttgaagtactgtttctcaacctgagctgcatattggaatcacctggggagctttgacaactactgattcctaggacccatctccagagagtccagagtaattgctctgggtgcagcctggactgtgggatttttaatcccttccctcccctgagattctaatgtgcaaccagtgtcaagagacatcatcctgtcgaccgtttaccaaacaggtgtggatgtgggcagacaggcttgtcaaaatgcgttttcccagatgccatcccaagacaacaaattcattagttttggggcaactccaagaatctgactatttaagcaagtccaagccccattgtgattttgatagaggaggcccttgcaccacatttagaaaccctttcttggagattatttctaaaaagagaatgactgggaccaaaatctgttcagtgttgtagtattagggaccatcagtgagtgattgaggtgtacttgaaaagatgacgaggctggggactgggcgtggtggctcatgtctgcaattccagcactttgggagctcaaggcagatggatcacttgaggtcaggagttcgagaccagcctggccaacgtggcaaaaccccatctctactaaaaatacaaaaattagctgggcatgttgccacacgcctgtaatccctgctactcgggaggctgaggcatgagaatcacttgaaccccggaggtaaaggttgcagtgagccgagactgtgacactgcactccagcctgggcaaaagaacgagactctgtctcaaaaaacagacaaaaaacaaaacaaaaacaagcaaccgatgaccagcagttatgtggtataggggcaagactcctggggtcacaacaaaataatagagttctgattctcacagtgttttcgttaccagttctgtggccctgggtatgacacttaatctttctggtgctgtttcccttcaactccaaaaagagggcttggagaatattaatctcaggtcctctgaagctgccatacttgattattctctgatggtaaaaatcttccattagcataaattcttacagaaacttctagcagtgctgttgatggatgccctgcctcagtgggtcaaaaagcatagtgcctgggcaagcggcagcatggtcatcttgttagaaatgcagattctcaggccccaccacagatttactgaagaagcatcttgggaatgggtcccagctgttttaaccagcccttcaagagatttcgatgcatgctcaaatttgaggagcacgcctctaaaaatagtacttggaaaaaagaaagttgataagtattctttttacctgtggtgaagagaaatcatttgctaaacatataaacatttaagactatttagaaagaaatgttggcaagcagcttcaagtggaaaggtaactgttaagagaaatactgaaatctacagccttgctatacaatgtgtggtctcctgatgggtcaacattgctatctctggagaactgcagaatctctgtctctgccccagatctactgaatgagaatctgcttttttttgttgttgtttgtttgtttgtctgtttttgcttgtatgtttgtttgtttaacaagctcgcttggtaattcatttgcagttaaagtctgagaagcactgttctagataaagatgttaagaccataatgtcagctttctcttacttttgtaatgtgtacctatcagtaaacattactgtgaggtgtcccacctcacacgtctgaaatcaaatccagtaaaaaatttttggccctgtaagttggatccacacctatatcaatttaatagttagtatctgttattttcattgtgttttacctgtttggggcttttaagcctttttaaaaaacattccttatggaaaaaaattgcttaatactgtcgctttctttttccttttcttcctcttttgaaagctgccatttcagtctgactccctatagtacttgaacatttttaaattatttttttctagtgtctgaccacttttctaaaatggaggctgggtagaatattgagggtttgttctgtgggtttgattttatcttgattcattgctacatttctatatttgtgtgggtctcaataaaattataaattagaagattaatgttaaaatgttacaaattataaattaagttaacattaaactgcaaaatgtatgggaaagaatccttaaggatctgcagaagaaccttctaaattaacagagaactagccttgtgcagcagtaccttaggatagagataggcaacctgagatttcacaaatagaacagagcaagtttatgataaaatgggtggaaatggagcacgacatactacgtgtatattcttatgtagcaacttttaaaaataactcttttaatcatttgttccctccaaaacttaggtactctctctagtcacagttcctaggtactgggaaatttattggcttcaaattatgagaagaaaacaacagtattaaagtgattttcattaaatatgtgccaaatatgacatttcttcaaccattttgtcaactaggacattatatcaacttgtaacttaaatcatctttatgacttatctataagctacatttgctgtgtgtgccttcactatgtttgctatgatttggggaatcaagaaaaattcctaaagctaggaatcttagaacactggccttacatggttaattacttcttttcttctgtggttattccatgtctatttttctgtttagaagtagaaattagtcaagctttttaaaataattattatttgtaataaaatatatcataaaagggcagtttttatttgatttttgaggttatttttctctctagaaaatcagttattgacctttttggggggttaaaactcatctgaaaatctcatgaaagctgaagaacctgtgcttagatacatgaaaatatgtagaaaaatatacattttgggctgaagattaaccttcagtgtcagtgctataatttgcatatttgtcccctcctgaatttaagttgaaacttaatctccaatgtggcaatcactttaagatgtgcttgattcatgatggccctgccctcatgatagatttatttgttcatggattaatggagtaatgggttagcatgggagtgggtctgtggcttcagaaaaagagtaggagacacctgaccatggtagcatgcctccctgaggtggcacagggcatcacatggcaaggaggctgagtgtgctaacatggttaggtgtctctttctgtcacttctatagagagtctccaccagcaagaaggccttcaccagatgcagctgcctgacttgggacttctccacctccataactgtaagacataaattccttttctttataaacccagtttcaggtattctattataagcaacagaaaagggactaaggcaatcaattaattcagtaaagacttttttgatgacaaaaacaaactagcaaaattaactagtatgttcaccacaggagttttaagtgagacaaaggtaactttttggttctcattgaacccatggctgggtctagggtcttgatcagtctgatcatacttggtttctttctgtttctctgccatgtcttctgctgtgtttggtttcatatttcagtcattgacagctccaggctgatatcccattattccaaacatagcagaataaagactctaatttcaaagtatctcaagtaaatctcagaactgagcttgtgaatcttgattgcttatatctgggtattttgtccattcctgaaccaagattattccatctccagctgtggtaggtcatagcccaagtcacaatctttcacttttagagtcagtttcacaggaacctcgggaactaacagcaggaaaaggaaggatttctagataaacatcagtgccctcttatccatacaagggggacgatgttaagggggaaagactatcaacatccactgcagaagcagaaatggtgttaagagacaaagactatcagcatccacaaccatgagcaaccactgttttagaggtaaagaaactatataattagcacaggccaactctttttttatttttataatgcccagactacatgcatgtcttaatcatttcttttatataaaatttctgtgcacctaatgagaaggtatttttagctacacatccatgacccttatcctcattgttgcatttctcctctgaaccttgtcatcacctaccttgcccaaaaggcactgcttgttttagccattgagcaaggtgggtaagcatattgaatttgctgtcatatcctccttaaaggtgcagcaatgcaggtcacatgggatcaaaaaaatgaggcttattcctaatactttaggctatacttgtgaagcctcatgggaagtttttctttaaacaagtctacagcacttattttaggcttaactaatctgattagttgttaacagaaaaggatatatttaaagtccacggatatgcaaacatttaatcagtgagtataggttttatgttctgtcttcatttatcagtgatgagagtgaccttggctatgacctcccacagctaaggatggaatgcttttggttcaggaatggagaagatgccaagacctgaccaattaggatgaacaagctcaattctgagattttatttgaagtacattggaagtggagtctttcttctgctagggttaatactactggcatattagcctggagctgtcagccataagagataatatgttcaactatgtcatcattccaacacagtgagcaaggactgagtgctactgaaaaatctggtaaacagaaggttgtttcactttggctatattttgctggatttaaattgaacgtttctgaaacttctgaataattctgtcatagaaagatccacgacagggaacattttataaataaactactcttatatcaacagagatcaaggcaaagaaaagaaaccactctaggtatttcacacaggaaagatttaatacatggggattgggtacttagaaaatggcctgaaatgctggtgaatgatgaggaatgttgtagccatcactggacttttgagttcaagagcacacccactgttgctatagctgctgtaatttcctctaaaacctgtatctgtcaaattgtgattgccaggggcagtagcagcaggaagatggccactgccctttaaatatttaagtgcttctaactggtgaaactcagatgcataggagtcttggaaatttaatgtttaacctcctggcctccctaaccaaggaagggtgggttggcaatatacagacaatccatagtacataatacagtattaaaaaaatgggttcccctgggattttattaatgaagttccttttgtattcaagagaaactacctgtctatgacagcttaaagtaatattaagcatcactaaatggtgaattaaagttttttctttttatttattttaaaaggtacaaacagtaaaattcatactttttgatatattagatttgacaaattcattgaatcatgttatcactgtcataataggatacagaacagtgtctttactccaaaaaattcttgtctgttgtttgtctgtattccagctctcttcccatctatacctcctggtaaccaaggatatattctccatcactactagctttgccttttccagaatgtcatggaaaggtaatcatacaatgtgtattgaatgtgacattagtagaatgcatttgagcctcatctatgttgttgcttgtataggtaatctatttctttttattgctgatcagtattccattgtgtgtatgtaccattcatgacttacattttgaaagaatcacatatttccttttattcaaactctccatatatttttaaaaaataacatggatattatgaaccctacttgcaacttcaaactcagtgttctttattgatgattaataaggttatatagtttaattatgattcctgggtaggatcaagaaaattagacaaatctcaagaaatttccagtctaatatatagatcaagtatgctacctagaatgtaccaagtgcccatttatgccacctcaatgagttttccaaaaaaaaacaaatattttttagatgaattatttgttgatttccatactatcatggaaagatcagtgaataccacccatattttcatttgaaaagatggactcatttttggccttattcacagacagcctttcttccagacaaatttcagcatattttgatgactcattgtagaaattggtttattatttgcagcaggagaaagcattgctagccaacagctgagaaaaagaaaaggttacaacattctgttttaggtctctaaaggccttattgggcagaatgtaatttccagctgtggattcatccagcctttgaggacttacccctgcctgttttctgaagtgttctatgattgttcattacctcaagttgtccattttacatcttatttgaaagcaggaccctgacagtgctaaactttctcaggctcagctgaactgtcagaggtaaagaaaccaagaagtttgcttgtatttattctaccccagacattctgcatattacattcattatctcacaactttatcaggtaggtagtagtgttaccaacatttaacagttaaggaagctgaagttgaaagaagttagttaccattcccaggatttacatagctcattcaagaatttttgaacccaggactctctggtaacaaagtttatgcttacaaccattttgcatttaagctttctgtcatttagaagacattgacgttgtcattactattttttatacatgaattatgtgcatctataattaagatgacaactgcttgtccagattacttatccctgtaaaaaaatgtttccgaacaatgtgaagtgtgagtaaataatacatcctgcataaaatgttttgtggatcaatgagatggcttattagaaacacttagcttcttccaagaagggtttccaaaatagcaaatgtagtagaattctttataacacttgtacctggagtcagaagtcacacgtaacatcagactaactatatcagttggggcttttagggttgtgctttttggattttagagggatgtgatttgacctttgattaagaaggcatcatggggctgggtgtgggggctcacacctataatctgagcactttggaaggctgaggagggaggattgttgagcccaggagttcaggacctcagcctgggcaacacagcaagatcctatgtctaccaaaaaaaaaaaattggctgggcgtggtggcatgcacctaatagtcccagctactcgggaggctgaggtaggaagatcacttgagcctgggaagtcaaggttacagtgaactatgaacatgccattgtactccagcctgggcaacagaataaaaccctgcccacgcacccccctcaaaaaaaaaaagagagaaagaaaatatcaaggtaccatggctaagaaggtataacaatttcttaatacagaactttgttgctgttgcaatgaggttcgctgtatcacttgaaaataatttgaagaaattaaatcagatcagggccttgtacctaaaacattacatgtgctttagtagtcataaaatatgttacgttaatgaggatgctgactggcaatcagaagtctaaaatggggcattactgacactttacatgctgtcatagttaataccatagctgcaggtctccaacctagactattgagggtctgggtctcaacccctatctcctctcctcccctcattcctcctccaccctgaattacatgcaagcctggacaatattgctttagcactttctaagtatattttatgttggcaagtcatatatttactcagttcttttgtgcaaagcaagtaagctaccagagctctccccttggggccattaatcaaattgtttttgagcttttctgctccccagggtggggacgtgtgacaaatttcttggtgagcatacccttaaaatgaaaagatgttcttgggtgatatcagacaaggtcagtttgttctttggtgtcatgaaaaggctctcccagtttgttcactgttactagtgaacttgacttaccttgtgagcttctggttacagggattttttttttttttttcatttcattttacctaccttggtacctagcagtgttggatatatagaaggtactttctatattttgtttttggaaaatactttaaagttacacaggagaaaatatatccatgtaattcagaggaggctggattcccttcaggaatgggggcattattggttttaatcctcagtatatacttattagaaaataaacaatgagttgaatgtttgacgtaggtcaagtagcatgcaggaaggataatcatagacctgcttttgcaaagcgtacaatcaagggtaaaagacttacaatgtgagaatagaatgatgtcactaccacttttatcattactcttgcctagtatgtatcgagcaacaatgaaacgtcagaacttcttctaagtcatttcaatattaacgcctttaattctcaaaacaacgctcttgaagtaagcactgtgattattcccattttacaaatgaggaaactgaaatacggagaggttaagtacttgctgaagatcacacagttataaaaggcatgcctgctatttgaatttttgcagtctgactccagagcccatacttgtatgtactggtcagatggaagaagcaggggatcccaaatgagcccctcacccaaagctgtgggttagagaagggtcccagagtcagtgacatctgtgctaagtcatggatgatgggtaggtatttgccaggtgaaggaggaggaagaggaaggtgttgagttatgttctgttcggatgataatacagactggttattatggttgcagtgtgtgtgtgtgtgtgtgtgtgtgtgtgtgtgtgtgtgtgtgtctgtttggagcagatgatacagatgctcgagccagagtatgtatgtctttgttaagccatgttattactaaatgtgggtttttatcttgtgtattgttgtgagccactgaagggctttaatcaggtaacatgataaaacttacatttttagaaaagttagttgggcttctgtgtagacaatgaaagaaagaacaggaggaagactgctggcaggatattaactaggaagctttgcagcagcccaggaaaggacggattaatacaaaactagagtcaggggaagacggggcagatgccagagagatccagggagtagaatccagcaggacttcgtaactgattggctggataggagagaagaattagacagaagagtcacatttagagtatttcaaagaaaaaaaaattgaattccacagttcttgctccaggccagtttttcattgttcttacagttcatttttctttagaaaggaaaaggcacattaaatgttaaagaaacagatgtacctgattttttatggactcctggtccatttgactttcctttctaatgctatagtttcttgagtttacactacttgtggtggcgaatactttcagtaaactttcttgtatgtcatctcttaaaaattgcaataccaatccctttaagttgccgtaaaaaagagagggcaatgcaggatgagagaaattatgcttgtcttcagtatcttaatgggcaccatactccttagatattaagactgaatctgacttttaccccccaaattatcagattctgaccctattttatttgcacatgtaaacacatgtttgggaacagcaaagttatttccatcagccttggacaatgcatttttataatggcaaattctattcttaaatatcccacatagggttaaagaggaaaatatcttctgtcctacgaaaaccatgccttgtgctttgcctctactctttgtttctgagcatcagaaactgtgtttctcttgagaatttccatctgctgataggttttctctatggttctagagagcagataaagatacaagtatcccttattatatgacagtcttgctttttctgtacagtacaggttttcaagtagtaaaattcctaccttgtttaaaatgtttaaaatctatactaattatttggcccctttcctctttgtcccttttcattttgtaattgtcattcaagtgtaagaaaaatataaccatgcttaagatacttgaaaaaatctttccaattcagaactctttgaatgtaatagagactctttagaattttaccatatagaaggaaatactgtttcaaccaccatatgaacaatgatttatgatatttcttattgtattagcccgttttcatgctgctgataaaaacatacccgagtctgggaagaaaaggaggtttaatttgacttacagttccacatggatggggaggtctcacaatcatggcggagggcacaaggcacttcttacatggaagcagcaagagagaatgaggaagcaaaagcataaacccctgataaacccatcagatctcgcaagacttattcagtatcacaagaatagcatgggaaagactgactcccatgattcagttacctcccactgggtccctcccacaacatgtgggaattctgggaaatacaattcaagttgagatttgggtggggacacagccaaaccatatcatttatgaaacagcattacctggtggggaggaaacaagtggcatattatcaaatgggacgctattattgcacaaggtcatgtggctgttaaatggtagagccagaactccagccttgttctgtgccattcctaggccctgctctttcttactttcataccacacatgtcattcctgcctctagctcacggccacagtctaattttttgatagggagcaattccagaaatgaagattcaaatcccaactaattctgttctactgaaaatatggcccatggaccagcagcattgagatcaccagggagctgttgatagctgcttgtttttggagtgcttattttgtccaagtgacgtgccaactccattacatgcattatctcatgaccttctcaaaagatgtgcaatgatacaatccttctttttccacagatgacaaaagtaaggataggaaacttattgaccatacttgtccagtgctgtacaaggaaaggttggaggtgaatttggacctagctgttctgatttcagagcttatacttttaaccatacactgcagtttaggatgcatgtggagctgtttcaggggagagcacagtagggagtgggaaggtgaggaggaaaggaaacggatggcaaatgtgtcacctaggtaggctagctgctgtaacaaagaggaccacaaacatgtaatggcttgaaaatatttatctttgctcatataacaatactgggcaggtgaaggggttgatgcaactgccacatgttttcgtttattcaggaatccaggctgatgagagctctgtcatttttagcacgtagctgccaaattcaccctggagtcaatgtagctagaaggacgaaatcaccaagaggaagggatgttcctgggaggatattttatgggccatgcccagatgcgatacagctacttccaatcacatttcatgggccaggactcaggtgtgggggcctgagaagaggagccagatgtgagtctcagacggggaggaatacctggattttactgagttttcaggaaatagtaggtcataagccgctattagaatcaagcctctgggtacatttttatatgttttattctttcaggctttgtgagagggggttatttatttcatttgcaaagcagtgaattgagatccagggatttgtccaaggtcacatggcttgttctgtgccattcctagtccctgctctttcttcccatcataccacacatgtcatttctgcctctagctcacagccacagtctagtcctttgataagaagcaattccagaaatgaagattcaaatcccagctattctgttctactcaaaatatggcccatggaccagcagcactgagatcaccagggagctacttagaaacctgcagtttcatacttgggaggctgaggtgggaggatcgcttgaacccagtttcaggctgcagtgagtgatgattgtaatcctgcactccagcctgggtgacagagcaagatcttgtctctaaaagaaaaagaaaaagaaatagaaatgtgcaatttttgtccctaccccataactgctgaatcagactggtcattttaatggggcccccaggtaatctggatgcacagtaaagtctgggaagccctggaccaggttcctggaagccagcttctccacctactgccgctatgtgactgtcatcttccttccgtgtgggagaagtggattcactgcatgttagctacagggtataaccactggagtaaaatttcagcctttttgaagagtaaacatgtttaacctagaaaggactacttagcaacataatattgaaagaccgctcagcccattttttgaaaagcatgagctgtttccatagataagccaaacaggcctgaacaaaacagaggaaaagcgaactttgctgttttgatttgtggatgatgatttgattttctaaaaagaacagctttgtttctttccctgagaacataagattactgagttcttagagcctcagctcatgcagctttcctgcttgggtatatgggtagggcaaagccagattaaagatgcacagtatcaagccatctgacctccaatgccagatttcctgcagtagtctaattaccagtttattagctgttaaccttgcaccacagttacaaaacggtaactgctggttagagtcttaatagttgataagtgtcagggagggtcttccttctggtgagaccagtatccttgtgagtctcatgatgataatttgctttagagctcagtcactggaagggaggagagaagggacataatgaccgagggtacccaagtactgtgacagaaggccatagacagctttcctatctaggaggaattcagcctgaagcccacagctcaaggggcacacagaccaggcactcctgttttgaaacaataaaatgaaactgttttttgcaagttttgttcacttgatcattttgccctgtgtctgtgatttcccttagaataaacaaattaggaacagtacctcggttttagtataagaccaagtgcagccacaacaacattgccttagaaggtaactttatgctatttgtattcaattaaatctcacaagccacccagagtgaatgttttcatgttgctttcttagagatatgaacacagagaacagaagcttgcttaagttcagagcaaacagaattccagttgcacggactctcccagttacagctgtgtgcttatcaatacttggtggatagggaagaggtggcttgtgaactgcaagactttaatacatgtcagtaaccttctactacaaattgaaatgctctgtaaatcaggaaagggtttgccatttttatgctagtgtatttcacgacagtccagttggaaaagagttagtattgatgttctattggcaaggtttccagaccagatttgatttataagaacagcactgcatataagagtgtacattgcttagatgggacatccaggaactgtgttaatctacattttcaggtacttctactcaagagaagcacagaaaatatctttacaaagttccaaaattaaattttagaaaaaggtttgaacaaaaatgtttgcttattaatttatccatggttactccagcgagctctctcatgacaactcatggcatgctttactagatgctgggccctatgcatgggtttcatctgatattaccctaaaaaggactcttcacatagatatcataaccttcagtttacagtttgagggagctgcattggatctcacaacgagcagatatgagcgctggacttccagggtcctcgaaagtagcaatcactgtgagtacatgatggcagccgacacatagaatggacgtggtccatacaggccatgactagggcaggttgtctcactcacacaaggcctgttcatttattcattcatttctcttcacttgtttaataagtacgcattgagaagttaccatgtgccaggagaacacaaaaatgaaagattcacaggtcctgccctcatggagttccccactgagtttttgtttgtttgtttgtttaaatacaagctttactgtatttcctttcttggatggttacatctaggtaagacagatacgttgtatgttggatggcctcaattaagcaagatgctaataactttatgaaactgtgggaaaaatttggagtatgttatttggttaaagaataggaacatttctaaggacagattacaaagttaaacctaaaattaaacagtttgcttgccaatgtattccttttgtgtattcctttatctgtgagttcattgaatgcttcctatgtgcaaggtattatgcagagtgtaaaagttgaattcagtttctcatgcagctgaaacttctttcagacttggacatgagcttgaaataattagagtgctagatagaaatgttcattgccttggagaggtatgtataaagtacttgggatttaaaggaagagagaattagagaaaacgtgaagggggggaaatgacatttgagccagacatcaaaggacagacaggattggaagatggggagataggtaggaatagaagattcattttagccagagagaacaatagggaaaatagaagagtgactagcaggaaattcagctcaaatttgagatatgaaagatattttataggtatcaataattgacttacttccaaagagttcatcatcattttaatcttccttgaagattattttttaaatccaagtaagatattttaaaaattagaccgtacataaaagttgaaaaaggaaaaaaatgctgaccttcactccagtgaaaccactggctaacgtttgagtattttccttcaagtcttttgcattttgtttctgtgcctctttttgagtagttgaaataatgtattgcattctgccttttcatttaaaataatactaccagcacctacccacgttatgaaaatctctttggaatcgtcacatttaatggccttatactgtttagccgtttggctttgtcatagttgactttaccccaccctattgctggagtttagggtgtttcatgttttccattgctatgaacagactagctgttggccagccaaccctttttgtatttcacaaatggtaaagccaaggcacttgtaataagccaagatggggactgacttgttcagttgctagaagccaaaagactgttgcataaaaagctgccttctgactagaagaggggctgtggggtttctaggaatagagattaataaggtgcttaggtcatatcccctgagaagtttaatctgagtgggccactgaccttctggcctctggaaaggagatccattgaatttctaagccctttggtactcctcccatttcctgcggaattttgattgtgggtaaagtttcaaaacactggctcttcacattggatttccaagttgggaagagaaggcaggaagacctatcaaaggacaaagatattgtgttctccacttcgatctgaaagatggaatggcaggggagaagggaagggaaaaaaaggaggtgggtgtctctgtcctaatttcactgggtttctcatcccattagttgaagttagcaaacaggaaagcattctccttaggaagaaaaatggcaagaaaactgatgcctgccttgcttggatttttagtgttgccaaacacctatgtttgtgacttattgattttgtactatgaacctagcctgctttgcatcagctcttcttgtctttggtcgcgtcttttctttgtgaaatttcactcggtgaggaaatactgaattggagggagatacggtccttactgagcatgctgaagtaaatccagctattaaatccagcataaatcccagcagaaagtagtgtatcagaaatgtggttctgtatgccgaacatgtgttcataataacagtgcctggaggcatatttgtattatagttcagcaaaggaaggagacaggaaggagactcttagcttagggcaaagaaacatctgctacaaaaaaaaaaaaaaagaggtataccacatttatgtaataaatactgttttgaaagtttctctgaaattagtttcccatattaaatcatgcttcaaactttcttaggaacttcactttttcaaagaatcgttctattaaatttttgagagagagcagaatttcttaacagttaagtatactaaccctgggatgaggctaccttattcaaatattggcttcaccatttagtatctttgtgactttggaaagtgatttaattgcttgagggcttaatttccctatctgcaaaacagacacaataataggaccatcacataaagtctctatacagattcaatgtgaaagaacattttagaatgcagtattagaagtagtttaatcactttaaaatgttgctattaataatctgttaattagcaagtgatattatgcatgtaaaataaaattttggaacaatatttttcttacaatgagccaggtctgtaggctaggcatattaaaatatttaaaataagtcatggtatattaggttaaaatgatggaatgaaaacactccaaatcagagtttcaaagtaattcaactgaactgtaaagcaaaataggtataacacaattctatgctaaaatgttttaatcttaggtttatcatataacattttattacctaaaactgctaaaacatgtaggttttatatttaaaatgatagtttgtatttagtttgaaatgtggagctgaatgattttgcaaaattaaattgggaatacgttatattttaggtaccctggaaaattgtctgtggttagatggctgatacctttccttcttatttagtttaattgaaaaaaaattggcattgaagaattaaacacactctaaaatttcaataaatattccatgactactttatttatctagatatcaacttactaataatatcagccatccaagttaaacaaaaagtaaaacatccagaagtgaaaaatacagccaaatgttgtacatggctagtatacagatcctgctataaaatgctattataaaatccagctgccctcactcagagcctactgattcttatatatcacataatctttcccttgttccttcctctgaagacagtaggagctataaacaggaacagtttgggagaaagcaaagcccggcatcaaaagagatatagaacaaaatgtagacacacaactttgttatcacagggcatgatgaccaaggcattcctttcctcattcagttattcacttcttcatcaaagattctctaatcatctgtgatagtaccagtctgtcttctaggtataggctttagaaaagtaggtaggagagattcagagaaaaataggatataaacatttctctgtcaggttgctcacaataaggttgacgtatttgtgttcacaataattcatgtcatccagaaaagtgatgttacagttttatgtacttcagagtcacagatggtttgctttaattttattatacccccatactcacaccctggactgctttgcaagtttctaattgcttcctctccctgcctttttattttggatttcctctcttcttccctgtatctccttaatactcttcaataatatcatttatataacacaatcacagtgcccacttactcactagagcctcacagagatctgtcatccgattcagcctattttagcaggtatataggttagcttttgttgtgtaacaaaccaccctcaaattttgcagaattttttaaatcatgttttatttctcacagttctctgtatttgttgagtggtttttctggccatggctggcttggctcaggttggataacctaggatggcctcactcactttatttggggcctcagccaggaggactggattgactgagacttctatgtggcctctcatcttccagtagattgtcttaaccttttaaacatgataatctcagggtttcaaagagaacaagaaggaaaccccaatgtacaagtacttttcatgcctctgatttgtttcaaagcaagtcacatgtctaaaacccattttcagtatccatgtggaacgaaagtcttcatatcttgatgggagaagctgtgtagtcatattacaaaggagtgtgatcaagggaggggaagactttctggtcatggaaatggtctaccatgcctggagaaggagtggtaaatatatccccccagaagggacacactttatcttcaggcagaaaccattggcctgaactagtcatatacatgctcctccttctacccctgcccccagctgaggctgcatgcaaaggaggatgacaaataaataaagccctctatgtattacatttgtctcacatgacaaagttctatttcacttattttcccttgacaaaatccattgaggcctttcagagttagccatattcaaagacaccatgaatttccaccttcaactcttaggtgtctgaaggctgatcttctaataggtggggtttgggggacggttttatgaagtactttaaagtttcagaagcaagatgctgtcttgctgctgatcatttatagtctcgaacattacatgttgcatttcacataagaattcttatcctttatggcctagctcagaagctttctccaggaggcctttctacccttttctctcctgggcaggggttatctctcctggttctaaattcctgtaaaatattattttgcttatgttgaatagtctacctactctgctggatttgagtttgttaggatagagtctgtgtcttatccactattgaattctgtgtagtatctagtctagcagggacacagtgaaataataaatcatcccttgataaagaaggaggaggctatatttaaccctaatgccctactttattccctttctattatattttttaatgttccatttaattgttttctatccctgagtcaccaacacttaaggccactgtcatgtatggattcctctgttaattccttcattgagaaaagtcagaagagggacacattcattcattctatacaggtctatattgagcacccactacgtggcccatatatttgtgtgacagagacacagcagaaaacaaaatatatgtagtcactactctggtagaggaaaacacaaacaagatatataaaggatcagagatgaagttgttgatgtgtgttacgtagaaaaatctaggaggtaacaagaaagagagatcctggtggtggtgagatgccattttgttctgagtggccaggaaaagcatcttagatatggtgacatttatactatgatctgcaggcagtgagccatgccgatatttagggaagaatggtctaaactgaggtaatggtaaatgcaaaggccctgaggcagaattgcaagtggcctctatgaggtacaggaggaagtccatgtggttagagtcaagtgagcatgggaaaggaataggagatgaatggagagagatataaggctagattatgtaaggtcttacagcgtgttgtatagattggcttgtatcccaagggagatgaggagccttatgaagaaagggtaaagaaccaaaggtatggagaattacatgggtttgaagaaagagttgggggagagggaaatgtatgatctttttcgtccctgtcctccaacattaagtggatttctcaccttggtcccccctgtgaaaaatctacttccaagattggctctgtgtttgctaatcatcagtatctatgacatgtatagaaataccttcttccacaggaaatagataaatagatcagagataaatagactatatagtgtttgctggtaattcttgccattttaccagatataatcgtttaaaaaaacatgtcccatatttatgtagtgctttattataatttaggttctcaaaaagattagtttttaaaccaggtctagagctctgcttaagttgtttcaacaaaacccaactcattatatgttataaatgaaaaagcagttatttaaattgcaatggccttgatgtcacaggactataaatgagaggatgcccaggggaggggagaacattcactttcagcatgataaaacatcctgcatgaagatatgttatttttacaaactcattttctgcaaagaaaaccatcaaaaaacaaggaactttctgtgtaagtgtgctaggaatgttttttttttttaaatttgttacaaaagtaacatattataataaatgtaaacaatttagaaatttttagcattttaaaaatgtaattatagtcagtttataatggcattattttaaccagggcaaaccagccttgttatgaacacatttgtttattttcaagataatttgattagagccaacttattggtttcatgtgactaatactgggctgtggtgtgcattgtttagtcaaagaaaaaattaaattatcatttttactttctgtggcctttagtaaataaaggctgatttactaaataaagcctgacttactaagttctttttagcatagtatagttctcctcatagtagaattcataggaaatcttggccctcttttatgataaattgatatgcttgggtacaagcctatttattactgcaatatagacctgctttctgaggttcttctttctcaggaaagtaaataaacattacagaggatatttgctactctgtgtgacccagtaaagagttctcctggagaaaactttgcaaataacatgatcaacaattgcatgctttggggccataaacaaaataagcaaaaaagttgttttagatcctagaaaagcttgatggagcattctactgtctggtaaacaagaccagagtaaatatggctccaggtagcaagtgaacagccagaccagggtcaaggccagcattcgcttgcaggggttagaatgctgtacagcagtgaaaatagtgtccatgtctattgtgaaatagaacaatgccataaatgcgtagacatcatcttttctatcttgggagcctcctgcaaagtgacattataggcatgtctgttttcagatggggaaactccttgaaatatagtttgtgggattctctttcagcttcacagtaattggttgaagcaggtcttaaaattggttcttttcacatggagtgcactttaccattaaaaggaatccatgtgtctcatgaaaatgtgagttatcttgtgtaagtatgtgtgttggtgggtatttgaaattagcctggagtttaggagttttaggggtttttccatctacttttaaattcttggacatagatgcctacaattaggtagtttatcaataatcaaataggctaaaatataatgaacacatttgggatatatctccacccataaaccttcatacttctttgtaaaagttttgctgaagaagtatgtgtttatcatatgaggaggtggttatgggtatagtggaagagacagatttaggtttggaaggtaataattagggaaggttctctggcttctggttttacttcaatgtttacatctatttcttcaggcctaaagccttttgtcccattgtcaagaatagttcaggaccagtgttttattccatgaggccaagagagaaaatgccagttgtgtggccaatcacttaagcttaagaatgtgacatagtactctgcagagaactaagaatgtatcttgaggtactacatctaggttcaaatataaccacaacatacagtgggattcacagttattttaagaccacgccagtgaggtcattctgagtcatgacctcatggatagaggattctaatcaactgctgaagtctacagagaactaatgaacgaaagagtcctgagatctggtaggggaattttgaagcgccatcagtatctttgtatagactttccatcccctaggatctgtatggtcaaataaccagaaaggcttccatggtcaccttcctggacacctggctgtgagccaaacaacttcttcaatctcttgccaggtctctagtctgtgagtcaaagaataccatatttatgagtgatgttttgagatagtgggtgctctgtgaatttcaggtagtgtttttttgtttgtttgttttttcctcaccagggagcatcataatttttcagcatgtttgttaacaatgtacattttattttaaaaaaaatcatgacaataaattcatacattgccaaataacaggtgtctgctatctgattctgtcagataaactttataccttttctggaatatatgagttagaaaacttcaggtatcagactcagctgcctcaagtactgacataccaggcatttctctgtttaatcatcactcaactcatggatgaaagtattaggaaacagaagggattatgaagataactaaagttattactggcacttgaactgaatttctcttaaaatatcagtttactttgatatgtgctacaaagaccttaaccatgtttctgtctgattcttttgtgaaatgaaggtatcaatacagaatgaactgttttgataagctccctcacaattttaaagtatagagttaatctctaagaactaataagcaatgattccattttcttgattttatttttatgagccacagttttatatcccactgcttatctgatttgaaaatggttgtaatattttgagaaagttaatatcgagtcatgccaaaaccttaataaacttagtcttgaactaatatttcaggctcatgagggatttctgtatgctaagatagattttaatattacagaaatgcaatagtgacctttccataaaaccttaataaaattactttgttctataaactgcagaagagatgggaactttcttgaaagagaatatgcatgatttatctgcatttcatggcttaatcttatatctcatttcttcagatctcttatgtttttcttttccttaaggcaaacaacagtaatttccatatttttaaactagagaacagacagaatttttcaaaggcatgttttccttttgcaccagtgagattgggttttggactggcagttcaaggatgtggttctattgcagctccaccagcaggattgtggcaccttgccaagctcacctgaggtttcttggcctatgttcccactctattacaggaagagctcagattaagtctgaaatccctaggattatcttttatcgactgttgcttaaatgttataactttcatattcttcaacattcttgtattttgttgatatggttcttaaaattgtggcacagaaatgtacaaaatactgtaagcaatgttaggatctgaaagttcactaattttattatagccctttatcagtgacctccctaagactgcgttaaggtttcaacaagtacctcttcaccattagcttattaaggttggagttcaccaaaagttcagatgtttttcacataaaaaggcctttttcctttgtcctgtagttgcttttttttttttttaacttctacgatctttgcattgctcacttttacatcaatcttgataatttgtcttattcttcaaagcagtccttttgtagcagtgagcccatctcaggacatatttggacatctggaatactggagggagcactggtggagatgtcttaggaggctgctgaaaacgagggagtggagttttggaagggtgaggagaagagtgataccataggattgccctgggagggagaatactgagagccaaaaaggataaaggacagaggaggtggagggatggccacatgtggaaagaggatcaggctgaaggtaggagttacattctggaaaggttaagaaagatcaggatcaacataagaacattgagcttaaagaccaaaagtttcagctactcaaaaaggcatattttgaacagaacatatatgctagattccatattttaagacatttacagtgagttgacagttaggaaatgagggtatccagcaaagtcttttttccttttttcacaaaaattggccatgggaaggtataacatagatggccaaaatataccttaattataagtcttcttctctgtacaacttcagggcacaataattaatttagtgacagtagatattttatccccaaaactcaatttaacttattatccatgcaattgtcatacttgaatcttatctcttttcctgtcttaccttgggggttggtttcaaatatggcagaatagaaataaaaatatatatacaatggcttaatcacacttgtgatttcaccagtattaaatataggcagcaacattgattttattaaaatactccctataaatattccccaaatagcattgtagaccaattaatgtcatggcctaagtggctagattgtgatgtttttataaaactaagttttctctatcatatttggaacactctacaaacaaagccaggatttaaagacacagtgatctatttaaagtgaataatgattttataagggaataaaaaaataaaagaaacttgaaattattcgggttttttttggataatataaaatatttactgatgttgatgctgaggttaccaggatctctgtcctcaggtcatttcaaagtggaaaattggaaactgatagtaatgtggacatctcctttattgaagcaatccttattttttattaaactacctcttattaaagcagcttaaatacagtcccaggaaaggatgagtttccctcattttggttggaggccatatctttagagtgtttttttacttgaaattaaggaactttcgtcatgagaaccaaggtcagacaatgagggtgttcggtcaaaaggtttgttaagttctattaatagttctaccatatttgagggattctaagctttctgagctttactttccacatttttccagttgtgttaagatttctaacttcaagagagtatataacttcaaaagagtatgtaaaaatacttggtaaatggtgaaacagtaagtggatgctgggtgcctttattgtgagagctttgagaagtgtgtcaggtcaggggtaaatagcccctgcttttagagcagagtggtgactttcatttctcattactgcagaaggtccagcatctcttgcctaatgagaatgtcatcctcctggtctccaggtcaggccgttgagttctctctgatgtgtctttgaaacttgctggcagtcttgtagcattttagaatatgctggatcaaactttatcctttcagaaaaaaaaaaccaaaaaaaaaaaactaattgattgcagacacaaggaccaaagcaatttttgtaactgttcattagtaccgacacttgggaaaaccaaggatttgtctaacaaggggcagggaacttagttaaagaagctccattttctctctctttttccccagcctgcggatatggtttgaattagaagttaaagaaatttgctaaaatgaaacaccatgtgaactctttggaatcgcttcacatccaactctctgacctttgatatcctttctattgcctctgggccttgttagagtgagggatgtttttcagtttctatataagcaatggaagcaaacatgttttaaaataatgcaataaaagcacccatcttatgaaagggacaattatttgaagactgttgaccttacaagaattggacaaggatttggcatcttgaaagtgtgctttgatactgaagagttgttctagaaatgccactatgtcattactctgtcagttactcttcaagacacaatagtaatgcattgttttaaatcttgcttggcccatctgaatgtggctttcattttttcatttttggaaatgtatttcaggaaggatatatatggttattaaataacatttatatttcataggagctcaaataatgtttaatcaaatgtttattaatgtaaactaagaaggcatcacagagataaaactaatataagctaagaaaacatcagataaattacagtttcaggatctgtattttacagacaaggatactaagactcagagggttaaggggcttcctcaaggtcacacacctagttgggacagagctggggctggaatgtaggtcttccatctccgattgcccttctctttccattccagcatgctatatagctcatattaatttaatattaattgtggaaatagtgtaatatataatcaaaggcagactcatttttaaaaatggttaatttacttataaaactataaactttgtatttttctgattcacttttccaatgtcacattagatttatttcaagttgtgtgaatgttattgctggtatttctgatgtgaatgaaatagactcaattccactctccctgctggtctatcagaaaaagccaaagacagcatctaatatttacacctagttttaatgtgcagcctcacttacataaaccaatttgcacagtaaatttcccattattttaagtaatagttaattagtaatgccaaacctgaggaggaggggcctgaaaaggtgacacttttaatataagttaactgagattaaggattttatttccttttcctttcagactggatgtatttttgtgcataaaaaagacaaagaggaagaaaggtttagagattttgaaaataatgtgcatgtataaaaaaattaaatcaacctccccaaacctcgaattccatgtgatttttttctcactatctctattttattagttccatctctgtacttactttaagcttttggacttcaggtggaacaattttgggcgcataaggagataaatgaccttgtgtgagatttgagatttatgtaggtgacatttttttgactaaaggttactttcagatcatggggcagtacccctgtgtggatgaacatatgaagactgttgatttcggatatccttaagcttgaaaacttgaggaagaatgttttattttctccttctatggtctgagctcagttctaatatgcatggtcttaggctttatcctcttcttatgactcctgtataataatagcaaagatctatttataaaagtagcttggagaatttttaaatacaaggaattttgattaaattgaagagctcgttgtgtgtgtatgtttattttaatgagaaaatagttttaaaataaagaatgcctccagtccttgaatttatgcctgctcctttccaaagcactttgcccatttttgtgaagtctcattttacaatcctcaggcttactccatactcacgccggaggcaaccttcagagagcttattcaagtgaagataaaataaaaatctttcctttgaaatagtccaataataaggcaaaatcaggcttctaaaaagagatttccctcttgacatatatgattcatgttggcgatgttttgcctgataattgtggcaggcagtccaagggcaaatgaagggcaaagtacagagggctgggcataagagacaggaggaccttatgggctgcccagaggtctcctctaaagagacagtctctagggataagaacatcacgcacctcatgaggacatgtccaggatcaagccccaccagtgaggacctaggtgccaatctgaacagcccttactaagggacagtgatcagagagggtctaaggagaacagaggttcaggccatagaggtggtgtggttggaatgtttattctagaaattattcataggcacaatcgaggctgtcaaacttggtaaagaatggaaactcattctacaggcctggttttagcctgcagcaggcaggcagcagggtatgagtggagaacaaaacactgtgaacagcatttcaggatactggagagaggagcaggtatacacagaaatggtactaaagtgtgcatttgggctgggcacagtggctcacacctgtaatctcagcactttggaaggcaaaggcaggtggatcacctgaggtcaggagtttgagactagcctggccaacatggcgaaaccctgtctctactaaaaactcaaaaattatccgagtgtggtggtacacacgtgtaatcccagcagctcaggaggctgaggcaggagaatcgcttgaacccaggaagcagaggttgcagtgaggccagatcgtgccactgcactccaccctgggtgacagagtgagattcaagaaagaaagaaagaaagaaaaagagagagagacacccagagagagacagagacagagacacagacagaagtaaggaaagaatggaatggaatggaatggaaaggaaaggaaaggggaaagggaaagaagaatgaaggaaggaaggatggaaggaaggaaggaagggaagaaagaaagggaaggaaagggaaggaaagggaagggaaggaagggaaagaaagaagtcactgcgctccagcctgggtgacagagacagactgtcagaaagagaggaagagaggaatgaaggaaggaaggaaggaaagggaaggaaagggaaggaaaggaaagggaagggaagggaagggaagaagtcactgcactccagcctgggtgacagagagagactctgtcagaaagagagaaagaggacgagaggaaggaaggaaggaaggaaggaaagaaagaaggaaggattaagtgtgtgtttgtgtaagagaagagtccattgtcctttctgccttgatttgttttgggggttggttgggagctcctccacagagtaaaatattcattcattcattcattcattcattcattgtttactgctatatgctggacactatagtagcaagcaaggccccagccttcacagaggtcatcatgtagtgatgatacagataaacaaatagctgtttaccaggtagggtggtgagttcttcaaagggggaagcacaaggtgcttaaatgaaaatacagagtggtgcctggcccagtttctttaaataataaccagtaagtttaggggagtaaataaccagtaagtaaataaccagtaagttagtgaatgagaagaaaagagaaatgtgcaaaatgctcagtaccggggggcaaggaatcaattctgataaatacagagaggagaatgtaaaaggaaaggtggtgagggaagatgctgctttccagtgcagctgagggcacgtttcttctagaatccttgtgttttaacataatctttctcctcagctcatttgtcaattgcagttccttaaatttaaaggaatttgctggttgactcttacccaatattttttcctgagttcttaggagaaatattagcattcatagcttgtagttaacagggagcataaaggtttgggccaaaagaggtaactgcttgaagttatttaagtgactgtgaagtctgcactgcagattaaagggatgttgtgttggctgagggtttggttatgactcagtcaccctttatttactttcttcaagttgcctgtcattcttaactggtttcttcttacttaactcttaaggatgaagcttgaaaaaaaatggttgagaaaattaccatttacttcaggctctcagtatctactcttggtcttggatggaaagcaagtactggccttcagagtctccataggcttggttgtccatggacttcctgagaaaagcgtgcattctagacaaatggactgtctttcttacccaagctttagttccgaatacctagccagcttcttttcctggtaaattgggctgggctggataaggatttaaagaccattttcctcttcccccttttttcctttttgctggagacttgatctaaggctgttttctcaaaccttagcttacattgcaatcacctggctagctggatacaccgtggattcctggaccccaccagcagactttctgatttaggtctggatgggggttgagattttgcatttctaagaagtcccaggtgatgtctgctgtcggggtaccatactttaagaaccaataatctaaggcaaatccagggacctaaagattctctagtctttcccctatgctcccagcttgagttcccatcttggctaaaaagaaataactcaaagagtattcctgcaaagaagaaacttaagctgaggaagaggtcaacctaagcctccattctcatagtccccactctggaaccccaggactttttaaagactagggtcctctgtgaccaggaagccctgggttaagaaccccttgaaagatccaggagagaccagtatggaatctgtgacctctacctaaaactatacttaatttgtgcatgtttcccttttgttttctatgttccaagaccttctcagaactactactgttagatcaaaaagggctgaactctccctgaaaattgttgcatatggctagcacctcctactaagggagaagttgttgctttcctgcgcggtaaagtatagacatccaccatgtattctgttagttctgtacttgaaaacagtgacaagttctacttttgagagagggaaaaaactgctactatacagtctttcatttacaaatatcccagggtgctctaatcctcttatttctcagaacttttatattctttagggctgatgataactctgtttatgttaaattctcagtagtaataaaataccctctgctctttgctgcccttagtaagaacagaaatactttatttcagaggcataaaagataagaaacaagatgacttttgtataaggtgtaaggaagggatccagtttcagctttctacatatggctagccagttttcccagcaccatttattaaatagggaatcctttccccatttcttgtttttgtcaggtttgtcaaggatcagatggttgtagatatgcggcattatttctgagggctctgttctgttctgttggtctacatctctgttttggtaccagtaccatgctgttttggttactgtagccttgtagtacagtttgaactcaggtagcgtgatgcctccagctttgttcttttggcttagacctaaaaccataaaaactgtagaagaaaacctaggcagtaccattcaggacataggcatgggcaaggacttcatgtctaaaacaccaaaagcaatggcaacaaaagccaaaattgacaaatgggatctaattaaactaaagagcttctgcacagcaaaagaaactagcatcaaagtgaacaggcaacctacagaatgggagaaaatttttgcaatctgctcatctgacaaagagctaatatccagaatctacaacgaactcaaacaaatctataagaaaaaaacaaacagccccatcaaaaagtgggcgaaggatgtgaacagacacttctcaaaagacgacatttatgcagccaaaaaacacatgaaaaaatgctcatcatccctggccatcagagaaatgcaaatcaaaaccacaattgagataccatctcacaccagttagaatggcgaccattaaaaagtcaggaaacaacaggtgctggagaggatgtggagaaataggaacacttttacactgttgtgggactgtaaactagttcaaccattgtggaagtcagtgtggcgattcctcagggatctagaactagaaataccatttgacacagcaatcccattactgggtatatacccaaaggattataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaaggatgagttcatgtcctttgtagggacatggatgaagctggaaaccatcattttcaacaaactattgcaaggacaaaaaaccaaacaccgcatgttctcacttataggtgggaattgaacaatgagaacacatggacacaggaaggggaacatcacacacaggggcctgttgtggggttgggggagggggaagggatagcattaggagatatacctaatgttaaatgacaagttgatgggtgcagcacaccaacatggcacatgtatacatatgtaactaacctgcacgttgtgcacatgtaccctaaaacttaaagtataataataacaaaaaagaaacaagatgacttttactctggagcatatttataatatgtcaaaaacaaattctactaaaatagatttattattcatgaaagagaaaaacccagttagattatatattcctttcctcaggcttctatagcccgcacccccccccacaccatatatatatttttttgctaaaggttgatatatcttgcatgctatcaaaaaaatttctttctagcggtcacttctgtaattcactactataaaaatgattaatatgtgtgtacacgtgttctcactcataagtgggagccaagctatgaagatgcaaagggataggaataatatggtggactctggggactcaggggaaagggtcagagtggggtgagggataaaagattacacattgggtacaatgtatactgcttgggtgatgggtgcacaaaatctcagtaatcaccactaaataacttattcaggtaaccaaacaccacctgttctccagaaacctattgaaatttaaaaaagattaatatacaaactatcttctgtttctgaaagatcaaaatactgttaagccaggggtggatttactaagcacttaagaacatgacccctcagaggacatcacgtgtagataggccccacttctgccactgagccctcctgtaccattattgctccctagcttgaaccattctaaagttgaatgacaagggattatcaggctggaaaacctcagtcatggacaactatgtacttttaatacgatttcagctccttgatgtgttctagaggattttggagggctggcataggaactcagatgtcatttccaagggaattgctacaggcaaacaaccaacatccaaacaatcttttgaaacagctcagttattctcttaggaagttgttatacttcgttgtattctaatttctttgaaactgattattgcagattgaattaaattgccagggctcagaacacaatacctgaaaacatggcaccttgacatactgagtattttgagataaaggaaattgagaaaactgcagaagctggaaggtcaatctctgaccttctttcctgagacaccttcatgtgacaggtgtcccactttatgcctggagggaaggaatgataacacaaagataccaagaagaatgtgaagagacctttctcagttccccccagttcaagaccattatatcgtacccacttttgtctaatcatgcttctatatgactatccattctttatcaaaactaaacatagaaatatacgattatctcaatttctgtctttgtttctgaaggctcctgtgtcacataaaacttacattaaataaatttgtatgtctctcttgttaacctgtcttttgttatagagggtctcagacatgaactttgtgatggatgaggaaagatattactttttcttccctagaatatattgacagttattcattatatttaaattaagctggatctctaaatactccaggcaactaagcatattttagacatgttttgtaaaatcctgatagattgaaacctataacacgatcacaaatgtcatctaatacatttataaacctggatcttcaccccaggtaactaaacatattttagacatgttttttaaaatcttgatgtaatggaaccaatagcatgatcacaaatatcacctaataaatttataaaggcagtacactttaatatttttattcatctatttgtaattattaaattttaaggaagttacacttgcccctcaattatgattaatattgaggtacgagaggcagggacaaatagcgaatgcttgctttctgtttttattttattcctgtgcaatttgtgttcttttaatacactccaggaaattgtttttaatcatgtgatgctttataatagataaatcatagcaaaggccatagatttcttgtagcccagaattcattaaagtctaattccagtaccatcacaatcagttttttcccaaatataagtattgcagaggtttcagttaacgttcattttagtcagtatattaagtaactccttactaagtaatgaataaggatcagtcataactgggatgtgtgaaggctcccattgtacagggaaggttttaaattctgaaaggggagaacaacgttttacagctttatgtatttatctcttcctgttatttgttcttgccaggatttctgctagaaaacatagacattattttaagactaatttatatgaaaagaaacaagttttaaaattgtatcctccatttgctttagaaaatattttttctggaatataaaaattacagtcactatgaatattttaaaatacagggaagtattaaagaaaagaaaattctaaaattacatcagctagctgtaactactatttgttttggtatatgtcttgctagtttttcccgttgtaaaacagtgtacatatgtaagcaatatgtgtataatatataacataaaaatttggatcagactcgtgtaattttatagcctgtggttattttttttcttaactgtatgttaagagcatttgtctttgcttcacaagagttgtgaatatttttagaaactcttctaaatttgctattgttaagcaaataactattcctttaaagtactatttttaatgggtacagtatttaagtactagagtgtgtttaatcaattgcttagtgatgattatataaggccaatatttttctaccataaacagcacaacagtattcttgtgcatagattttgtacacatttacataggataaatcctacttgtacaattactagataaaagagtatggatatttcaaggctatagaaatgtattacaaaattcttttttaccagatatgccctcaccccatccatcaacagcattgcatattatcatatttttcttcctgtactctttgtatgttttttgaaaaggttatttaatggcttaataaaaatggaggtatttttgcaaatggggaagttatccctaatgatacaatatattaatgtcaaattagattcttactggaggtaaagccatttatttaaaagccctggatgatctgatgacagcttgttgatatgtttttagaaatataaggatatcttatttaaagattgaagagcaaggcactgaaatatgtgtgatagattcaactgatttacttgtggtcagtggaaattttatcccaactctctatgttctggaaaacaactttggttgtgccatcatgaggtcacttaaggtcatgggttatttggtttaatgggatttgtatggttggatggggaagggattaatttgttatggaaatttttttgtcataaggttgaagttaaaagttgcacttaataaaatttataactgagtcatggtgcatttattcacttgaaagctatatgttatcaagtagaagcaaatgctttttcagatgaattcattttttcacaaataggaataaaaaatgaagaacaccttgtttggcttcgggggagctgcaggatttgaagtttgtatttattgctgagatgcaaaattgttacaagacatttggaacctggggaagagtatgcagaaataatgtcattagtcctcaaaggggctttggaacagaaggacaggaatgatctgaattcatttctaggtgaagtttattctgtacttttctctctgtcttcctctgatgattcagttgaacacacatgttgaatgaccattcccttcaaatcagagcagtctgtactgcattccaaacttatttggcaactttttagttcttttaagaaaggtgttcagcttcagggggcccaatatatgcattttctgggctactataaaaaattagcacaaactagtggctgaaagtaaccaaaatttattctgtcacagttctcgaggccagacgtctgacatcaaggtattttcagggccacatttcctccaggctgtggggaagaacccattcctggcctatttcaccttctggtggctgccaactcttcttgaactgtggctacatcactctaatctctgcctccgtagtcgcatttcctcctcctcttctgcttgtgtcaaaacttcccctgctccccttttgtaaggacatttagggcccacctggatgatccagaataatctccccatctcaagatctttcgcttaatctcatctgctaagtccctttttgccctgtaaggtaacattcgcgagttgcagcagttaggaggtgggtatcttttgggggccatttattcagcctgccatacccaggtaccttagatatgcctggtttcacatactgccctctgttcactctctaccagaacgtgaggcacatgtccagagacaaaaaattccttgtgaaagtattgacctaaactggtctaggttgggggtggtggtgagggagggtgagcagcactgactctaaagttgatccagcacatctgagataggtggtctggtaattcctgaagaccaccttataggtctagcaaggaagacaagacagcaggtttaaagactcaggacagagtaggccaagaaaaccaaatctcttccttggttcaccccaaccgaatggatagaaggccatatttatgggtaatgcacatgtcctacttgaatatttggcccctcgacagcccacctcagcccccttgtgttcctcctaactctgccagtttcttattatcatctttaggaggagcttttgccacttgctctggaacaagaccttctaggactccccttctttcttgtcccccgcttccaaagtttcttgcagtccagggagtttttcctctgccctagtgcaatagctaatccgatccagttgcacaaggatttagaacaatgcgactatttaaaagccttctggcctccttccagtaactgctcaatgtgtttacactgcaagaggtttcaggctgtctattctttgacaatgtaaagtctcttccacttcccgtgttcctcaaagagaaggtggatcctttcctgtgggctctgcatggtgagatgatgccattctaggaggtggaggagacaattaaaccttgaaatatcttgtaagtgaggccttggaaggcaagctagagaatttgagaagaggaacttttggcatggtacaatcaaagcctttttttttttcaagccagttagttggctgtgggttgggatttgagataattgcaataagaatgtagttatagggtggccagttcctcccctcttttaaaaagaagtaactgtccctttaacattctctgcagtcactgggactataatgtgtaccttcgtttgttcccattttaaatcaattatctggatcaaactgtagtgaaacaggattggctgggtcaacattttctagtctgtaggtcatcattgtaccatgtgtgtaaaataacccagctagtgcccctgatgccaggccctaggaagttttccacagatagcacaaagaacagcctcgaccacagccaccagtttcaaattgggaacactcaggatactccaacatcattttgccagaatacttcttaccttgttctgaaccccaatgctatgaaggaataagcaatgaaatgaactttcacctccactgcagaagagattaaggtcaaaattaccctcctccttcacctccaaagttcttcatatagtgagactattgtgatgaaattagtacccaaggtagagatgaatattttagtagttaagaatagtagtgaggtctgagaaacatcatatactgggtactcatgttgattctaggagaaccagagttaaaccaatggaagatatgcaaactgtaaaaagctttttttttttatttttatttttgatataaactttttgtatccaaagcctcttactgatttaaaatgaaaccaaagggatgaattaaaagggatggttgtcaggagtgagacaatcatagaacacataaaattctgcagaaaagagatgttttgcccaccattcttcacagcctggcaaactgggatggccaccatgttgttttttaatctatttttcaagctaacacttagctccctgtagttggttattaaggggggtctgtgggtctatttttctctgcagatctgttttatagcatagaaggcatgaatgcacatcatctacctcagaagcttgtttctaagcttcttgggtagaagctatgtggttatgtgtgtacatacatgctatattcaccaagctatgcaaaaggtttcaaagtcaaacttatttcttctgtgtaactgatagaaggctttgtatacttcgattatcaactccacattccccctaccctcagcctttggtaaccactgttctgctctctgcttttatgagttcaactgttatagattccacatgtaagtgagcacatggatatttgtctttctgtatttggcttatttcacttagcataatgttctccagttccatccatgttgtcacaaatgacagaatttcttcccttttttaaggctgaataatatttcactgtgtataatacaccacattttctctatgcattcatttgttgtgggatacttgggttgattccataacttggatattgtgaatagtgctgcattgaacatgggagtgcagatatctctttgacctactgatttcagatctttccagtaaatacccagaagtgggattgctggatcatttagttcctcaaaaaactaaaattccatttttagttttttgaggcacctccatactgtttttgacaatggctgtagtaatttaagccaaatgtattttaactttgaaagatatatactttttatttagcttttaaaatattctgattaaagttatatacaatattctcttagaatattcacattctcattctttaattatatcccacttttcattgtaaatgttgtgagtttgtgctgcagccacctcctcctcctcatcctcccttctgcccccacctaaatctccctctctctgtgtctctcactcttgctctaagtacttgccaaatatatatccaattcagaaaacaattaacttttgcttttactgatcattgttttactatttttttttttttggctacatattacatatctaggttttggtttgtaatgctctcatcttttctttctaaaaagtttataatttctgcttaactcaagaatgattaaggggtgtatgtatgtgtgtgtgggggggtgtgaatgtttaatttccatgtatatagatgttgtacactctctgtcattaatttatatgtttccttgttgttgtcaatgagcatgaccacaatattttctgccttttgaaaaatgctgaaatttcctctagggcctaatcgtgatcggattttgagattgtcacatgtgtgtgggtagccagggtgcaaagagggaaagaaaaaaaaatgtatttagagagagaataaatatattaagagagagaataaatatcattaagtactgttatttaaattgtgttactttgagttatttaagttgttgtactaaattattaagtatgatattcagatcttcgagattcttacttgtcttcttattctgttattctgagaatcattgtctcctgtttgtgactttgctaatttctccgtgtactttgtcaattttcaaatgttgtgatgctgcgtgctcacatgcttagatattaatggcagttaatgtgatgtattattactctgcctctgctttttctcttgaagtctgtttgtctcatgttgttgttacacctgttttctttttttcttagcacgtgcctatggtatcttttttcattcctgcgttttcttttttattttcttttttttttaattttagttctatcttttttttaattatactttaagttttagggtacatgtgcacaacgagcaggttagttacatatgtatacatgtgccatgttggtgtgctgcacccagtaactcgtcatttaacattaggtatctctccaaatgctatcccgcccccctccccccaacatccctgcattttcaaacttcttagatagttttcaaaatatttctgtaaacaaccataattttacctaatccgaaaacatcttttataagtgaatttaaccaattcgtatttactatgcttagtgatgtgtcattttattttgtgtttcctacttataatatgttcctgtcttctctccattctttatctggttactttttaaaagaggctcgagtttcttttgctatttctcccctgctaatcatttgggagttatgtttttttaattttaattttctataggagaactcttaaattcatagcacccatatttaaacttctattttcctactgatgtctagagtttttagtatctctgttcccttcccaaaatggttttacttccctttgtctcatactttgttcctccaaccacttcactggccacaactcatatattgatataatctaggatttgggttggctaatttttaaatatattttttcttttctacttttttggcatagtacaataaaacttaagattaagcctattgtttctttttactttatttttcttaacattatttcccatctctctcttatttctctatttattttcccctgacagagtatataatacattaaatttttcagagtagattactaaatctttctgattacttacaagtctgtaaataactacatttttctcctaaaagttgaaacagtattgaacacagaattttaaatccaaatttattttccacagaacttcaaaattgtcttactgcatttagtgttgtggatgatgtacctgatatcagtctcatcgtcatttacctctagcttatcttttctcttcctgcatctttgagagatttcatcatttctgcatattttgtgtcttcagtgtcaccatgaggtatatttgggggtgtatatctttttcccccatttatactacgtggaatcagtggattttttcactttgaggactcaaatattcaggtttcagaaacgttcttctactgttactttatttccatccctccattgtctccatataaggttggtaaacctttcctttctattttctatatctctaactttttcacccaggctggagtgcagtgatgcaatctttgttcactgcaatccccgtctcctgggttcaagcaattctccctgccttagcctcccgagtagctgggattacaggtgcctgccatcacatccagctaatttttgtattttttagtagagatggggtttcgccatgttggccaggctggtcttgaactcctgacctcaggtgatccaccccctccccccaccccggcctctcaaaatgctgggattacaggcgtgagccactgagcccggcgtggtgttgcatttttaagaatcccttggctcaacacttcatctgagttttctttacaattcagctcatctattaagttttatttcaacaatcttgttttaaatttctagtatctgtggttaattatattttaggaacagaatatactctctcttccctctgaaaaaatcagtatgctgaagtcaggtcctgtttttcctgctcaccctctttccttgggtgtaagttttacttgatgtgtttggtgttcttccatgttctttgcattgcttaactatttggtgactcattgttgtatgctcccctgtcatgcaagatgtttgggttgtagttattgcatacataccatggtgcatgttgccaacaaggatgggtaaaaggaacgctgagttcttcctagttgcagggagccactctgaacagtgcctagcctctctttaaatgtcctactcactgtctataataaaactgttgcaggacttttccttagttcagctaaaaacagggttctttgtcccacagccatgaaaattcaagctcacaggcaatttaaatggcgagtaagacagggtttcattgggtaaaaaggaagaaaatggggcaacagggactcttgcaagcccagaatccctgctagagggcttcattctaggccactggaatcccaagttccacacagaaggaggaggggccagactcctctctgctacaaacattgtgaacaccccgaggccccacctcagtgggcaggctggttggagtttctccagggaccccctatgagctggctgtctcaaaatcagaagttctcttgttccccacgtggcccaaggggtgaggaacaaaggggtaggggaaagggagcctaagagagggctaaagagaggaccaagagctataaaaaattctggctattcctacgtgattctgcaacttataccctgtgggctcctcctgcccatatgttcaccttcaagcccatagtgcccttagctatttacagcaggcctctcttatgtattgattttggtctacggtttccttattttatctgttgccttcagattttaaaaaaagaatacacacacacacacacacacacacacacacacacacacacacacacacacacatcttgttattttgtaggatttggagagggaatggaaacttcccaaatgatcacctctggtatttcttgattatgatatctccaggtttagagaaaagaaagcaagttgggggtcagacaaagggaagaagaaaaaaacgtattccacatatttaaagtaaatcttctgcaaacacagaaatgcgaagtgattaaccatcctcaattgttttttcattttatatactaacgagctattctttttcatttttaggtcttgaatataatcatggccaaaccttatgaatttaactggcagaaggaagttccctcctttttgcaagaaggagcagtttttgacagatacgaggaggtaaagaagtgttattaatcttttctctcaaaacattctaataattattaaattttaattacagtattgagtaaatattctttgacataagtaagaacatctttaggatttataggttggagttgttgaaaagaggcaagttatgagctagagtaataatgataatgatactataaatttttgagcgctcactatgtgccagatgaccttctaaacattttatgtgtattatttgtttaattttttacaacaaccttacaaggttgttgctattaatattctcagtttacagatgggttttatatagtaacagtttttgcttaatgcagtgcttttggcagtcattctacatttaactttgtatgtgttataaatgtaatagtgattgaactttgtgccagtcattgctttgctcatttcattgatataaaccattttgaccaaagctttgcatgcctctgattctatcatttattgtctgtgcccttgcaaggtggtgatgactccagactttctatagagcaggggctttgggccaccaatctgttcagaatggctgggtaggtgaattaaagcctcatttgcattgtaaatgcatgatttttcttctgttgtacttgaatttgaggtgacttgggaaggagtgtataatgaaattgatgtttcctttaccaagaagttgaaagtaaaacatattaaaacttcatttagagtcagagttggttcctttcaaaatcaatgaaatgtatgaagtggctaattcgctgatcttcccagagatccagattgtcagatgcagaaactaggtcttctgtgagctgacatagcttaatacttgttgacttgatatttctgcagggtgcatctctagatttacaggatagtcactttttaagtaaacaaaattgcaaatgctaaggatggacctaaacatggttactattccttgtttgaattaaaatattgaagtaatagctgttcatatgtctgaaattaaaataacagtgaactgcattctgctataagatgaaacagaataatattctgccatccagagacaagcactgttaattcttatgcagttttcttctagtcttttttcatatttgtttttcttttttttctctctcccatggttgagatcatagagtaatatttttaaaatataaagcagatcccatttctcctgtgtttaaaatgcttccatcacttcccattgtagcgtaaagggaagttcacagaatgaaatacaaggccttctataatttggctcctgcttaattacctcaccttcatttctctccagtttccaacatacagcgtatgttcaactatagcaaaccacttacagtttcccccataaactattctactacatggtttgtttatgctactccctcttcctgaaatgtatttattccaactggtttgattggtgaactcctctcatctcagaacccagatgagaaatgtccacttctgtgatatcttccttgacccattgaatgaataagaggcgataacttattttttgccaccactaacctatccttgcatattttacactgccttcacattttatttaatgtttctttctctccaactatgttctgagtttcttgaagtcagggatcatattttacttatctttttctctccagggactagcagaatacctgtaaccaccaaattctttgtggatgtctagcatctaaaatgattttagatccagttgattccaattcagactaataattcagagaaggtaattttgaagagattacatgcaatcattggttcagtatatctcctactgttatgtaagaaaaagctattggagaaaaaagtacttgacaacagtgaaatgtgatttgatgaaccagagattcatttgaatccttcttattgcttgtgttttttttgattattaatcatcacagctcatattaggaaatactgatcacctgtgcttctaaaggcatttgcttttcctctggattcctctacaaactaggcaaagttagaagaaaagaacccttgaacaagtattaaataaaatgtaactaagctttcaactctttcaagtgctattttactaggattttgagcaaaaacattttaactttataaagcaaacatgcgtcttcatgataacataccaaaccacaaagctgaagaatatttcaagctggatgacagccagtttaaaaaataattatttcccactcctataagactcagttctttagagccagagccatgaaaacatttaaggcaacaacatgtaagcagaaaaggttcgtttctatggttggtacatgaacagccatgagggattacagctgaaagccagtgcgaggaataagattagagaaacaaaacccaagcatccctaaagtgtcatagcaaaggtaccttttgtgaaggggcataaatgctgtcagcaccatatgataactaacgttatcatcatgaactcaaatagcaggtaaacataaaattgtattccatgtatttgtttaaagaaagcagctgggcacagtgtcttatgcctgtaatcccagcactttgggaggccagggtgggcagatcagtaggtcaggagattgagaccattctggctaacacagtgaaaccccatttctactaaaaatataaaaaaaaatagccaggtgtggtggcacatgcctatagtcccagctacttgggaggctgaggcaggagaatcgcttgaacccaagaggcagagggtgcagtgagccaagatcacgcccccacacaccaacctgggtgacaaagtgatgctgtgtctcaaaaaataaaaaaaaataaataaaaaaagggagcagggagtaagcagtcagtaggtgggggaaaaatgtttaataggcactgttttaaaaatagtcaataaatgtagtaagtgcaaatgcatttaaagtttattttattatttctgcattactgaagaattatttttgaggcagccagatttttacaaatgacctaagtggtaggctgtgattgtattgccatgacacttctaattctgtacttttctaactttacttgacttacacgttacttaaatgcaaaatatattttgtttcctaagtgatgcttaacattaaatctttaaaagacagattcgtctcttgtggaggagagaaatagcagtgtttttaaaaatacatgcaacccagatatctctaactcaaccagccccctgactttcctataatatccacatcaaagatctgaagaacccattccctggcaggtcagggccttcccagtctttcctagaattcctaggtgcttacccacttttgatgatgacttatgtcctcaaatgcttggctaccattcagtttccaggactgttgactactccaatttgtttccttccctaaacccactttaacatcaaattccagaaatacaaggatgttgtataaagtagactttttactgaagatttagtggcagcagaggagaattgcatcatacaccacaccaagacaactttaagattaaaaatcggagatcatgctgaataagtttcattagccagcccaaccaggagtgtctctcttttttcttctttgtccctctcctccatcaagattcctgttcctgtttcctttattttattttaatcacactcagagtcctttttcacttttccagatacttttttcttaactgtcaaacattttctgtctctcaatctaaagaagaaaacttcaaaattcaagtccctcctcatcctggagctgtttggctcccctttcacctcaaactctcctactcagactctcctgagatcctcccttttgcataagcctgaaagtcaaagtatgtccttaaaacacacaaaatctaaaaagagctttattcttaagaaggagactgccatcatagataagtgttcaccaacagaactttccacaatgatagaaatggtctacatttgtgttgccgttatggcagccacatgtggctgttcagcatttgaaatgtggctactgggactgagggacttaagtttttaatcttacataatttaaattcaaattcatataggtacatgggcctagtggctttcttattggatggcatagataatcaactcaaactacaaccagattttaaaattccattctcccttcttgacactaagaagcattctcagtgcattccgttggaatctccagaattcatcagccagttcttcttaggggcagccagagcaggggttcaaatgttttatggatgactcacctcagccactgacctcgtctttcccacatcataaatcccagctcgggctaccccttcttcttgcccatgggactttcttgtatctgagtccagctgcctagatggagtcccttttcctagcaaagtcttggtcttcttggtctttatactagcctccccaccttccaccctacacacacacacacacacacacacacacacacacacacacacacgcacgcactcacacacacgtggtggaggaaaactgagacaattattgcaggtgtcaggatcaaaggagtatcaaagtgcagggtcaatacaaacctaaagtcaggcacagtgggacaggctgactttggcctctttccaaggtggttctgaaatcaaattgtgagcagccacaccatgaagctcagaaaagctcaagcagcctacaccccacaggctgttcatcagcaaagcaaagcgctttccaaatacaattttcaaaagacttaaaaacacaagcctcatataaagtattttgattaaaagatatatttaactaatcagggaggacattagcaggatgataaagctagttccaagagcacttgaggaagagaattttacgtaggaaaggaaaggaaaagtgaagtaagttttgtcaattagatacaaaactggctaatgtcctataaggcaataaaactctaacctattatagatttgcctttttctactggacacaagtcatctacatcattatagaataacagcagaaaaatgctatctattaaacttcgaagaatctatgtcccaaacaacagtaaatagtaggtcaaaccaaaaatacatttttctatagaagtaaatcattcttaggtatgcctcttcaatcatgctttgatgtaacaatgaaaagagggatggccatctttgcatattatttttaagcttgagataatttaaattcaattataaaacaatgtccagatatacctgtatttacactaaaagatacttacagtcatcaaaatgataataatcataataaattagtttttcaactgttataatcaacctattagtttttcaacttttataatcaacctaagggtagagaaaacatttaattatttttgaccaagcataacaaaaaagctgttacctttatctatttaaagtaagggtgccagacagatgctggaaattagaagggacttggagaaacagaggaaagtccagaggctttatactctcagcaagagggaaggttggtagttgatgtacaatagaggcttgcagatatgatttaaagtataaaagtagccaatcacaaaccaaaaataaaataatttcaaatttggagttgggggagaaaaagtagtgaaaatgcgttaagtggagttaaattgctgtgtttttattccaagaaaccgatttctgcatattcctggtggataattagtttagttactggctgtcttgccatgagtcctgttttcttaagctcctgtctctattagagttggacatatggaacagaaacctgttggtgccactttattatgcactgcagtaagtactggcttcatagtttggacggcagctgtactcaccgctataccaccaccaccactggctgggcttctcagttttaaactctaggctttcagcatgtggccctgaagccctttcactctcacccctccactttcttccacttgcatattgtgatgagaaaggtggtagaatgatctccttgtggtgtgagaggagaggaaggggcagcagggctgggggactggccccagaagcctcaatgaggaggcccgtttcaggctgagtcttgataggtgagtcagtcaaccactcaaagcacagctaagaggaagggagaggccagggcttctgcaagggcatgagtatgacagcacattctattgagggggtaaggggattattcagctagggcagagggtagggcagtggagtacaggggtgaaggcacagagatggccagtgtccacaccatcaatgggtttactttccagcccagggcattggcatttgattcagaaagctctagggaacctttgatggggtttcagcagggcagtgatcagttctggatgaccagtgacaagtggatgtggctggattccttgtgggagtggtctggagggtagtgttgggcttgaaggacttaatggacagtcagtcacacatatggagaaatacgggaggattttgagtgtaggaataaatgagaagatttttctaacctggtggatgtagagtatgtgagagaataagtgtagaatgaggttggaatttctagcacgggaactggacagctctgatgcaaggtggagagaatgccagagaagggggtacatgtatggatgcatttatattgtttctttctgaaatgacgaagaaccaaaagcaaaagtgatatcttctgtagtacctaagaagcattttgtatataatcacattaatactagttaaaaatacattgaatagaaagggaagaacgtaataaatgatccaagaggatgaacacatgggcgcatcttcctctctcagtcctcttctctcagggtgattgttgctgcctgatgggatgaaggaatgaggaccccaagaccctcacagccacaggcttccttcactcaccctcttatgtgggtgatactgcattcctcagggtagaggaattttttttttttttttgagacggaatttcgtgcttgttacccaagctggagtgcaatggcacaatctcggctcactgcaacctccgcctcctgggttcaagcaattctcctgcctcagcctcccaagtatctgggattacaagcatgtgccaccatgcccggctaacttttgtatttttagtagagatgtggtgaaaccccgtctacataaacagaaagtctatttacacagaaaggtttgaggaaaaagaacctctgacagaatattctgaattataattaggggtaagatcgtaaatgtgtatacttatatgagtctttcacacactctgtatattgtatgtgaattatcatattggaatcattaggctacaacaagctatatagcaacttaatgatgataaacaatcttgagtacagttggccctttaacaattcggaaatattttaaagacattacaacttaatccatggtgcgaaccactgctctagaaggctgagataaagcaatgaacaagacaaacaaagtctcagtcctttgggagtgtatggtccagcggcaggagaccaacaataaaccaataagcatagaaatgaatggcttccagcagtgttcaatactcttatgttactaaaaggagtgatagagggatcagagagacaggcagacattgaggagtaggggaggggacattgctgtgggttgggtggtcagggcaggccctattcaggaggtggcatttgaagttgtagctgaatgataagaagtagctagattggccaggtgcggtggctcacacctataatcccagcactttggtaggctgaggcgggcacatcacctgagatcaggagttcgagaccagcctggtcaacatggcaaaatcccatctctactaaaaatataaaaattagccaggcatggtggtgcgcgcctgtagtcccagcaactcaggaggctaaggcacaaaaatcgcttgaacctggaaggcagaggttgcggtgagctgaaattgcaccactacactccagcactccagcctgggtgacagagcgagattctgtctaaaaaaaaattaaaaaaaaagagccagtttggccaagaactaagggaaaagcattccaagacatggaaacagcaaatgctaggctctgaggcaaacatagtcttggcatgtcgaaagaagagcaccaagggtggagtgagcatcatggtcagggcatggtaagaggagaattctgagaagcaggcagaagcccctcatgtggagcagtagttctctcaaagtgtggtccccaagccagcatcatcagcaccacccagaaccttattagagatgcgcattctcaggcccatcccacggacctatggaatcagaaactccaggaactggcccaggcgtatgtgcattaacaagcccttcaaggaagtccggtgcacacttaagtacgagaataaatggtgtagaaccaggccgaggtgtttggatttcgttctgattgctatgggaagccattttcaacagggactggcatgatctgatttatattttggagacagttactctggaggccgtacaaaggatgattcgtaggcgggggccaaaaggttggagaagaccaggactttaaggaaggtgagctagaggcttaatccttccttttcctgactatgtctccatgggcgattttcttaatatctctgtgccagaaaaataggatatgttaaggtggatgggtcgaagaatatcagttgttctccttaggattctacgagtctgcacacacttttcttgtcagcacagctgtgtgacttcttcctgatgtgagaagaaagccaaggccaggcatctgagcaccacctcagttggcccgaacactgaaacaacccaaagcagcaaaaactaagatcagccagatttttgcaaagaaaaacccaaaacaacattcaggcctgttccttcctctagaccagcctttgaaataacagtgctgataatattatctggtctctcatgctcccaaagctcagagctcattgtcatccaagcatgagacctttaaggaaaggtctgtattgtaggtcatctcatgctgaaaagtcatagaactgggtcagcatactttttctgtaagggaccacatattaaatagtttagattttatgagtcctgcagcctctgttacagctattcaactttgtcattgtagcccaatagcagccatagaacataatatgtaaaaaaatgagcaggcacttggattagaagacaaacaatgccacatagaaatgagtaacaaattggttttgatggtaatggtagtaatgaaataattctagtttcaagtaattatttttactcctcgtgttcttttactactgtgttgtatttttaatttagtcaccctctatttctcttccttatcttgatagatcattgtatcagtttatcaccttttgctgcatacataacagactgctcacctttcttttctaagatgctctcatttttgtggggtagggcaggggcttgctcttctcattttcatgtctcttccctctctgaagtttctttgggcttgcttttatttcttcacaaaagtagaagataactctatttcctggaggaatggaagcatctcccccatgaaatagtgtctcagtcagtttcatggaaaatggtaatccttgagatccatgcttcaaggatgcaagaaggacgtcttattcatggaaaaatgtgagatgcatccattaggaaactagacagggaaatctggggtcccactagatttacaaggagcttgtggaaacaacacaagacaggaagaaagtatggaaaaaatatgggcaattaaattaaaatataagtgtaagcacctaggggttcttgctgccagctgcacaaagaaagaacatggcattgtagtaaagaaagagtttgggcaggcgtggtggctcacgcctgtaatcccaacactttgggaggcaaagatgggcagatcacttgaggtcaggagttggagaccggcctggccaacatggtgaaaccctgcctttactaaaaatacaaaaattagctgggcttggttgcaggcacctgtaatcccagctgaaaatacaaaaattagctgggcttggttgcaggcacctgtaatcccagctgctcgggaggctgaagcagaagaatcacttgaaccctgggacacagattgcagtgagcccagattgcgctattgcactccagcctgggtgacagtgacagagtaagattctgtctcaaaaaaaaaataaataaaaataaaagagtttaatagagacaaggccagccacaccacttgagagatgagttagtattcaagtcatcttgtccaaagctgctagtttaggggttttttaaaggcagtttgagggaagaggaggtgcggggtctaggcttctgctgattggatggggcagggatgaaatcatgctgaatcgcttctgggtggggccataggagtggggttggcaagtccaggtgggtccaggtggagacatgggtgtgaggcatgcaaaaaaaacctgaaaagatatctcaaaaggccagtcttagtttctacaatggcaatgttatttgcagaagtaactggggacattgcatgtcttctaacatccagaataatggctgacagtcatatatgtctgcaccttagcaggactcaggccctcctctcaaacagaagtggttggtttttgggcaatgcctgttatcatttaaactgtagcctaaacatctcccaaagttaccttcatccaaaagcccaggaataattaaggaaaaggcaaggtgggaggtgggttagcttagctaactgttataatttttctcactgatacaatttttgcaaaggcagtttcataaggaactagctgaggatctacttaggtctctcaagtactactgtactatgctaaagaattaaacacaatggctaaaattacagtgctgattctctattgcttcttctcaacctgcagtataaagagaaaaatgctcaatattagctacctcaagccgtgtctgtgggccgcaggtgaacaggagggtgttggccagggcatccttttaattagggttgatgagtgcagtcttgcagatcatcaggctagtggtgaagagaccctaaggacatcctggtttcattctctttgcacacctctttggaattgcactctcttaatgcatgtggtgtagccattgaattaacagagttcattcaagtgtggacaaatgaacagtcagatgaaatatacagcacatgttaaaatgaattcttttttctgttgagcagtctagggagaagaaatttttttaaaaaatcaagttaataattttgaagtcccttctcgattgataaaattgcacttctttaaacctgtgcaatttcatgccactgaattccctattcctgaaaattttcagaaattatttttgtcattacttgttttggttgtttttgagagggtgctgtattagtgagggttctccagagaaacagagccaatgggatatatagagatatataggtaggaagagatttattatgaaggattggcttacacaattatgaaggctgagaaatcttatatcgtctgtctataagctagaggcctaggaaaacgagtagggcagttccagttcaaacctgaagggccagagaaccaggggagccaatggtgtgtaagtgtcagttgagtccaaaggccccagaaccaggggcatcagtatccaagttgaatgtcccagatcaagacagagtgaattcattcttcctccaccattttgttcagttcaagccctccgtggattggatggtgccctcctgtattcggcagatcttctttattcattccatcaattcaaacacaaatctcttccagaaacagcctcacagacacacccggaagtaatatttcatcagccatcagccttagcccagtcaagttgacatataaaattaatcatgacaggtgttttttagcacagacagtagtaaatcactactactttgagcactcactaggtgctggaccttgcacttgacaaatggtataaatgatcaggaaagtatcctgatctagaccctaagagagaggattcttggatctcgcccaagaaagaattagaggtgagtgcacagagtaaagtgaaagcaagtttattaagaaagtaaagaaacagaagaatcgctattccataaacagagcagccctgacagatgctggttagctatttttatggttatttcttgatcatatgctaaacaagtggtggattattcatgagttttccaggaaaggggaagtaattcctggaactgagggttcctcccctttttagactatatagggtaacttccggacattgccgtggcatttgtaaactgtcaaggcagtggtaagaatgtcttttagcatgctaatgcattcatatgaacatataatgagcagtgaagacaaccagaggtcactttcttctagccatcctagttttggcagcttttggccggcttccttagtgcatcctgttttatcagtggggtctttgtaacctgtgtcttgtgctgacctcctctctcatcctgtaactaagaatgcctaacctcctgggaatgtagcctagtaggtctcagcctcgttttacccagccctgttcaagatggagtggttctggctccagtgcctctgatttaagcattatttcacttaagcctcgaaacaaccctgttttaagtaggtctttttagcttccttttgcagtttacaaaactgaggattaaaatggttaagcatgttgcttgaggtttcacaggctggttacagacttagcagaaaaatggcctgccagctagcctacagtggatctccaagtatggtttcagacagcatcagcaacatttgtgagcttgctagaaatgcagattattaggccccaccccagacctacagaatcagaaactctggggggagggtccagcaatctgtgttttaagagccctctcagtgattctgatgatgcagctcaagtttgagaacctaggcctagggaaaggtaaggaattgtagacttactagaaggaaacaaaattagatccatttaaagttctttacagctaatcttcctcaaacaggcaacacagagaaaagggtgaagactgttgaataaaagagacttctttatctaggctgaacatattagatttattgaacccttgacacagtgcaaagtacttgacatcagtcatctctttaaaccctcaggtggtggtgagggctaaatgagattttccacagtttacagatgaggaaagagaagcttaggtcacttaagaattgcttgttaatcaacatgtagtacgtgatggagctagcgtccagaactaatgtattgctaaagagaacatacacaggtcacacagctttatgacccagaatggctgtcagcagagaaacatgtttttgaagatatatatgatgtataaaatacataattaaaaagtctttctaaagttcattaataggctggaaccaaagacctgtttaactttttactcaccgtttgcattacttattctagaccataagtattatactactaagtctaggtgtctttagtctagttctcttagggaaatgagaatgggaagactgtatttttcatataatttcccccacattccccaaggaaagtgtttaccagggcttttttaggttttttgttttttgtttttttgagacagacggagtctcactgtgttaccaggctagagtgccgtggcatgctctgggctcactgaaacctctgccccccaagttcaagcgattcttctgcctcagcctcccaagtacctgggactacaggtgcgcaccaccatgcccagctaatttttgtatttttagtagagacggggtttcatcatgttggccaggctggtctcgaacttttgacctcatgatctgcctgcctcagcctcccaaagtgctggtattacaggcgtgagagccactatgcctggcctttcttttttttctttttctttttttttttttgatacaggacctcactctgtcacctaggctggagtgcaatggcacaatcatagcttactgcaacctctaactcctgggcttaagcaattctcctgcctcagcctccctcccgagtagctgagattacaggcagagccaccacacccaggtaattttttttttttttttttttttgtagagacagggtctcactatgttgaccaggcaggtcttgaactactgggctcaagtgagcctcctgctttggtctcccagagtactgggattataggcatgagccactgtgcctggcccctagtctttaatttttgaggggggagaaaaactaggtaaaacatactatatggaaagattataatattttctttcaattgatggacatagacataaaatattgtcagcgagaaagcctatctttttaatatttattttgataaactaacaaggagcatataatttataaaatactttctcttaaagccataaatagtaagcacttgctccgaaatgctgctttgtcaagaacgttaattgaagcagatgagcagagtcagtatagcttcccaggtccagcctgcattccctttctactgcagagttacgctgaggacagcatgctggcacctccacggctcttctgctgtcaacttttcttctcccaagtacctgaaagggcaggtgatcctcttaactttgtagacatgtgaaaaggagactagtttttgaatgctcaccaaaagccaagttgccaggatattgtttgcaaatacagaaagggtttttgtactaagtggtatttaaggcaaaatctttgccaaagaactctatccaaaagcttgaaatacacatagttggttaagggaatgcatttggagttaaacagaaataggttcagttttggctttgctactcaagagatgtgaccatgagtcagtcttaacacccaccaagcactaagccagagcttccttgtttgaaaaatgggagtgataatacctacctcgcattgccatcataaggaataagtaagatggattttttaaaaatggaagtcagattatgcccttcttttggtttaaacctttaatgggtttctacctcattccaagtaatttccaaagttctttctgtgtcctgcaagtcccctacatgacctaccatttcgctgtcccattgatattccctgagcattctaggcacactctgacctcagggcctttacacttgctgttctccctctggactactctcctctgtacagtcctcatggttcacttcctcacttcattctgtttctgctaaaatatcacattctccaagaggccttcttactcacctacacacacaggctcctgacccttctggatgttttatttgttacatttatcactacctgataacttactcttttttgttcattgctgaagtccttctagaagataagccctgagagtagactttgtttcctgctgtatccccaccagggaattaattcatcactcaacatatttcataagtacctactatgatccagcaattccttagttacttatctgagactgaaattcattgatatttccatggttcctaatttttaaggaattttaaagccccaaagaactggaactgaaaatgtcactttggaatgtggagaaaggttaagccagagacactatctgtggcagctatggaggtgtgtcgcttaaatctcccttcaagagacagctgccccaggagtcccctcattggacagttttgctgcaggggcttcagcaccctcaaaatgtccctgcccaggctgtactgaacatggcaagctgctacaaccgggcctttcctgcccaagtgaggctcctctggtgggcgttctgtgctctgcagctgcaatccagcaatgttctcagctgtactgcaagctgagacaattcctccccagttctccctgctccctcctctcctctctcaggtgtttgttctgaggtctggtttggaggctctccctgtcactcggtttctctcccctttctctttcacaggcatttgccctaatgaattgctcacatttccaattctgtcttgcctgtaatctcagctactcaggagggaggctgaggcaggagaattgcttaagcccaggagttagaggttgcagtaagctatgattgtgccattgcactccagcctaggtgatagagtgaggtcctgtctcaaaaaaaaaaaaagaaagaaatttaaaaaagaaaggccaggcatagtggctctcacgcctggccaacatggtgaaaccctgtctctactaaaaatacaaaaattagctgggcatggtggcatgcacctgtagtcccaggtacttgggaggctgagggaggagaatcgcttgaactcgggaggcagaggttgcagtgagcccagatcatgccacagcactccagcctggtgacacagtgagactccgtctgtctcaaaaacaacaacaacaacaacaacaaatcctaaaaaagccctggtaaatactttccttggggaatgtgggggaaataatatgaaaaatacaatcttcccattctcatttccctaagaaatgtcttgggggtttgtttctagatggagaagcccttccctcagggtaagaggtcctcaggataagcctccaggactctgctgccatttcctgaggccgactctgagctcactgcagaattctctaggtggtagcagtggttcttgtgtgatgttccagtaattgctgcacttattttagacacaataaaaagtgacagagccagcattgaccctaagagccagtggggactatgtatcttcaaggcctaaatataagctatttcagaagacaaaagtccaactggagtgacgtatcatgcagctcttgtggaaaaaaaaaagcattttcaaaagctgcattatttaaatgagaaatgcatatatttaaagggaagttccataaaagtcatttgagattccttttctttcaatgactgtattcagcattgtctattatctccatatatcaatagtttaaaatattttttcatagacctgccttttcagaaacatcttctatgtcactgtatttttaattacttgctcagtgtaatttattatgctggaactaattgtgttttaattagaaatgctttgctaaagagaagaacttatcagtttgcggcggtgtttccggtgcaactacaaagcacgtctcctgtttttcttaggatttttttataaggggacagccacataatgtgtttttaatatttgttgtaaatatttattaagaatcctgtttacttgcctccataactctaagttgttcctctttaatttttccttattttagttgctaaggcaactgttttgactactgtgacagttttcctgcccaagaaagttactttgagtgaccacccactcctcttgaaaacacattttgctttctccttccttctgcactctgagaggtagttgttgaatattttaggaataatttcttcacctcttttctggcaagagtcagggaaccctcccagaatctgagcatccagattttgcctcacaatcctcacagcagagacacttcagggagggaaaattacaaacctagacagatccggagtgttcagccattcaaactggcctgcctcacaaatcaagtcccaaagatttaacatctatatcgtcaagtaaaagataaagtgggaatccctagctattagtgaccataaagtcaatcgttagaaacagtttggcctctcccaggtggctaatctgggcatttcatttctcccccagattcaatcatagttaagctgattaaattctcaaagaaccaaggatatttctgagaccttgtatctaagttctttcaggctgctataacaaaataccatacactcggcagctataaacaacacatttatccctcacacttctggaggctgcgatgcttaacatcaaggtgctggtagattcggtgtctgataagagcccatttcccgattccaagatgacacgttcttgctgtgtcttcacacggtgggtgaaaggggcagccgtctctctggattcttttataagggcactaatcccatttatctcccaaaggcccccacttcctaattccatcacatttgggattaggatttcagcataggaatttttggtggggtagagcacaaacattcagaccataggaccttggtaagcaccatcaggccaaattttattttattttttaaatatataatatgagagatcagaaaagatggtgtaccttcctttgtttcttttcaatagccttcatccactcttccaagccaggtcacttagaaagttgatgatgttctttattcctgaggtaagaataaaatgaaaggggtggattaaatctttctacttgacaccagaataagcgttctctgtatctcactgtcattgctggaatgagcactttaaatgctcatggttgattactgagggagagacgttttcatttttgttcctattggttttgaaatgaaagatagacagcaggtttaccaccttttgaagttgctgaataactcacttcattgccctcttgtcatctgagaacgtgctctgtcgtgtcagggaggtgcagggcagagtctccccaaccaggaatgacctcttctgttcactataccccaacatgcacttgaaaataaaaactgtgttgtgatggctcgtctgtggcagcagcttcttggcctgattgtagactgaggccagcttaggcagagtgggatggaggagttggagcaggaacaaacagaagatgaccttctgtgcagaaaccacattttcaacaagtctaagtcaacccagagttacgaactctgggtttcccttatgcttagctttgtattctagctcactggaaatagacatgcactaataccattgctctttttaaagatctgtgtaacagaaatggattccctgtcaaaatgtatttgtatttctgcctcatattatatattatctgcatcctcttgggtgacttgcctcacctcagttaggaaaagttttctcatctgtaaggtagggatggtggtgtttacctcatttgtctttgatggttaataataatcagtactagcaacattataatgattattattactatgttttatattaataatcaatactgggccaggtgcagtggctcatgcttatgatcccagtgctttgggaggctgaggcaggaggactgcttgaagccaggagttcgagttcagcctggacaacatagcgaaactctgtctctacaaaaaaaaatttttttttttaattagccagccatgatagtgaatgcctgtagtcctagctactcatgaggctgaggcaggaggattgcttgagcgcaggagtttgaggctgcggtgctatgattgtaccaggagtttgaagctggagtactatgattgtaccactgcactccagcccggatgacagcaaaattctgtctcttaaaaaaaaatcaatactggccgggcgcggtggctcccgcctgtagtctcagcactttgggtggccgaggtgggtggatcacgaggtcaggagattgagaccatcctggctaacacagacaaaccccatctctactaaaaatacaaaaaattagccagacgtggtggtgggcgcctgtagtcccagctactcgggaggctgaggcaggagtatggcgtgaacccagaaggcagaggttgcagtgagctgggatcatgcccctgcactccagcctgggtgacagagcgagactccatctcgaaaaaaaaataataataaaacaaaattaaaaaatcaatactaatttacttagttcagactatgtgtcaagtgctctaatgcccagaaataacctgtgagataggtattgtggttgatgttgttgtctctgtttttagagatgaagaaatgaatatctaaccacatttggatcaggttcatctaaaaccctaaagcctatgtaaaatacccaattgtttctgctgctggtgagttggtttttatgcttacatgtttctctcaccttccacaggaagctgtaatgtgaaatatgtaccaccagataaaataacggaagagggatttagattgaagggaaaaaagtaaacaagggagagtacatcaaatgaggggtaaatttagcaggcagcaactcaacaagcagcgaaaatgatctgtaaagttgaaagaggtgagcctcagatttgcttctggtgttcctggtggctaaagcaatgtagaaaacacaagttgttgtagggttcacagtgtccattagattgtaaggaaagcaacaggtcagtaggaacagagtttttcctggtcctaggatctgaaaaaaaattcttacagaattcttacaaaatacactcccccataaaaaactgtaataagtacagaatgtttcagtagtacagttgttcagttatctatgtggtaggattcacggggaatccataagaaatgcagtaattaaaaccaaaacacttcagaaacccatctgatcctttgtgatgattgctggcatcagtggcaaggagaatagcagaggcttcttcaggtatgactgctgagcagttacctgagccgactgctgagcagttacctgagcccactcctgaacactgtcagtctttcatgtgtcagcctcaaagcaggtgtagcatattgttcaaaacatttgatctgcatgcctcaatgtcctcacttgtaaaataggtataaatagtgaagcagcgttgtttgtctggggtaatacccgaggttcgttgtcccacagccatggaaagctaggacgtggacacatcagagtgaggttaagagtggaagtttaatagacaaaagaaagagaagagctctctgcacagaaagggctcctggagaaaatgggttgccacttccgcagtgaaatgcagaaagtttaataaatgaacttaaggagggggtatgtgatttacacaggggatgaaagatcggttggaggaggcatgccatttgcaagtgtgcaaagaagctggccactccaccctaatcttttattatgcagatggttattctagctggctggtgccatgttgcctcgtccttattgtacacgtggtgacaaagaaaagggaagatggagcctccgtgttgaacatacctggcttccaggtagccttctcttggcgcagctgccagcattcacctgtacaagcttccagcttgtttatctatgtctgtagctcggtttttcaggctgctctttgttagaaaagaaatgatttgggggctacttttattaaaagggaagccttgccgaagactccttgtactgacactatctgcctaataatttctttctagctcctatatcaataataaaaatggtacctccctcataggaatgttgggaggataataagttaatgtagagaaagtacttagagcgttgcctggctcttaggaagcactgtgtatgttacctagcaatagtaggcatattactaggtgccacaggccttttgaattgctcatcaggagactagaacggcatctccctgttggattccagctgagcatcagttactggtggaagggggaaaggtctatatttaacaacttaacccaataggaacatctgtccaaagaatcaaaggccatcaaaaggaatgcaggagctacacatgctgttattttgtctgacagattttttcacaaggtaatacttgtagcacatagcaagggtctgtgatggagcagctacagccgtgccctctggctcctcatgtggaatgtgagctgagaggcccagtgtcctttatctcctgggatcttaaagcagataggagaggcacaaatggaatgaacattctatatccttccaagcaagagaccaagctcatgagggtaaaagcaacttaataaggacccatgcccatctattacatcagtccataaatcattctgatggcaggatgttatcactgagggctttagtttaacttgaaaaaaataaaaatttgtggttctgagagaggcggtgtttgtgcagaatcacaaaggatctgctaggtatgaagcttaaagcatttccctggaataaggagaggaaataaataagccataaagcatctcttgggctctgagctttcaggatctgatagaaagctagacctcttggttaattccaaaccagactccacctgctttcccagtctgaaggccacacccatcattctccctggtttatgaggtctctttggtggtagtcacgcataatgtgatttaaattgaatgagatcctttatggcctcttcctcagactcctctttgtttctctccaaccttgacaaggtctttttaacttcctctccattcttatcaaaccaggaagcaaggagggtgagtctcatatgtacctagtggagtctacctaggcagtgttcgtttattgaccgtccaacaatcttctggcgataggcagaggggccctgcttggtcaagtttgcccaagtcagacaggcatgggctttggaatcagagaagctggcttgaatttcaggtttgttactatttgactgtggctttgaataatttagtctcctctgaacctttttccccccttctctctgaaaccgcattggccaatatggtaaccactaaccacattgtggctgtttaaatgaaaaattaattaaaataaaaaattcagcacttggttgcattacccacatttcaagtgctccctgtggctcatggtgaacgtattgggcagaacccatctggcacatttccatcatcacggtaaatccgttggacaatgttgatctagtctaaaaccttgcagagttatcatgagatttatgtgagatagtatttgtgaaatacctcacaacaagagccctaaaattgtagctattttctcataagtacgaccatttagtcagcatttactttgtcccaggtacttagacattctcaatattaattctttgaaagccctgtgagtcggtatcagttttcccagtttacagctaggaaaagtgaaatatggcaaggttaagcagaataactgcaagattctccagcagttgcctggtgaggaggctgacatgcaaacccaggaaccaaccactacaaggcctggatctcaaaaccactgtggactgccacctcttctgaaggttttctttcccagaaaacgcagttttgtgatggaatgtgaatgcctactccatttcacatttctctacgtcctaatgtatctgtccagtgacaaacacagaaaagcccctggccaactcatgtttaaataaggtagagttaaagcttttatgatctggtccaaaatagctgtccctagctggtaataagacttgactatgccctatttgaagatgccaactccacagtataagatacagacatttgcagttaacttaggaagtgatggcgagagagagggcaagagagaaagggtaagaaataactacaactcacaattaaaataaaatcagctaccacttagctgtatccccatccaaggaatttctccacttcaatcagagtatttggcctgctgaactctctgacattccttatgaggggattaaactttattgaacagaatcactttaaaaattgaaataaaggaaaaatgtttaatgttagttgatttgaaagtaacttgaatctttgaaaaataggttgtgatattgattaatgttgaaacagcatgtgtgagggaaaatatactaaaaataacacacaagtgaaaaacatactctatctttgataagagagggaagtgtctctgtaagcctgtagtggcacaaacccctcagagtggggatctctgagccagaaatagcttctagcaatggtgatctccagcaaaagtgattctagactctcaaacagaatgccctctggcctctgcttaagtagtttcacaaaaggtgttcctgtccctttctagccttgctctctagtggcctaagagttgggctggatgagctaacgtgtccttgagctctaaggcgtgactgatgaattttaactaatatgagaattaaaattctgcccaccccccaaggaagttctcttatggtttgtttctttaccagaaaattctgttaccatttaactgcaaaacaaatagattcccaaaggagaaacattccagctttcttttatgatctcccctgcagggcccagatctggaggaggatttttctgacaatgggacttcacaatagcctggcctcaatctggtcagggagccatagcccactttcaggtcaggagggattcatgtgaaatttaaaactgctgttagggaaaaaagaatagacatgatgtgtctttactcaccagagggtagggttattatgtttgttagtaggaggtggtgagaaaccaaattagattgtgttttagttcctttcagctgattacctctcatccctcagatttgctctgtgaattttcatgggtggtttgaagcatttggtccaagaacctttcagccacagttgatgagctgattgtgggttttgtcgtgagcctggtctttagtgtcagctgggtttcattctaagatccccctggagaatttctattctgataattgcttctcttaacaactgatacgtttttattttatgagctggatgggcacctggtaaatattttttttcccttttttgcttttgttgctggggagcccagagccaagttgctatcctgctataactgtgtaggaccttatgacaggcatttcagagagctgccttttactctggccttagtttactattccactttatttttcttctctttgcccagatttctcatcctattttgaaaatgatttcttcacagtgtcaaacagtgctcctggttcaataggaattcccaggacgtgcctcaaagtcacccccaacctcgaagatgagtttgtatgcattacaaaaagggactcctgcctttaggcagacggcctcaaccagtgcccttgtaattgcacttctatccttggcagtcttccaaggacttccttgttgggttctgggcctgatgcagccccctcaatttgagcaacttcttgtttatttgttttacatattggcctgctgcaaaatcttttatttaaaaaaattcattttttcatttatttttaagttaatttgttagttttatggtgcttttgatgtgctaggtgctagaacacaaaggtaaacaagactgcttcaaggactctgccctcttggaggttgttgcattctggtgtgggagtcagtcagtaaatcaaggatcagggagagcctctctgaggaggggataatgaagacaaggtctgtagaatgaagaggagcctgatgcaccaagggcagtagaaagagacttctgagcaagaggaactgcaagtgcaaaggccctgatgctagagagagcttgaggggttgcaggaaaagagtttttatggttgtgaacaagaaatagaaggaagaacagagagtggcatgagataaaatttgaaggatcccagatcgttcaggaccttttcggccaggtaaggagttgggattttatcctaaatatgataggaatccattgaatggttttaataaattcattcaaagtttaaagaatcaatctggctcctatgggcagcagaaaaagcagaagtgagaagatcaatccatgggagagataatattggtttgggccaaggtgggtggtgatggagagggagtaaagtgggtgtgtattcgaaatattatagaagaagacttgctactgaaagtgagaggaaaagatgagggaaaattaaggatgactcttagtttcaataagtgaccagatgctagtgacatttatggaactaaggaagtactgtgatggagaaacttggaggggagagaataaagagttcagttatggacatacttatttcaagacatcctagtggagatgtcaaatagcaaatatttgaactcacagaggagaggatggggctgctcttacaaatttgagggtcatcaggaaatagatgatattgtagacacaagattgaatgaaatctaggaacacagtggaaatgagaattcccagaaccaagtcctgaggactatgtaaaagttgagtacagaaggaaaaggcgggaaattagactaaggtaatggagcacaaccaggattggagagtgtttcaagaaggaaggaataatcaaactctcagagatcaactcaggtgaggaaaggaaggtgtgcactcctattttgcagcatgctggactggccagagaagttttagagggtgatagaaatggaagccagatagagttgctcagatggtatgaagagaggtaatggaaacagtgaatatttctaagatattatgtcctgaagaggatcagggacatggggtagtaagtggggtagtaagtaaccattgagaaggaaatataagattaaacgtcactgttgactatccatttgaggtttataatcttgaatttaaactaaagccagacagttccattttgtgattttcaccaccaagtttggtgataaagtatgcataaaatagacttcgttttttggccaagaaaacactaaatgagacatggaagttgcgaaccacctgtgagggagtgattgcaatattgggctgctttggaaataagctagataaggatggaagtaaaaggaggagggaactggtgcgtagtgagagattggcagggataatcaaaagggatatttgactttgcaaagaagtcaaatataggaggggagaactgtagagctaggggctagaaggaccagatggaattccaagagtgagatattaggaattgaaatgtccaggtggtaatggcaagctctaggggtactcaggggggaaggaagaaaagaattttgtatttaaggaggccaaggaagtgaaagttcactctcaaaataagttggaaacccattcttatttattatttgtatttcatgaatcatctcaaatccttacttggaattaggtgatagggtgcacataagaatgatagtggctgattctttgtggatctactctgtaaacaccattttacgatgtacttttgtacactgtgtaccaaaattcttcattgccgtcaggatattcattgggatatatttggaaatgggctaattcttatgtcttgattagttgataattctcatttttttagtcagtaacaacataagacccgccatggccttttgggtaatagctaatgcttttcaggtggcacggaagacccttgcaatgaaacaactcttctatacatgtcccatcacaccccctgtcattctcttgaagtgctctagccacacaaacaaatttctaatgtgaggtcaatagctgctcactctgcctggcatgaagattcatctaaagtatcaacttctgggttaagccttttctaaaaggttgaactgtccaaaaatgccattttgaagggtcaaaaaatgtcatatactggcactttcatattgttaataatttgctaccactattacaagtctgaaccatgcattgttggtagagctattacttgctgaattggaattctgtgttatgtgctttatgttcaccatctcatttaattccagcaataaacccaaaaggtaggtggaactacttccacttgttagacaaggattctgaaatttagaaagggtctttctgggagagagtacataacaaatggtggaactgggttttaactcctaaagcaaaaattataccatgccctttcctttggtcttattcatggcaatgacagcagtacagagcacacgcctgatacagagttggaatacataaatacatacagtaatacttcatctgccagaaaactacccaaattgaaggctgctttgttcagggacccctaggactactttatgatggcctagtatcttggcattggatttaccttgataaatgttgttgttcccctgtaatttagaaagataaattttaacaggtgaaactaagagtctgaacggcccttaaaaccttaatcctgtaattactatttatttgttttaaggcactgccttgatccatgtttgccagacaggttcctaattgctggcattgaaatgatctaggaagccagtttcttcagctcatgaaaagaacatgtagatttgttgaagtgtgaatgctaagtattggtgtaatgcagtcagagggcacaggacatctatgttcatttcccaaatgccctttttctttcattcacatggatttttcctctcattcctaagcacagtggtgctctaataagacaagaagtcagttggcaagtgtaacacagatgctctgatgccttgaatttggctaatattgcttcttcattcaaacgtcattctgtagctttccctgagtttctggtgtcaaaattcaaagcaatggttgtcaaactttcgtgtgtgttcgaatcttctagagggcttgttggaacacagattgctgggtcacatccccccagactctgactcagtccatctggactggggcctcatattctgcaattcagtaaagctcccagctgatgttgatgctgctggtctagtgactacactttagctctaggggctgttcaagatgcgctttacaggacaccaaatgaggttagataaaaaagcaaaaatctcagcaaatatctgaatgctagattttacagacaaaaaaaaaaaagaaaaaaaacacaaaacaaaaaccagtgacttaaaaaataatgtatctcctgatttttgacatcagtgggctagaacttgggaatccttcttccaagatattaaggaaactttcttctctatgactttcatgctttcagtcagtatgctttgttcttaaacctatcctagagcaagatgttttattaaattgatcagttttacaatacaaaattgaaagcaaagagttttcaaaatgaaaacattccataatacaataagaattgtggatattacatacaaaagagtgatttctaatttgtttagaagctcagcaatattttcatttttattagattcaaaatggtgtgagtcatgaagatcaacacatttctttttgacaggaatcctttgtgtttgaacccaactgcctcttcaaagtggatgagtttggcttctttctgacatggagaagtgaaggcaaggtatggcccaagaagagcaagttgttctttctgctttgtggtttaagccattttgtttctcaacaagtagactgagtgctgttgatgaaccctacccttattcattcattcaagatttttaaaaatgtgcctacatgtgccaggcattgaagtatacagtgatgattaaggacattatcctcatagattccagtctaggagcaatgtcaggcattaaaaaataagttacaagtcattgaatgttgtgaaagagaacactggattgtcaaagagcttaatttaatcttgggagttagaaagaaatctgccagaagaagagatgctcaagctgaaatctaaaaggtacattaaaagtgtgttcatctcattataccctgggacttaattcgatgtatggtacagtgtccacatttaatgaacaattgagctgaatttaagaaaagaattaaagttatataaaaattagcatttttctcacatttcatgtacacacatgtatttaatgattattaacaatgttttatatataaaagtaacagattttagaaacatttttatattcagcattgcacatatatatgtctatatgtatgtatatatatatatgtgaaatggaatacttggggtcttgattatttctgattatttacaataattattgttacatggttttaattccctcttcaagctgactgtaatcagcactgccttcatcatcagaaatttttgccaagcagtttgcctgtatcataggtatggcataatttaagctcattgctgtgttgtattctctctcttcaggaaggacaggtgctagaatgctccctcatcaacagtattcggtcgggagccataccaaaggtacctgtgattggtatttgcttttctaaacacggatttacttatattggaaatggccatggcttctagagataaaaaactcactctttgtatccaggctacttaaaacatttgatctcagttttgagaatagcatgtggttgctggttgtggtaatgtcacatttattcacatgaaacctctgtgactctcctctggtgagagagaggctttgtggacaagcagaccctaataaaaggctcttctatccaattgccatattccaggtcctccaataactacaatcaaaactctaaacaaagaccctcatatctagtttctaaatcaaaaatttaggccagacacagtggctcacacctcccagcactgtgggaggcagagggaggcagatcccttgagcccaggagtttgagaccagcctgggcaacatagtgcaaccctgtctctacaaaaattacaaaaattagggtgtgttagcatgtgcctgtagtctcaactactcaggaggctgcggtgggaggatccattgagcctgggaggcagatgttgcagtgagctgagaatgcaccactgttcaccagcctgggtgacagagcagagactctgtacctcccccaaccaaaaaatttgtaatacctttcttatcagttgatttcaaggaatatatagtgttacaaatttcacctctacaggttttagaataatgctaggtgtctgggcccttatgtttatttttacattaaatgtggtttctttttaccacgtttcttcctccatgctctgtgatgtaacttatttttttttctatctgtgtacctctatacaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaaggtagcttcagttaaatggcctccttctcttccccaccatgtatatatgttgtgtgtttaattttatgcgtgctatatttttatatacttaaattgtatggtaatttaaaagttagcattgctttgctgacatgtttctgtagaaaatcagcaattaaaatacccttttagcatgtcactcctgtgggccaacaacccaaatacctactacgatatgttgtagggatactagtccagcacttctccaacttgagtgtataccagaatcccctgagctcttgttaaaatgcagattctgattcaataggtctgaggtggggacaagattctccttttctaacaagctcccaggtggcatggatactactcatctgacaactacagtttgagtgacaaaggtctagatcagtaccacccagtagaaatgcaatgtgagccacatatataatttaaattgttcttgtagctgggttttaaaagtaaaaagatacaggtaaaattaattttaataaaatattttatttaacccagtagacctaaaatattgtcattttaataggagatcaatataaaatttattagtgacatattttacattcttttgctcatactaagtcttagaaatctgatgtgtattttcaaatcagactaaccacattttaggtgttcagtagctgcatatggctaatggccaccatactgggtgggcagtacgggtctggatggttaagaaatccaaaccccccctcccaataagttattaaaatattgggttaagatcagtcttttaataccatatccagcataccattgccctggcaagtgagtctcaaagagacttctcgaagaagtagaaagcctcgtaaatattttgtctgctaatcatgtgtttacagggtgattttacctctgtacagagctcccattatctttctgtaatgtgtgtgaaaaggactaagccttcactttccatggcagaaacatgggtttgggggaatggggaggcattttgtcttctcattaaccctataattggaaactcagtgtaggttgaatgagagagggttccaacaagtggaaactcagtgtaggttgaatttctaatatcattagaaatattgaattttagagctaacaggaaatgtacagggaagatcatttgaggacactgagattacaaaacttaaccatgaatccaggataacttatggcagaattgagttctgttgacccctaaaccatccaagctccattaccctcactcacaaagtatggtcctcattccagaagtacagacccctcctgggagcttgttacacatttgagtctcaggcccacccagatgttctgatcctgaatcttcatttttgacaagatgctccaggtgactcggatgtgtggtgaagtttgagaactcctgttttgtagctctggaggcagaagtggatgctcgatgtcacataagagtgtttggttctgtccttattgtggtggttttatgctatcgttcaggtcacctcactttgggagaacagattttgcagtgccttcaagttcttttattactcttctgagatcaactccttctctaattaccaattcatattacaagaaacaggatgatgcagtatgagctcaagtattggggctttggggccacattgcctgggttcaaatccttgctcgtccccttcccagctatgtgaagcagatatacgctggacctctctgtgcctcattttcttcatctgtaaaatgggaacagtactagaatatctgctcttaggatgattgtgaggcttacatgagttatgacgtgggaagcactttgtgtactgcctttcttattgaaagcccttaatatgtgttagctattaggatgacagaggccaagaattttagagttcgaaatggaccttaggaagggcttctcacctcatttttcagatgagaaaaatgaagctagagaggtaaaggaactctgagaccacacagcaagctgggccagagtccaacctaaaaccaggtcttctcatgccctatatgctgcacccactttgctctgtgccctgagcaaatacagtcctggggagatggctcaaatcagtaaatcccataatgtttttgctttccataatttggttgctgttagtcttggcccattctaagaaccacgttctgaaacatacccttgagtagattatggatgtgtactgttggcccttgaacaatgtgggggttagagctaccatacccctgtgcagtcgaaaatccatgtataacttttgactcccccaaaacttaatagcctactgttaactgaaagacttatgataatattaacagtcaattcacatactttttgtatggtatatgtattacctattgtattcttacaataaagtaagctagagaaaaagcaaatgttaataagaaaatcataaggaagaaaaaatatattattcatgaattgaaagtggatcatcataaaagtctttatcctcatcatcctcacgttgagtaagcagaggaggaagaagaggaagaggttggtcttggtgtctcaggggtggcagaggtggaggaggtggaagtggagtcaggagaggcaggcacattggtgtaacttttactgaaaaaaaatccatgtataagtgggcccacatagttcaaacccatgttgttccatgaccagtgatatatgtttgagggttgggggtggggggatgtatacttcaagggaagatttgaaggttttctcctagtattattgccattgaaatttaagagcagctagccagttaagaactaaaaaataattctgtattggattttttattcaaactcaatactatttgagcctgctcttactgaagaaactaagtgtttcagcttctgggaactattacatcgaatttcattaatagcataatatataaataaatataaatctcattgtccaaactggacagtgcattgtcctttcggttgattgacactggagaaaatattgagtacatttttccaccaaatatacctgcatgtggatactcttgcccccttccttatctcaaaacttaaaataaccatatttaccaccttcagcattgacaacattttctccatcaccaccgttttatttctattcctctatatgtgtttctattcctaatagaacacacaagccatcaaagtgaaagtctttatatgaaatacacatagatataattacctcagttcgaaatgatggcaggatacataaatcaaattgggccaatgagaaatgtagagatttcccagggtacatgaaatagtgtttgtgactcactgagtggttctactcaaacgtgagtatagcctaggagcctagaatcagggggccatgaaatatactaacagccctcttacttagcccatgcaatgagaaggtgcatttttggtcagtttatcacaaaagtcaattcgagcaagtaatcattttttaaaattaattcatatataccttaaacactgtaacttaaggcatataaatgttgttctattgttgactaatcttttaatgttagggacaagccttttcattaattgtggatctgttgcgtggcttttatgttttggggttttttttttttttccccctgtactttactctgaatgcctcagatagccagtttggtttctttaaggtggatctgagactaaggacactcattgggcagagtgcaatggaatgcaaaatcctacagttctgtgacttttttccctaatcttttagttatcttgtctacatggaatttgagaaaaatatttttggcaacttgcctttaaagaaatcttcccaaaatattcagctagagaaacaacaatgccctttctttccacaagatcgtgtcattggtttacgcaatttttatgacaactgacaataaataggtttgaaaacaaaagtaacccatggtagacatgtaaggtgagagtaaaagagtacaaaatattggaaagtggcttgctggctgggagagtccagcactccctgggcaatctgtgtattttgtttgtcttataaacacctgatgagtcttggtctgacaagtgaaatgtaagttaagtgagtttctagtacagaacttgcttatgagtatcctatgagattcatgagtctttttttttttaattcctaggctcttattacacttaagatctgaccatttggaataattcacttaacccaacatttaatctaggcaaaagggtaaactttgaacttagtgtcttttataccaaggaccatgttccatgtggaggaagctttcctgactttcagcaagccattttcccttctgtattcttctacttctcaaagagggtctctgatagtttttttttcatattcaagtgggtgctttaagagtcaataaaatattatctgaaacctgagtttctcagggttgaattttaaataaatacaaaatactttccagtgcatatgactctgaaaatatgattgtgcttttttcagtaaaagataacagcattgttaagagacaccttggtagctcaccttgtcttttcttcagcttctctctctgctttgagagtaaatacgtttgtgttgccactcttacctatttaggagatttgtgctcagttctatatacctttctcctctaccggtaagtcccaaatcaaagctttcaactcttctcacctgcttctcccacagtcattttcatctcaacaaatgtgctctcagttgcagagaccattctcagttgcagagaccatgaacaccttcctcttgtgtcctatgttagtctgttcacaaatactgtttgctctaccctcagcaggtatccagaatccagctgctcctcaccaacgtcatcacgacacagtggcccaggccaatggtccaggccaatatcatttcttccctattgtgccccaagaggtatctaactggtctcttttccttagccttgcccattttggtctagtctaaaaacagcagctggagggatgtttttaaaatgtaattcagatcacatcactccactgctcagaaccctccaaggccctgctagatatcatccccacctcccttcccctttctaccttaatctctctctttcctcctacgcattttcttccagcctctgggacttggcatttgctgttccttctgtctgtatcgtgctctttcccagttacacacagagctttctcccccacagccctcacgtgtctgctggaaaattgtcttagcaggagctccccatttcaccagccttcggcacttcctcactccttttcctgctctgtgtttcttcttagcacgacttacttaccataatatccatttattcatttattttcttcctctgtctgcaggacggcactgttctgttcactgctgtatctgcaacatctagaactgtcagtgcccgacacttagtgagtgctcaataaaaacctattctattgaggtatttatgttgactaaatgaattccaacccaagtgataaaggtgtataaaccttaatgttgtgcaactcaagtttgtacagttcagttgttagaacagacaggaagatgatcctttgacaacaagactgagaaaatgtgattcaatgatagtctaaaggaaagacagaactctgggatcccgtgtgttatttttagagccacatttcaggatgtaatagcgctgctgctaagaatccatgacgagactggaggttttgaccctggtgtcctggcctctttccagtttggatcattatgtcctgcttacctaaatccttcctgtcgttacagttagagaatttagctttcatttcctctcctaaacaactgcctgttaaaaagaattactaacaaattgctgtcatatttaccccaaacctagtacacctttcgctaataggcgagtcttatacatcataaagcttaaaacagttaagaataaatgcagcctactaaaaaaaaacaaaaacaaaaaatttacccagtgtgatggcagatgcctgtaatcccagctacaccagaggctgagtcaggagaactgcttgaacccaggaggtggaggttgcagtgagccgagattgcaccactgcactccagcctgggcgacaagagtgaaactccatctcaaaaaaagaataaatacagccaaatgaaggtattttcccatttttttctaaactgaaataaagctcttttttttttcctggaatcattctcatctttttgctcactgttttacaaggcactatagaaataattgaatatgagcattctaataagttaatttcattagaaaagcaactttagttcctctcatgttttcttttgttttttcctcgctcagaatacaactagcttggaaggattttggtgtctagcaaagttgaaggcagttcagatgtctttcattaataagttacagctggcactgcacagcaaactgaaatcacagtcactagacgtaagatggaaatgcaggcctcattcaacatctccataaataaatctgttattctataccaagttgaattttcctttgattacaaaaaataagctgttattatgacgttcaaaatgcaaatattgggattgagtttagaccagactgctcattatactttatgcaggtttgtaaatatttggcaaacttcataaattatgccttgtaatcaagtcatcaaataagcatgtaaataactactatagaaattaaattacaaaaatattatgtattcttttgtgtacaaaaagataaagtcaggttatttgttaccagtaataaaatattattttaacaaattgggctgaaagtcaaaattgctttgctaaacttgaattgtgttgagtgaaagacttactgcaatggttccagaagaaggaatttattctttgtttcactaaaaaaaaaattgattctctatttaaattgagtcctcctggctttgctaacatcctgcaaagcctccaagccctgcaaccagttcctctactgatatttaaccacagcattaccccaagggatcagaggcttcagcctcgtctggggacttcttagaaaggctattgcatttcttaaaattcagttttaattatactgtataggccagtggctctcaatacctgagaacttattagagatgcagattcccaggccctgccccaccctactgaatcagaaagctaggatttcagcggccttccaagtgattcttatgcacactcaagttagagaatcactgctaagcagaaaagctcaatcactaacatttatatcctgctttacttgcagaggccttaaagaacttacattaacttagtggtctgatgcccaggctcaactgagctgatgcctgctgaatactaaagcagctaaattgtaaatctgaactgcctattgatcacccaaaccccagtatactaattaataaaagcttcttcaccacattgcttcaacagtttttgaggctcaaatgtgggatgagtgtgtaggtctctgtgttaatttttgttttgttttgggtttctttaacgtttccaagactgaaagttgacattttcttgttaattgtttttcttgaagctcttctgagttcattggaaacaaatcaatgagggggggcattaagctgtccggagtgcagagctgtgaatcagaacaaataattgagtgcatattcttaagtttaaatgtcccatcccacctaagagttttctttttgccaaataaggataatgggttttattgttatttctattgctgggttgagtttacggaccaccagtctctgccttacatgggctgtggtcatcagagaatctgtggagctggtgaaatcagtctcctggggcctcccatgaccacctttttcctctgtggctccttcttccttgcctgccagttctcatttgctcttgcaagaccatctctcctagcagctgctacctcagtgtctcatccgtgatggcgctctctgaactctgaattatttatttgtgcatcaccaaaagtgatagttcctttagaccagattttgtgaactcagatgcctgtgggagccagggaaatgatgtgaatagctgaaaacatgtcaggcaaagacaaatacgggagggtgtggactttagcaagttggagtgcacatacgctgttgaggggggcactttcacttatttccagctagttttccaactaccaaaacatgggcctgaggtttctagattgttttcatgtccatttaatactaacgtggattttttacatgaaatctcttgatattaaaatgttggcaactcattttttaaacattgtgcaaaatgacaaacatgtctgtggatcatttagaaccatagctatagacatcaggcaccatgtagcattaacacacttgcactaaagtgaatgctaatattgacttattgtgttcaccttattggcattttaaatgaaagatacctgtttgttcctttatttcttcattcagctattcatccaggaatatttttttgatgaaacctgaacttggacaaatcatttcaattatattaatctttttaatcctcatttgttaaagaaaggaattgcaccatgtgtcctttgaagtcactttctcttataagacttaaggaaggactggctgggcatggtggctcacacctgtaatcccagcagtttgggaggctgaggcaggtggatcatgaggtcaagagatcgagaccatcctggctaacatggtgaaaccctgtctctactaaatacaaaaattagccaggcgtggtggcccatgcctgtagttccagctactcaggagactgaggcaggagaatcgcttgaacccaagaggtggaggttgtagtgagccaagatcacgccactgcactccagcgtggcaacagagtgagactccatctcaaaaacaaaacaaacaaacaaaaaaacttaaggaagcactctctttgcaaaataaagtgtaccaggagccaaggatggtccaggttagttgctttgacaggacacttgtgtacacatggaaatccctagataagcttaacctggactacatcatcatgacaccaggagtcagctactaggataggaggctttgtggttggagaggtgacagaagtcattctgggtacttcctgtggacattaaaggttgagagatcctgagatagaatgcaagaaaatcagttgttctcggcttcaatcagttacacaagaaggaaagatctgagaaacattcagtgtggaatccagaggttttgttcctgggtaaagttagagaagctaaaatagagaccagattctgattctgattaactgggagtacgatgatacagctaatcagaaattgagggtctggttactttggatcagggagaaaaaggaacaatgaatttgtttaaatttttttctctgaggaacctgttagttgcatgacctgctatgggtgatgcaataggacagagatcatatactacttaggatccttaggggcttgtccatggggcgagctctgttctgtctctgtggcacatctctaggcctctgaaatcctgaaaaggtctacgtttgtttgtttgtttgtttgtttttgaaactccctactttcataaggaattaagtgtggatttttagctggcatttttcttagtgctggacttacttaaaagctcctggtcaaaatgattcttcaggaacatgcagctgaagctagaggatatttgctgttgttttcggggaattttgtcacctgtatcagtgaagttatttctttggatgagagtatcaaagatgaaagaggcctcaagcctccgcttagctcccaggttctctgcagctgcactgaccatgttgacaaggtcatttaaacatttgcatggacagtgtgtttttatactgttgactggtatttcctgaatgctaaaggaatgttgctcatgatagaggatgtagttgcatgacattctatgcagaaagtacaggatagtaaaaaaaaaaaaagaaaagaaaagaaaaagaaactaaaaatcccctagagtgtatttccccttctgtgtcttttcttaattcaagtgaaatttatgtaacataaaattaaccattttaaagtgaacaattcagtgccatttagtacattcaccatgttgagcaagcaccacttctacctactttcaaaacattttcatcaccctcaaaggaaactgcatgcccaataagcgggttcctccccatcccctctccccacagcgctgataaccactctaatgagtctttttattccccacacactttcctttttatatgcagttggactcatgctgtttaatatactgcattttattatatgaattttcctgtttaaattaaaactttttcttaggtttcaatgtaaccgcaaatccccatgatctgtgaggtggattttcatgggcgctcagctcttgctgttttagaaatcatccagcctccttcacagttgtgtttgaaatgctgtgctcttcatggggcacatggttttcagtgctggagcctttctcaccactgcatttcatgaacttgacaggtttcataagaagagactgtagacccagcccagagaagctcattttgtcctagttgcaagtgttatcaaatgactccaccaagggaatgcaaaatgaattactctaattgcactagaagcataatgtgaagtttgtatttcaccttttggcccctgggagagaaaaatgtcactgactttaaattgcttttccattttccacatagccccagtttccagtgccagcaaaaaattgccattggaaacataatgtatgctgacatgggcctacatgtatttgtatgttttctcatctgtgtggcaaaattaaaaactggatggcatgaagaagtgggcagaatcccttgtattacatgagactttgttgcctccaagctctatgatctggagccagtaatttaatgatcataatctggggtcggcaggtgcaggccatgggctgaacacaacccttagcctaattttgtatgtcctgtgaactaagaatggcttttacatttttgaagcgatgtttaaaaaataaatttaaaaaaaaaacaggaaaactagacaacatggaactatgtgtgcccctgaagcctaaaatatttattatctggctcttaatggaaaagatttgctggtctctaataataatactaataatagtagcagcagcagcaggaaaatagtttatattgtatgtcagacactgttcaaagtgcttgatatgtattatctcatttaactctcacaagtctgtgggataggtattatgattatcctcattttacaaataaagatgcccagagaggttgagtaacttgacttttcaaggccatacgtccagtaagtggtgttttgagcccaggcagtggctctctctagtgctctagatcctgaattctaccaccaccctgtgctgcaattcacagttggcttctttttctttttctctttttttttctgaggcagagtctcactctgtcccccaaggctgtaatacagtggtgtgttctcagctcaccacaacctctgcctcccgggttcaagttattcttgtgccttggcctcccaagtacctgggattacaggtgcatgccaccacgcccagctaattattgtatttttagtagagaccgggtttcaccatgttgaccaggctggtctcaaactcctggcctcaagtgatccacccacctcggcctcccaaagtgttgggttacaggcgtgagccaccgtgcacagccagttggctgatttagcttatctgtataaaaactggggcagggagtggggggaacagcctctttcacctgtaacactgtgtgatgttaatgtactttttaggcaaatgttttaagatcattatctgtgggagctatagtcatacagtagtacttcccgaattagtggcctgaaaaaaggattccttaaaaaagtccacatataaagggggttctttggtcagctaagcatgagaaagcctttagacaggtttctttatggtagtgctttcagaagaagtatttcttttttttttttttggaggagctgggtctcagatatatttgagtcttagtgctttactctttttttttaagttttagggtacatatgcacaacgtgcaggttagttacatatgtatacatgtgccatgttggtgtgctgcacccatcaacagaagaagtattattcttatgtggatctcagcaaggaagaaagctattcagctgtttcctaaactttttttttaattttttgatgagacaccattaacatctttcagaaccagtgtggcactgaataaaagtcagtaaattatatcatagaggcattattcagctcaatatttttctagaagtatcaaaacaatgatgtaatctaaggattcatttattcatatttaccataaatattctatttattttccctgtttttccacttccacttgtcttcactcctcactgttttctgctgtgtgtggggagactttaccttaaaagacagagaaccaggtaatgaaactcaagcccaccgatttagattccttttagtagctcttatattgaaagtcctatttagtttatagaattacctatagatttgatttgcttgaactaaattggtggatgctgcctagttaagagttagacaaaggcttcttgattgattatattgatctcagactaagcaggtatgattgtcatcaagttgaaatactatttactttggcatgacttaatttgccaacattgtcaacaggtacctgtcaggaagaatgtgaccgataaatacaggccatcaactaaagaaacaactctatgaacaccttttaattcaccagctgtttactcatcccataccaacagaatttcacaaatttgactgagttgagtccaaaagtaatgctgtcaaaaaactgatggttgctgactggcttaagatgatgcttttggttttctcaacattttaaaatccctccattcttctagagctttccatttggatgccaaataatgttacataaaataaaccaaaaatcttattttatttttgaaagatttctggggatgtaggaatgtagttggtctgtggactttcaggcactaaagaacatcatgtgttgtatatctaaatcagaagcacaagtgaatataggcattaatgtaagtatactctatgtatacatttttccctcctgatcttttgtgtccataacagtatatttattgtagtagatatttggaaatagatgcagttatttgtgacaagattctatagatccaataggacattgctacagggtatctattaatatatagaatcaggcttaggcaatgcaaaaattgtgtctaaggaatgctaacaaagccatttggtatggaagtttgggactgcagcttctgaacagcacaggtgtcctcttttttcttgtgactatttagaggctctttttgacctaactggccagtgttgtcaagataaccagcaaggctgatagactgttttgactctctgggagtgactaaattaattttgtctaggaatgtataaatattatcctcacccattcaattatctctttcaaacatagccacccatactcatagatggcagcttatttcttgcacaaatactcattcaccatgctctgagggtaatttaagaatcatatgatttaattttgtctaggaatgtataaatattatcctcacccattcagttctatctttcaaatacagcctcccatgctaatagatggcagcttcttttttgctcacatactcattcagcatgctctgagggtgatttaaaaatcatatgacacttaatatatttcttctttcactttcatcaattttactctgtagcttcagactgtcaagaaaaagaggccccagttgctctctttttccccctttcaattcttctcttttagaatttgaaaactttatgaggattattattgacttcccaagggcttttgaaattaatgttgggttgtctttttaatttttgtgggggcaaaagtcctgttgctttttagccaccagtttcagaagtaggttgctgtcagtcattatcacaggctcactgatgtagctttctatcctgggtttatcaactggacttgtgtaggatggcagcttagctcctttattatgcaggaaagtcttcactgtcttttttcttgcactcatctttcttgcagcaacagttcatggtgaattgccctcttgtcccatgggcatgtgggcgtttccaacactgacattgatatcttgtgacactaacacttagtacctgcacttgtctgtccttggtggagccaggagaaatcagctgacatgaaagagagaacttgtttaatttttacttcttaacatgatttagaagttggtctgttatacaaacaaacattagtggttttgttcctttttaattttaggctggatttagtgtcctagatgaatacctttgaaagataaaatgttcatttgtcaagtcctgcctgtaccatcagcttctccactctccacctctgccactggggttttataattcccaggcctcagacctggaccaaatgctgtgggaatggggactcaggctttgggaacgctggcccttagcctctggctcctcctgctgctctgctggctctggccttggtccttaggtctggactggacagttggtggcccaagtcatgttctgatataccccaattttaagaagtagacctctgtctggtttctgtactggcccaagtcatgttctgatcatgtaccccaattctaaaaagtagacctgtgtctggtttctgtactgaatcatctggtaagagttatcccaagaagcccagatcttccagaccagaactatctcaagcaggaggagctgtaacttccaacagtcttcctctgggccagctccctgctgcctgatgagatcctggaaatcaccagctcctgaatttcctgtggctgtgaaatatcctcttacccaacctccctgcagctgcctgcattgcttttatgttgcctgtaactttctttcaaatacttcaacacatgcagtggggtgtgtgtgaattttcatccaaaaccagggaatgagaatttaaaattttaaatgctcaccctaaaggtagttagttagcgtttgaaaaatttgaatcaaagcttaaagatcaatcattatatataaattatagctcaataaaattaattcaaaataaaataaaacaagcctaccctccagtggccacctacacacccccttcagttaattttctctctcattagcaccaggtgctctgatactagcctcctggagtggtttctacatgatagacacctggaggcttgttaaaatgcagattactgggccctgcccccaagttgctgattctgtagatttgggatagggcctgagaatgggcacttccggtaaattcctatgagatgctcaacccgctgatcaagggaaccacacttgagaacctctggcataatgcagactggaactaccttttctttggtggagttcttcatggtattcaagatatgcaatttgtgtagaaataaggtacaagccctggtatccttgtgagcctagggcacaggaatctggcaagcccaaatgcctgcctggtatctgttggaagcttgttagaaatgcagaatctcagtgcagatgccaggcttactaaatccaactctgtggttcacaaatgcccccaggtgatccaaatgcacattaaagtttgagaaacacctgcccaaaccaaatttagttcacatcatctagttcaattgtcctcaactataggttcacgttagagttacctgcagtgtttaaaaaagcagattgaaagacagcccaagtacattctaattattagttagaatctctagggtgagacccaggcttctgaaatgtcttataattcccccaggtgattctaatgtaccacaggtgctgggaactaccagtctagtctctctaagtgctatccgcatagttcttttaacagtgtactagctggaaatgtcttccctttagcctgccctcaaagttaaatactgacaatttaatgccaactaaaccttctcctaattcaaatgaaatgatttcatttgccatgctttttaaaatttttttattttttatattttgtattattattattattatacttcacgttttagggtacatgtgcacaatgtgcaggttagttacatatgtatacatgtaccatgctggtgtgctgcacccattaactcgtcatttagcattaggtatatctcctaatgctgtccctcccccatcccctgaccccacaacagtccccagagtgtgatgtcccccttcctgtgtccatgtgttctcattgttcaattcccatctatgagtgagaacattcggtgtttggttttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcaccacactgacttccacaatggttgaactagtccacagtcccaccaacagtgcaaaagtgttcccacccctccacatcctctccagcacctgttgtttcctgactgtttaatgattgccattctaactggtgtgagatggtatctcattgtggttttgatttgcatttctctgatggccagtgatgatgaacattttttcatgtgtcttttggctgcataaatgtcttcttttgagaagtgtttgttcatatcctttgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgccatgtttttatagactcataagaggaaacatgttggtggtgatttatctacagtccctatttattttagaatctgaggcactggctatatttcatggcaagctaaaactcaaatgccttcatgaaactaaatttctagcttaagatgaaggtgtagttcctgcactgaatagccttcatctgtagatttgtgaaatgttgcagttttacatctaagcaccttataaggaattctatcttagacaagattagatcctgtggcaatctttatttgaaaagcttcatagtttgctccaagtgcatggaaatgtgtcttatttctcttgaatgccctttaggtcttaacagaattcacagtgccaaggagtcaaaaactatatttcaaattatatacattcctgacatattatttgagcagattaaaactgatggatagagcaatttaggcaccttgaaagtagctacttgaaaaatgccaactttttcttatctccattcacttaaacaaaaatgggccaggtgcagtggctcatgcctgtaatcccagcactttaggaggccgaagcagatacatagcttgagcccaggagtttgagaccaacctgggcaacatggccagaccccatctctgcaaaaaataccaaaattggctgggtgtggtggctcacacttgtggtctcagcttctgggaggctgaggtgggaaaatcatctggacccagggaggtcaaggcagcagtgagccttgattgtggccactgcactccagcctgggcaacagaacaaaaccctgtctcaaaacaaatagaaaagtaaaacaagaaaacaacaaaattaattgatctagatttgtgagttgtcgataccaagaagttcccatgttttaaatatttcagatggccccgtcattgattattctcacagctcagatatagggaagatgaaagctgctgcctatagcatcttgcatcctcttgcttccacatacaagaaatgtgaacttcaatcccctaaaaaggtcagagtttccattctagtgaacacatttgttcagcccaggtggggtgggacatgacaaaaaccaagagtgggtctagaaccatggggctcttcccagggctatcactatgagatagaatatcctgtgtgtagtcactctcagaaacagcagctcccttaggaaactgctgtgtcctgaatgcttgtgtcccaccaaaattaataaactgaaatcctaccctctaaggtgatggcattagaggatggggcctttgggaggtgattaggtcatgagtgtggagccctcaggaagaggattagtgtccttattttaaaaaggtaccagatagcccccttgccctttccactgcatgaggacatagctagaaggcactacctatgaactagaaagctgccactgaatctgttggcgccttgatcttggattctccagcccccagaactgtgagaaataaatttctgttgcttataagctacccatatattgtattttgttgtgtgtcaaacaaagacaaaaaccaaactcacatcttatatgggcagtggaaggagaactccaagttgaggggggctgctcttttagacctatgattctcaaattctaatgtgcacaccagtcatctggggatcatgctaaaatgcagattctgattccatggttctgggatgagacctgggactctgcattcctaacaagctcccagatgatgttgatgctgttggtcttggggccctttgagtagtaagggtttgcaacagtgcttcttaaatgtgtgtgtgcaaaagaatcacagggaaggctgattaaaacgtggattcctatttcccatcctgaagattgattcagccggaggcctgataatttgcattttaacaagttcccaggtgatcctgatgctgctggtccccagactacattttaataacaagcctctagttaacttttgaacaacttaattaagataccttcactagtagcctcttctgtgaaaacagagagccaaacatcaaaagatgaaggaggatgctactgagtccctttggagaaaattacatcacaaacttggagagtgccacagggtctctgttcatttttccattgacaatatgcttctttgactaaagacgaaaaataattcttcaggatcaaaacctagagataagattggaaccctaagattggaagtagtgctgcctgatgaataataggactagttattttaggatgacgggccagcctgtgcctagtgaaagcttagaaatgccaatagcagactgagcacggtggctcacgcctgtagttccagcactttgggaggccaaggcggacagatcatctgaggtcaggagttcaacacaccctggccgacatggtcaaaccccctctctactaagagtacaaaaaaaaaattagccgagagtggtggtgggcacccacaatcccatctactcatgaggctgaggaaggagaatcgcttgaacctgggaggtagaggttgcagtgaaccgagatcccaccactgcactccaacctgggcgacagagcaagactccatctcaaaaaaacaacaaaaaaaggaaataccgaaagcaaaatgttattggtggccaattcttaatatacgtcatgagatttggggtgatgtttacttcttactgtgtatttctttgctttacactttcctatgaagcatatttaaatattgttttcataaactgggggaaaaaccctaaccaatatttttaaaagaaaaaagtaaaatatatgctcagtgtaagttcatagtatttttggtttgtgtttgttgtatctgtgtctctctacgtttgtattttcatgggaaagggattatttttgtctatgtcagtcctaatgttcccggggcaaaggtgatagatgggtaagagcaaggtctaaacatatgcctggaagttggacagggcctggggtggtgaaaataaatttaaggagtcccagaggagaggtcaaaagctccaggagagaattagaggcagcttctctttctctccttgccctccaaacaattcagcacaagccctcaagtcccttgaagagtctttctttcccccttcttcttagaagggctgaaacacactttaagttaacttaggaatggttagaaaaggttaaaaaaatgggagaacagtagcaattaacaagctgctagggaaacagggaaaccgtgctgatccgaacatcagagccgacctcctgtggtctggttccctagcacccaggctcaggcttcggcttggggtggccggaccagaaggaaagtgccccgtgtggcagaagtcatctcaggagcgtgtcgccatccagccaatgacttgtgttccaaggactggaaaatgcgcttcctggacactatgtagatgattaccacacgagcttattttcagcaattcaagaaagaatccaattcgtggtttattgcttctgttagtctggaaatggtcaaacaagttgataggcatctagttcacgcctggcgtaactttccaacaaaactccagggctctactgacacctgctggcatttcatctactttatgttaaaaaaaccccaacaagacaaagaatcattaatatttttcctgcagtcctttgcccttgttatgttacttgtactttacctgaacgataatagaaggggcctttaccatgtcgtgaggagagaagtgtgggcaagccattgggtgaaaataaaaatccccaacacgaagaatgtaccacagagctcttgttgcctgtctgccctgcaccagctgctctgtgaccttaggcaaggccattgacctcactttcatcattgcaagaagaaagaggcagcaaccttccctcccagttccctttagggcttctgaggatgctggtggcatttcctactaactaaagcatgggccctgtcactggagtgatggccttaaaggtcactctcactgacctttccatcacaataaacaagattccttgccagcgttgtatgttcaaaagatgaatgaaagttatttaagcctcttcaaagtgcaccatctctgtaatttatttcgacaaacaactaaattagaatgatcagaaaaagcccagtgaacagtctcagaaattgtccactttttttttttttgtctaggaaactatggactttgttttgtgttttagaacatgtagtaagcctgcaggttgagaaaatgcatcccagttaatgccaacccaattatttgtgctttttctgtctattcttgggaaactctgtgtgggcctgtggtttgttaggtcaataacaggatatttgatagtctgcagggagttatagtccatatttagcctgacagaggaagtgagttctgctgatgaaaaataattgaggcatttctttaattctactatttcatttcttcatcttccttcagaatcctgaccccactatgatgcttgctgaggctttcgatgctatttacagctctgcttttgctagtcacaaaagaaaatttacctcttataacccctaagtcttccctcagaaaactgttaggtgtgaccaggatcagcaaaaactgttagattcacatccattagtttggctactacttaaaaaaagaaacaaacaaacaaaaaaacccagaaaatatcaagtgttgttgaggatgtagacaaattagaaccctgagcaaaagggttcccttgttgcatttgcagtcctttgttggtgggggaaaaatggtatggccacgatgaaaaacagtatggtatttcctttaaaaattaaaaaatagaattactatatgatccagaagttccacatctggttatttatccataaataagaattgaaagcagtaacttatttgtgtatcaatattcatagcagacatgcaattcacaatggacagggagtccatcagaggtgaatggatgagtgtattattcagcctttaaaagggaagaaattccgacacatggtagagcatggatgaactttgaggactttatgctaagtgaagaaagccagtcacaaaatgacaaattctgtatggttccatttatatgaggcacctagcatagtcagaatcacagagacagaaaggagaatggtattaatatttatcaatggctgggaggagggggagatggggagttatttaatggatatggagtttcagttttgcaagatgaaaagagttctggagatggctggttatgttggttgcataacaacatgaatgtacttactgccactgaatttttcatttaaaaatggtgaaggtgataaatgttatgttatgtccatttttaacacaattaaaattaaaagaaaggttaaacagcaaaaaacaaaacaaaaccatactctgttagaacgcagtcatcacctttgcccttacagagattaaattgcttgactttttaaaacctggttctactgggcagtgctgtccaacagtcccatctgtgatgatggaaattatctgcactgtctgagccatcaaccccatgttgatgtttaagcatgtaaaatgtgattagtgcaaatgagacactgaactttatatttattaaatttaaatagccatatgtgtctagtggataccatactagacagtgcatatagagtatacgtctatattactatctattccaagatatttttccttcctcagcactaagccgcaaatctaagcagtcaggctgtaaacctaagaaggtaaggaatcagcttatgtgtgggccaccgttctatttaacccaaatgtcaatttgctacgaagtgttttgccgagggtatgattcttctatggcattcattggcatcagtttttggacccaagggcagagttggccttaattcatgggctgagcttttctagtaaatgcccttttagagacccaaattcctctactgccatgcacaatttcccttcacttgtccttgtaaaacagtggagtgatggtatgaactacaagtgaggtccaagtccttatacagaaattatgtgagcacatcgctgtttgctctgatcaccctggcaatgaaagaatgtttttctttttaaggctttgctggaaaacataggtaagataagtaacaaactcttagattgaaaggatcacacaataaaattgatgaacccctattcatttatcctctaaagtgaaaatagttaaatatgtcatgtattttataatgctggttggaaataattaagattgccagcaactgaaaaagggcttatatttaaacaagctgcaaatagaaagcttcacaagtcagtcagtgggcaacattcctttgtggcagcccagagtttaatggcacaatagatggcacatttgtcttcatggaaagaatgaaagctgtttattaaagaataaaatatgagcctgcaaaatatagatggctgtgtgacaggaaagggacaaaagaagagtttgtgtttttattacacaaaatggatacaatctatctaataaaaactgctctatttgactccagcagatttgctcaccaagaatattttttctttctctttcagcaatgggtagaaggcctgagatcaatcatacacaacttcagggccaacaacgtcagtccaatgacatgcctcaagaaacagtgagtgttgtttgcattactcgtttttcttggcagttatcaaacaaatggtcagatgaagagatgaaggctaggtggttccttcctccaaattcctgcttgcctttccctccatgctcctgaccttggagttgaccaacacacacctgtactcttcataccacgtagaaaggcatgcatgataaacccatagcccaaaacctatatgaaaagaatagttgatggtcaaaggacactggaacctcagtcactctgtatgctgtcagttgtgggtactggcttttgtgtccccagattgagttttctgatagacagctctgcatgtctggagccatcgctgagtgctggggtaattctatcctctgctgcataaaactgagaaatgaggagtgtgaccaagagacgcacttgccaatgcacctgaaaaagaagcctcagccccaagtgcagtgctccttgtttagcacaccgtcagggatccaaagttacctctgaatttttttctgtaggattcagttatttaaagatttgatcaaggatccaatggtgatttccaaatttattttttccatgaaagaaggaattactccagcttacagtatctgaaatccagaggagtactacagtggtagatttaaaccctacccaagttaacctttcaaggtgacatgaaaatcacccacaaaggaatcctagccaaagtcaaatgtcagccagtttgaaaagcagtgatccgtgaaggtgggggccatctgccttcacagggccattggcaggcagttgtgaggtgccaaggggaaccatgttgagaaattgcagggataagcctgtatctctcaaaattatgccccagcaccaagagtgtgattcatcatactcacttggcaatgggccaagaggttagtcctaaaggtactgtcatgtcttatcttctggtcattgtggcaggtgcttacaggtgtggtctctaggctataaatcccggcttcaccatggcaaattcttacacttgtgcctcactgtcctcatctgtgaatcaaaattaccatgcagatgaaattggaaagtattctttattcaatactacttatcttgttatggtatccctccaattttctttcacccttttagtggaggaaagttatttagtcttatctatttctatgtgttgtgcagctgcttcttcttttcctctgcagttgccctggcatgtgtttttaaagagaaacccagtggatattctgatgttatgacttcaggcactgatagtcctaaagggtcaaaaacttttagaaggcttgcttatacctgagtgacacaaatatctctatctgacatgagatctaacaacatcctgcccagatccctttatgaagctggtgttcacccagccatcatctgccatgagaatgggctcaccaagggctcagacctgtccacttcttcagagcattgccctctgctgaaggggagcttccattcctggaagattatactcttccctcctccaggaggaagtccacagccaatgatgagctgcaacagggtacagaaggccatccctcttgccgccaagtctggcacaaatcacatgagttcaagctaaatcaagctccatctgaaaccacaactttgtttaactcttttttctgctcagtcttctctcactctcttcatccctaaaacatcccgttattaaagtagttagtggtgcttctacgaaacttaagacagaaactttactaaatcatcatgttctgcaaattgttagcacattattgattggaaacaggaagaatgggagtcattagctaagaaaagtcctagctccaaagtacagataaatgttctgagtctcctaaaagcctggggaaagcaaggaatttttcaccatcaatttgagttgatgaactagtcttaccactggaaattaaggaggcgcccatgtgatcagtacttggcagcactaggagctgggagtgatgagtcctcatgaattctcaagacaaggctggctgctgtcaccgtgcagttgcatttcccaccaccttaatatattattacagagcaataatcgagcagaccaatcacaaataagtaccaacaatgtgttttgctcaatggaggcacccagtcatctcatttagctagggttgccagataaaatagaggacacttagttaaatatgaattttagataagaaacaaaaatattttagtataagtatatcctatggaatgtttggagcatacttacagtaaaagaaaattacctgttgtttttctgaaattcaagtttaactgagagctctatatatttatgtgctaaatctgacaaccctaaattcatcttatagcacataattgtctgattttcagaaccaatgttcttgatttaaatgaactttcttttaaagttcttaacagaattgaagctgctccctctaagaaacattaaggcaatgttattgctattgttttgcagctggatgaaattggcatttatgaccaacacaaatggtaaaattccagttaggaggtaagtaatcattcctatctgctgtccgtgtcccgggtcaacgcttgtcatcccaaaccaaagagagaacccttcacaagtatttgtgtgttaaatgctttaaagatatttctggaatcttagtttcaattgctttgacaaatgctatattcagtttgtaaaaatcatttatggaagtaaaactgcatttttttggtcaaaataggtggcaaaagaggtactttgacaatttaaagaacatcagaaaatgtagaactattttttaaaatcggcaaataagtggtttttaggatttatgtttcttttgcttatttgccatgagaaactgttagctaaacttaaagaagattttattgtgcacctactgtggaagggtgtggaccgtgtcttgagaagtgtgatgcctctgaacagagcattttcattctgggctttgctgctcctctggtgctcagggcagatggggatacttctctggcttcgtgctgcctactctctacatgtactgtaactgacaccacacactctgtggagctatcctttccacctttgccctgatgcaggtaacaatgacaaagaataaaaaggcttgaggcagggcatggtggctcatacctgtaatcccagcactttgggaggccgcagcgggtggatcacaggtcaggagatcaacaccatccctgctaacacagtgaaactccgtctctactaaaaatacaaaaagaaaaaaaaaattagccgggtgtggtggcaggcacctgtagtcccagctactgggaggctgaggcaggagaatggcatggaacctggaggcagagcttgcagtgagtcgagatggcaccactgcactccagcctgggtgacagagtgagactccatctcaaaaaaaaaaaaaaaaaaaaaagacttgagtggaatcaagaataaagaaaacatggacaggatacatcctccacatgtgttctttaatacttaagtggacagatttcaccctctgaggattccccatgcatccctcttttctgcttctcacttccttccaggggttagggtttacacatggtctctgggtacagttggaaactctttccacagtagtgatgggaattctttaccaaactcttcagtacctttttggttggtgtttgttttaagcattcatggaaattccagaagctgggctgggccccagggcatctgcttttcacatgaagacaggcatgtatctggattcgtgaacctaagcccacaaccagaatcaaacatgggttccccagatgccaactctctcttccagggttctccagactcaggttcatgttcacttctctggacaccactttagcaaatacgcaaatcaacaaataataacaaacaaaacccagaactactgggtggaatcctgtcttagaattgatctgtctttcagaaataaccaggtcaccgagtgcgtagcatctgtgtggatgcattgagcagtggcatgtgctgtggctcctggcatttctgactctcctttgcctccttccctgcccagctgcttcattctgctctgcagcttccattctgcatccctgtgagactatctccatactcccttgacattactcttttcatatttaacagaattgtcccagaagacctcatttttctcaatcttgtatattaaacaatcacgacctaaagtatccatgtgaccacttaaatatcgagaaaatgtaaagcacagaagtcatgaagaccttagacaattttttttaaatttaactctttattgagggcttgttgagtcatggacctcatgcatttgttgtggtctttccaaatctatctgtaggattctctgcttttatttaataacttgctagcaagtcaacttttagtctgctttagaagattgaaaaaagccctgttagcagccttgactgatggttgttggcagatactttatgcttatccttatttaaaatcctttgctcagttgagtaatagcagaacaattattttaatgtatcccagtaccctacagctattgcatttttatttaaaatcagagagcacaaagcagtgtgaagaatagaaatgtaggttggatgtgtttttacatgccttactatcctgctttttcttccaagatgaggttcaggaaatgggcaaagtagagacacatagattgtgatcaaagcacttctaaccagcagtcttggtttcatttgtatgtatcctatgaatcaagtcattgtcatacaagctttgaagtcgtttctgattccagtgatttttatctaacatgttcacatacaaaattattaccacctttttgtagaaatagcttagatattttggcatcttctttagctctctttgacatggactccatggtgcttgccagtattaacaggtgtttgacacaagacggctgtgatttgggggcagtttgttagagttgatggagaattgataccatgccagaaaaaaaatcagataactctattggtgaatgagctgccaagagttagttggaaattgttgtgtatgttttaatggatatgaagagtaaacacttttaaaatgttattcactatcattctgaagtttctaaaatggaaactattagtgtactgtccataatattaaaagagatctggcttcatagtgattacatagcttgggaatggttcctgctctttagcattaaaccaaaatttaatatccaggaagttgcaggaataacacatgaagaaagtcttaccttttgtctccctcttctcttgtcttgctgtttacataacccatgcagtctgcctttctctcaaattcacaaatttacactcagtttatcctcccactcagaccaaagttttggaaatagcaattctcttttgccaccttccctcctctctcgtaacctggagtgaacaccaatgactagaaaattgggaagtgagtagccagacagtagttgtgggcaggggctggaagagatcccaaacaaaacggctgtgttaaagaaggctgagagccgcaggtgccgtcttggaagcatccctatataatcagcccaaccatgtcctgaaggcccagcagcccacgaagaaggtatgattctgctggggcagttgccccatccttcactcaagagttctctgtaactttcagaacacggtgttaaaaccatcgtgtagattgcagaccctgtttcagctagcaaagagtgggactcccttagtttctaggatcgttgctgttttagccacttgcgaagtcccccggaatagaatttaaccaggactctaataggactggacacaactcaggggtgtttgcttttgtagcatttcttttggggaatgggggtggtttagtttgattcaacaaaaactcattgagtaccagttagctatgaggcactaagcttatgtgaacatggggctatatagagatttgagtaaatcacattccctttgtaaatgctctatgttcccatgaaacacagccacgatattatctcccttcttggccccctccatctcccttccccttgagacattcttctactttctatttgttggcacctggccaaaccctagccaaaagattcaatttctgtgtaggaaacagaagctattggtacccaggttctgtttcaccagaaaggctcagtctccacacccgctgatttcatgcccacgttgatcagttttcatctcgttatgccaggcatgtccaaacctaacagaggcttcagttagctgggatacccctgagattgctatgcaaagattgttctcctgagagcaaatgccagatcctgccagagtcttactagctaggttaacacaaactttttatgaaataatagtcaccctgaacagctactttcccctaaattaaaaaggctacaaaatttttgtcttaccccaaatttaatgtataaaaattacctgaactctagagatgaaaaatgtaaacatagcaccctctatactaggaatcttaaccatttattgatgtcacacacatattctctcccatatttgtagatttgttaaagagaattcacaggcctccttatatttgaatacaactgtctcaagaactcttaaaaatgtacttcttgaagtattcttggacctggcatgaaacaataaagctgtgaatgaacacataattcatttacctacagctacttcttagtctattttgggaagtcctactctgccactgaagtggtgctttctcccactcaggaagaggaactgtcagcactctcattcagaacttgccttctacttagcacggatggcggaaagtacaaaaacgctgggcatgagatgctgttaaaaatccttctgtgctcacaggggaggcattccaaagccagccctcatggatagaagtaaaactccatcctcaagtcaagctggacttctgaatgtcgagttaaaatgaaattatcatggtaacacattacctgggcttccaatcagggagcgattgaaggctccttggtggctaaggtatggctcagagccaagtgtggtgttccagggtaccaagtcctctgctcaatagctttcattctgagtggcaccaacacatttataatggagagtctctcctaacttttatcatcaccaggaagtgtgttcatcaaggtgttatctattctactagccttgatgctcactgttctagttaaaaggctatccaaaaatactatgtcttggggtactactgagatttgttgaaacattggataattgttccccttccccctcacccaacccatcatgttgacagtaaagtcccttatccttgaggcagctgacatttcagaggggctcaagggtgcttagcttgaaaacaagaacaaaatatgtctgatcacgcccgtgtcaactgtggttaagtgtgggaaccaggataaggacaactgaaggcatggattgagttgtaaggggccgcctccttttccctaggcccagttattgtcaacatgagggtttgttctagagctactgtcttatctgccacattcctttttcataagaaggcaatttggtagcatcagaatttatcattgtttttgtccaaaaatgtgtgtcccaggccaggcgctgtggctcatgcctgtaatcctagcactttgggaggccgaggtgggtggatcacctgaggtcaggagtttgagaccagcctcaccaatatgatgaaaccccgtctctactaaaaatacaaaaaattagccaggtgtggtggcgtgcacctgtagtcccagctacttgggaggctgaggcgggagaattgcttgaacctgggatgcagaggttgcagtgagctgagatagcgccactgcactccagcctaggtgacagagtgagactctgtctcaaaaaataaaaaataaaaaataaatgtgtgtccctccagtgccgcttgccccttgttctcccaagcaccagggggacccctggtcttagattcaagttgcatcactagactaaccagctctgggaaccagagggacactggaggaactagtttgggaaatgaaaaacatctgcaatgagaggtaattttattctcctcttccttttaccctagtctcactctccatagtaggacctggatctttgcatcagagaaaacataatgaacaataactggaatgtgtgtttctttcttttctgccctagtattactagaacatttgcatcgggaaaaacagaaaaggtgatctttcaagcactcaaggagttaggtcttcccagtggaaaggtatgcattaacttaataatgtatttctaaaaccattttgtttatttatcttctcatatgtaatgagctagattatttatattaaactgatctaaattagatttggaattatatgtcagtgacatatagtacagttaattttcttttctttcttcttcctccctctcccttcctctctccctccctcctttccttcctcccttccttccttttgttgcctgggcattttaacctaaatctctaaaaatgtaaatagtttgcttcaaatgatttttgtcacctttcttaagaaaaggaaatgaaggccagcttgctgtgttacacagtttttattttagagaagctcaccaacactgcctcaaccaggcacaacattagcatgaataattaactaataaattcaattctacaagatggctatgcaatattttgtgaagcatctctccccgcaccatttgtattcatggcccttcaaatttaaaataattgaaattaatttattgacttgaagaaagattgaagcctggtactattttaataagtcctatttgaaatataaatttcagtttgaaaagtaaaatcttacatggttaccctaagcccgttcacatggtcttgcaaaaattcacaaaataagcataattaaaccttgggcttgatttattcagcatccctcaggcaggcacttttctccctcaaggtgagttggaggaaatatttatattcgttctttggggtatttcccagagcaaggccagctgtagccaggtgttcgcacacacagaatctggcagcatgataactagaaacactgatgtacacgcactgttttttagtgagatggcctggcagtgcctggaagttggcctcctggcttctgtcagcaggaatcagagatgaagaccctgagtccaagtggtcttcactgtgcttcatgaccctgtagcttctcaccctccaagggaaaaacggttctgtgattcataacatgattttattccttacagaatgatgaaattgagcccacagcattttcttatgaaaagttctatgaactgacacaaaagatttgtcctcggacagatatagaagatcttttcaaaaaaatgtaagttccacttatgaggaagtgccatataaatattatcactgtccttttcgattttttaaaacgtttttgtcctattttaatagagtatgttggtagcatctaggaatatctagtcagggttacatttttaaccccatactttatcagtgtaaaagttcactctgagtttttgagaaacttttacgtatattaattgcagcacctggaacttttttttgcattggctttactaactacctacaattttaacctgctcctttaggtattaacccattatgtgaactaactagattcaatttggaatgttaatatgtttttgaaaagttgattcattccaattatttcaaatggatgacttacatgttgtttttgaaataatatcttttgaaaacggtaaaaaaaaaaaaaaattgcagactttttctgtgacctagtgggagtgttttccttctgttgttgttgttgttgttgttttatttttctccctttatgaacagtctctggccattttaagaattcaccactacttcagggttagaaaataagtttagaattatcatcaacaaatgtcaacatgtaaatcgtacatactgtagcatcatatacaaaaacttactttttctaataaatttcttttcagcaatggagacaaaactgattatttaacggtagaccaattagtgagctttctaaatgaagtaagctttttcatacattaactccataaagtctgtgtgcagtggcttgccttctctggtgtcctcattgcatgcctgcatcatatgcccttattcgctttgcttctgacctgctgatctttccattatggctttaccaggtgcaaaaatcagctgccgccctgtgtgttcatgtgctttcttcacattggctttgcacaccactttttgttggtttctggctgttacatgtagctctggttctgtgtgtatgtgtgaattgtataatatattcatttaagtaaatgtgtctgtgtttttgcaagatgatatttaaggtactttttttctattgatctcattaaatagaaagagaatggattgagtttactacactgtagttggattctccattgctaactttatctcatacctttgcatggactggaaagctttatttttgtcttttaatggattgcatgtaagaaaaatatgttggctcaaatagaatattttgacaacaagcaaaacacttgagttcctgggtgaaaatacattgagttttaggctaataggattgcaggttaaatttgtactttttctttttataacaagctcagagctaattttagaatgtgattaacttaacaaccaaaactgatagatagaattgcttaagcacaagagaaaaatattttcgaacaaaaaaagtttgcaacttttattacaactaaaatgaactacttttttcttcacacatacaaaaaaagttttcccttcagtgaaacccatcaagactcttgttaatccaaaatggaaaattcacttttttttctaacacattaataagagtttgagtgaaggatggacagtatgcttttgtttcaaaataatttaagttaatcattataccatataaagagaaaatgcaagaaaagatggtatcatgccagataaaacgtattatcttaagaaaagataaaaaggcagaccttaatttgccacttcatagagacaaattacatcttcttttcttccgttgtgaaggttcagtggcttcaaatttataaaggtcgcactttagaaactatgttaactaaagtgtaaatgcactgatgcaagaaagagaaaatcctaccccacatatcagacagatgcctctaaaataatccttcgtgtacaatacaatgtttattttactcgaaaacatttcaaatttttccactccactggtttttagtcatataaatacaatgttcataatctttacccagatactatccacgttcttatgccacagctgctcagaagttaaattgctttgttttgtttctttaaccccttccccttcttctgccttttgttttttggtttcttgttttgttttgttttatatcccttggcttcttcatgcactttggttcagtgatcatcttaggtttggtgaggtgaagagggaagacggtttagtgtaaaggagaaaatctaccacatcttcagtttgccacttccaagacaaggcctcttgtgttctttgggatgaagccctctcttaaacattacagagaccttaatactgcatttcactgttaaagaatgaagcaactcttaggtcttgaggataagtgcagtatttataggctcttatctaatgcatttccttttatgggttgtttttgttggtgctcccaacagtcactcctgtaattcttagacataacatttaattttttaaaaatatcatcatccatactttcttgttctgccattcagattctttctttaagtatttattatttgtcaaccttttatccctcacaattacagtagacaatagtattcttttttttaatagtgtttccttctatttgatgtcttcttaacattaaggaagtaccttaaattttggggtgtgactgatggaatcggtgtgattctagatttctttaggtcataggaactgtaagactactcaggaaagtctatagcctttatttttaatccaagtgtctgccctgaatttattccttttctatcctagtgaactcaactggaagaactagacaaaaacatgaatgtcggcttgaagaagccttgtcaaacatagagaacattctgcctgttccttgcactccctcttttgagtcctaccctggcccctcttatctctccaaaatcaaaaacaccccttgggcagaacaacttcaatactcataacaaaaggagacagacagagctcactcaagaaagaatgggcattggaatgtaagggtcaattactccaagagtttaaacctaaacattttcaaaatgccttagccacatagtctcaacaagccagtattcaacactgcattggaagcccctgtgaaggttccttgtgaaggttcaatggcttcaaatttataaagcttgcactttagaaactctgttaactgaagtgtaaatgcactgatgcaagaaagagcaagtactaccccacatatcagacagatgcctctacttttaaataatcctttgagtatgatacgatgtttattttacttgaaaatatttcaagtttttccactccactggttcatataatgagacaaaaaaataaacaagtcccatgaacactggaaaggacaaggtcctagtctcatttgcagatgttgattgtctactctgatataaacaattccacggaaaaactgtttgaagtaattagagagttcagcaaggtaaccagagaaacaatgagcaaagcaaaaacctggagacacacatacactgccattaaccaggtagaatagatagtaggaaaacataaatcccatttatattagcaaaagacatgctggttcctaccaccttccagctggttaatcctttcactctttctatgaaagtttttattcatatactaatgtgtatcttcagggggctgcaaggagaggagagactatatatatagtccatttactgctttggtcaccctgtagggtgacctcctccctatccatgcaatcaacactgactagattttcagtagtagctttagacctgactcctcattggcttctcagtatttccttgttcgttgctccccaaagtgtgatccatggaccagcagcatcggcaccccttgggagcttattagaaatgctcagtcttgggtcccacccagacctgctgagtcagagtctgaatttaacaagatctccaggtgatttatctgcacattcaagtttgtaaagcaccatcctagtggattactggattcctccttggaatgtttagtgtgagtgggaagaatatgagagcgacatataccttctgttattctccattaagaatttagccataggaatccaccactcagagctaaaattttgccacatctatgtctcttagtctcatccaatggactgagggaaatcttctttgcctataatatgaaaatagcaaactagagtccaggagggatagcagaggcacttaatgtgagctgccacgtggtgagacactactactggctcaattgcttgtatgtggcaagactagataaaacctcttggctttggttagttttacctccctttccctattcctaatgagaagcaaaattgatttttagttttaccttcattctttgtttgacttcttacaaagatgataactagggtcctgcagaattgggagatgggtggagggcaggagagagggataaaaacaaggaagagagggaaaaggccttaggtggccacaggaatcaaggagtagctttactttcttgttgctggtaatcttcccccttcctcacacatatcataggatcacatcagggctcaacctgacttttttctttttgcagatgaaagaatattttaaaaggacccatgatctctttccttttacaagatctttatgctttaaatgcacaggcaaagagagagaaggagggtatttagtcttatgagtaagcttatccttgccaattattccttctatatttttaaaatattatttatgtcaacattcatctctcccagtgctacttggattgaagccagacgatgcctcttctcagcaccagtaaggacgtaatactggagttctcttcatctcctccttacttacttggacacagttctgtgacctatttttggaagtcatttagaatctcattttacaaagcactggataccatggggtgaataacctgagtaacttgtttccccaaatcctggctgaaaactgatggttcctcagagatgtgaaacattcacctcactgtgcttgtgtctctgtggaactctactgcagccttattactgtgagatcagctggaagtgatccttctcctcttgtttttccatatgaaaatgatagttttctgactctaatgcaaatcttatatttgtttccttgcctttggattacccagattgatttgtgttacctttttgaagcatgaagattttagggagagctgaagattgttatctagtgggagcagaagcaaaaacaaatgcaatttcgcattgtctgcacttcatgcttatttgctgcgaatgtaattttcagaataggggattatgatacatccattttagggcttggttttcctggctttgttttgccataggcaggatggtctaatgaatgtcataccctctgactaaattttaatagtgtttaattgggaggacatctgaaacactgaacatgcttctatccttgtgagacttaggtacttttctttttactgatgtgcaaatatgttaaaatgcatacctttatatgttaggtaaagtgattcttatacttgagcacatcagaattactcagaagtcttatgaaaaacacagattaataggttccaccccagagatcagcagattcagtagatctagggagggacctgagaagctgcatttctagcaagttgacaggtgttggtgaggctgatgctgccatccacagatcacacttcaggtagtaccttgtcagaataaacacatgtatgtatattttaaaatgcacaaaaatgtctgagttctgtctcctttcctaattttatctcttctctctcctgtagctgaatcccttttttctctcattttttaattcatatggatttgcctcatcatctccatgagttcaaaatatttaccaacaaacatatttttaaatttaaaaaacttaattttaataaggaagataaataaagtggccacctatgaacataacagtgctggggtctaaaaaggacctttttcatcctttatccatcttctaccatgatattatttatggagatgtgagaagggatgtgcctagaaagatgggtttgttgttgttgtcagtttgtttgtttttaaaacaatgcattctcaccagaaagacggagctccttgtttccttgagtagtgggctccattgcacgatggcatcaatttcctaaacaaggtgtagcatgccttcacttgcctggcattccatggtccacctcacaatcctcttccctgcatatcccataacttttgttcttggtggcctcgaggcctgctgttaacataacagtttctgttgtagcatatgcatgaatgttagctgttgtgagccataatttcttagattacaacagaagcatgcttcattgggataaattgatgaaatttgatattgattccttatgagttaatgctcttaactcggtgggggaggaggggacccagaaaaggctgggccccatatgcatgaggaaatgacatccaagtgctctgttggccaaaagcattcattctgtgtatagctcacttttccaatgcccattccaaagcaaatagggaagggaaatccatatgaacttttaacagttgctttttaaatacctttccaacaatgtttttcagtccgtgcatatatttgggtaaagagttgtcaccaaggtcctatttattgaccaggttttgctcacacctgcttatctgtcattattccaaacttccattgaggtttgctttatttattcacttattcattatttttgtaagggctgaccagggacacagtgctgtcctctaatcctcagtgaacagaaaggaagtttagtggacccactgccaacacacatacacacacaaacacacactattggagctgagtaagttagtaaactgggtttttcatcattgccatgaagttaggatgataccattgcagggacagcattgctcctggtgcctcatgtcatagcaggagctccttaggtgtcaatttgaaaacaataatgtcaccaacctcttaagtcccgtaatcattcatggactctctgcccagagaattctatattgtttatagcttgtaaatatgcttgtactgattaattttcatcattacaattggttcgttttgaaaaaaatagttactcaagaaaatgaaatttgttgagtgcccaagaaatcatggattgatgtagaaaggtgttatgaaaaagagatgatgtttgcctgtgtaacattaggctttttgttgttattgcttttggggtttttgaggggtgcacttaaattagtatattacctatttgaactattttggggggttggtgtttgctttttaaaaatattttgacctcacgttttatagatattcatgccaaatgtcttccctgttgtgtgggaactggaagacagtacaattgacatgcacactttattatgtatccttcaacttttgaaggggaaaaaatgtattctctctctctctctagttcagggagagtaacccaaaagtattcccaaatgtggactttttgaagtatactttaaggagaaaggcaggaaggcagtgaggtcctatctttgtaattataaacatgacagtctagatatattttgttttataaattataaacttagtaatgtctaatgcctcaaggccaagaaatatcaacctaaatggagttattttcttatcatagcatcaacgagatcctcgattgaatgaaattttatttccattttatgatgccaaaagggcaatgcagatcattgagatgtatgaacctgatgaagatttgaagaaaaaaggtaataaacatgaaaaaaggacttaaaaaaaaaaacaagaaaagatgcaacttttaaagccttggtttatttaaaggtatctgtaaatgctttgcaactccctgagccatggattgatgactatttttttttcctgctcttaagttcgtataaattttacctttcatcagaattagtcaatcctgactgaagtatactgttacatttattgtattattaaatacattatagtgatgtttccccatgtactttcttgtattagattttagtattgcatattgcttgaaatattaaaacaaccaatacagtctctacttgcaatccttgaaaataatttttgtcatataaaaacttataccttttctttttctcccttttgttttgccaagccaaataaatttaatacgtgatttgatgtgcagtaaccctcatttgacctctggtatgaaagataaatacaattgatatgaaattaaatagtcaggaatcgccttagctaattgctggacctttgtccctttcaaagaagctttggaaacaaagggttgttcgcacaaatatttgtcaaaggaaaggcatggggagaaattttaaaatcagtcccacagcagtgagaaatgcctgcggaacatgggagggagagctgggggtacctgagctagagcctttggcgttatgtctcagtggagaatgtaaagagatgaaagttcaagttccataggtcccgtatgtccgtgaatctcaaggtctcagtttcctcctttttaaaatctatttttttctttgtatctaatgccagtgagtgtggttgaatggtctgtatgttatctggaccctctttttaggtatacctggccctctacactccatgatttcacccctgatatttttccaagcccaatagttttccctttagttgtagttgtacagtttacactttctgctatggctgaagatacctattttaagcaagaatgcttcattccttccctctctgtcaatattctgaatatcataatttatttcacattgcttatgattacagcaaagggaggtacagcttggtagaaaatctaacacttcgcattggcaggaggtgatatgattcttgtcacttccctgtgaccttgagctaggaactggcctcctgggcctcagtttccctgcttgtaaggtggtggggctcatgcagtaatttggctagtatttcccttccctaccttcattctttgaagtttgtagagggctgaccgggtgccaagcactgtgccagatgctaggaattcaaaacaataagaaatgtccccagccttgaaggcagttgcgatctgttcaaggagaaagacaagtgattcaacaattccttggcagtgtgataaatgtcatgattgaggtgtgtccttgtttatttccaaattccttctaagttttaaaggtctatgaagtgaccattgacacatctaaaaagggtagcttgaccatttcacaagtgatggaaattttaacgtctgtcattttcaagtgtgggtgagaatggagtacaaagccattcttataaacttctggtaagaccctacattggtacaaccatcttggggaatattttggcaatagtttataaagtgaaaaatatgcctcttatacagcccagcattttcacttctaggtatgtaccctagagaatctctcatctatttcccaaactctggataccagagcggcacagttctcagatctctgctccacctatattcactctgtacctgagctcatccaagccaatggctttacatttcttctattaaactctccagtcctaacctccagcttacactacagacttgtagtagaactctccatctggatgttgaatgggcatttccaatgtatatatacaacatatttcgatccttcctacccctagatatgttcctttcaaagcctataaaatagtaccgttatttacccagtcaaaaccactgggctcatgttggacttgtttcattctttcacatcatgtctggttcatttgcaaaacctgtaagatccagcctcaaaagaaatcctaaataaatcacttctcaccatctccaacattactgactatccaaaccttcatcatccctctccaggcaatgccttctccttcctactcagtgccctacaatttatggtccacacagcagccagagtaaaccttttaaaaccaaatctaatcatgttattccaccctttgaaaccctccaaaggcttcccaacacatttagaataaaatctaaaatacttagtgaggactaaagcccaagtgatgtagcctttggctccatctccaatctcacttcaagctacctttttccttggtcacttgctctgtcttgctgtcattgaatgatgttggcacgcatacatctgcatcaaggtctttgcacttgatgatccttctgcctggactggtgtttcctgggtgtgcacgtggcttgctcctcacacatgtacgtgacctcagaagggctttcactggcccatatttaacacagcatcctgccatgcttcatcaccttcctccctgctttctctgtccttctagtacctctttgacattatatttatttgtttacttatttgtttctgtcactcataatatgagagtttcatgaaggcagggcttacctgtttcttctatcactgcatctatcctggtgcctctaaaagtacttgctctttagaatgaatgaaggtgcccaaggaaagaggtatacaaatttctactttcatttataattagaaatgacctaactatccatcaaccaaataatggataataaattatgatatattcatatatggacttctgtaccttcagtgaaaaataaatgaacaagatctacctacatagctggtatataaagataaaaatagcaagttgcaaatgcacacagtgggatagtttttacataaaattaaaaacagcccaaactacccgttgtttggataaatgcatatgtagtaaggttgcagaaccattttggaggtaaacaccaaaactaggatactagttatctatctggtatggaatggaattgaggtggggtatacaggatgctgcagtggcatcagaaattatgtattcttttacatgtaagtcaaataatcaaaaatgtaaatcaaataaggcaaaatgttgagatctgaccacactggtgtaggcccgtggctattcattatgctatcatctgaacacttctgtattagcttgaaatcagttcataacttgcaagttcttaaataaaacaaaaacttgaagctgtcgatgcatcaaccatttataagttgcataaatactgattgttgctcctgtagttaccacgtgggctctaccccatgtcagaaaggtgtgatcgaaatgaagggtggcttttggggccacgtttcaatgaccactgtatactcttctcaccagtcccataacctgacttttagataaaattgaaaactgaattgtttaaactcagaagcaccatcatctccaagaaaaatcccttttccaattcagtgagaacaatgtcttataattaatacattttccatttttaaagagcacctctcgtatctattctcatttcccattatgaagatcttggaagtcagataggtccagtctttttccccaattgacagaagaagaagctgagatctaggagccaaaggagtgagtagcaagagcagaacttgatacaggccccctggacccctggtcaccataactcccagtgctgtgtttctgaacttgggggaccatgtacatctgccatcatggatgtaaaagcagaataccacctgtttgtggaattcattatgttacttataatgtgcaactctcttatttcattcaagttctgacagatgaaagttcttgggaaagagactgtgaagacgtttttactcttataatttaagctgcctcagcttccatgaataaaacatgagatatgcatcttcagagctacaagtgctactaagatgttctttttcccctaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcaggtgaggaactcaagatggcaatttgttttttgtgtgtgatgcccttcagtttaatttacttttctctgaaaaacaggaaatagtaatcaggatgaaaaggaaatttgtttattccctttaatggattatcatggtcatttaacgttgagaaaagaaggacagtatctctttcggaaaaatcttcagtcatccaaaagactttactgtgaaaagacttttctttactgtaaatttaaaatatgcctccaaaaccacaaaaaagaaaacatgcatattgtaagaaggcgtgttgagttttttgttgattataggtacttgttactagcaccatgctctaaccaattgagctaactggccattgattataggcacttgtaaattagctttttttttttttttttagtatttattgatcattcttgggtgtttctcagtttctcagagagggggatgtggcagggtcataggataatagtggagagaaggtcagcagataaacacgtgaacaaaggtctctggttttcctaggcagaggtccctgccgccttcggcagtgtttgtgtccctgggtacttgagattagggagtggtgatgactcttaactagcatgctgccttctagcatctgtttaacaaagcacatcttgtaccgcccttaatccatttaaccctgagttgacacaccacatgtttcagagagcacggggttgggggtaagattatagattaacagcatcccaaggcagaagaatttttcttagtacagaacaaaatggtgtctcctatgtcaacttcttactacacagacacagtaacaatctgatctctctttcttttccccacatttcccccttttcttttcgacaaaaccgccatcgtcatcatggcccgttctcgatggtcactgtctctttggagctgttgggtacacttcccagatggggcggcctggcagaggtgctcctcacctcccagatgatgggcggccaggcagaggtgctccccacctcccagacggggcggccgggcagaggcgctcctcacctcccagatggggtggcggctgggcagaggcgctcctcacttcccagtcgtggcggctgggcaaaggcgcttctcacatcccagacggggtggcggccgggcaaaggctctcctcacttctcagacggggcggctggcagaggcgctcctcacatcccagatggggtggcggccgggcagaggcgctcctcacctcccagatggggtggtggccgggcagaggcgctcctcacctcccagacggggcagccgggcagaggcgctcctcgcttcccagacggggcggccgggcagaggtgctcctcgcttcccagacggggcagccgggcagaggggctccccacatcccagacgatgggcagccaggcagagatgctccccacttcctagacggggtggcggccgggcagaggctgtaatcttagcacttcgggaggccaaggcaggcggctggaaggtggaggttgtggcgagccgagatcacgccactacactccagcctgggcaacactgagcattgagtgagcgagactccgtctgcaatcccagcaccccgggaggccgaggctggcagaccactcgaggtcaggagccggagaccagccccgtcaacagggcgataccccatctcctccaaaaatagaaaaaccagtcaggcgtggtggcgcacacccgcaatcccaggcacttggcaggccgaggcaggagaaccacggaagtccggggcagggaggctgcagcgagccgagaccacggcagtatagtccagcctcggcaacggagggagaccgaagaaaggagggagggggagggggagagggagagggagagggtaaattagctttatttgatgtaaaagttcaaaaatttagttctctgagagtagaaattattaaaatcgtttttgttttatagaaactggcaaatatttgagatttaaaatatggcaaaaatgatgaaagtgaaaaataagaaatgtagttacattatgtttttttcttggttataaattaaacaatactttatttttttaattcatttttttttggatatggaaatatgttaaaagaaattaactgtcttactacttccatttgcaaacttcctctgaatacctgagtatgaatcactaaacattttctgaaatggccaaagtaacattatccagcctatcaaaattaaaagtaatttttttaatttattttattttattattattatactttaagttttagggtacatatgcacaacgtgcaggtttgttatatatgtatacatgcgccatgttggtgtcctgcacccattaactcgtcatttagcattagatatatctcctaatgctatccctcccccctccccccaccccacaacagtcccatgtcatctaaaacccagcccacattcatatttccccagttgtccccaaccaaattgtccttttttttttttttaattgggacagagtcttactttgttgcccaggctggagtgcagtggcatgatgtcagctcactggaacctcccctcctgggttcaagcaattctcatgccttagcctcccaggtagctgggattacagcctcccaagtagccatcacacctggctaatttttgtatttttagtagagatggggtttcaccatgttggccaggctggtctccaactcctgacctcaagtgatccgccttcctaggacacaccacgcccggcccccaaattgtcctttattgcgttttgtcacaagtaggatttcatccagaaccatgatgcttgttatatttcttaagtctcttaatctcactcagacaatccccttttgataataccaaccagatgaggaatataatgtggttttaacctgtatatgccatgaaataatcaggttacttaatttattcaattttctgttctggaagaaaacaacttattttgatgtctttcttttaatttgtatgaacactatttcattgtaaagtttcaatattgtaacttcactatatccctagatgtgttgaacttgactgctgggatggaaaaggtgaagaccaagaaccaataataactcatggaaaagcaatgtgtacagatatcctttttaaggtaactttaaaaataattacacagacttttccaaactctgtgaaaatgcaggaaatagggagatggagaagagaaaacaaatgattcattttctcaagcattatgccttcatattcccttcttccagtcttgaggaaaaagtcaagacaaagatcttttccactgaacgtccccttcatgatactgttcttgctttcaaatggtgactgtgttacataacaaggtttctctggcagagtttacctagttttacttaccttagaaacagtgtctccttttgttatctacttatttgcttatttactttacattattcctaaaggacttcaaggtggcataaaaagataaatagaatacaggaataaaatagattgtaaatagggcctacaagaataagaaaggccgggcgtggtggctcacgcctgtaatcccagcactttgggaagccgaggcagggagatcacctgagatcaggagttggagaccagcctgaccaacatggggaaaccctgtctctaccaaaaatgcaaaattagctgggcatggtggcacatgcctgtaatctcagctactcaggaggctgaggcaggagaatggcttgaacccgagaggtggaggttgcagtgagccgagattacactgttgcattctagcctggacaacaagagtgaaactccatctcaataaataaataagtaaataataagataatgaggttagacaaatcaaaagaatgaaattctgtggtttgcaaatgtcagctgcagctgtctgtcggtttggtataactcaggatagatattacaacaccaggagcagcggttctcaactccacctacatgtgaaacatcaccatgggtattttcaaaaacataggtgctgctgggcgtggtggctcatgcctataatcccaacactttgggaggtggaggcaggtggatcacttgacgtcaggagttcaagatcagcctggccaacatggtgaaaccctgtctgtactaaaaatacaaaaattagctggtgtggtggcatgcacctgtaatcccagctgaggcagagtcaggagaattgcttgaacacaggaggcagaggttgcagtgaaaccagatcatgccattgctctccagcctcagcaacagagcgagactctgtctcaaaaaaaacacacatacacacacacgcagatgtctagatgctatgcatagtatttctcttagccaagatattggagagttttgaccagcaatgaattcaagataatacttcttgatatgtaccaagagtatattcaagtgggaagccatgaatttgcatagccaggaagaataactaaatgactacctcagccacaaggaatgcctcaataaaatatttcaagattatctaaccttgggctttatcatgtcaaatggatttgcctagataactattgtgaaatatttttctgattaactgaatgatgagatttgccctgtgattagctacaaaccagtaagaatttggggatttttaccaaatatgatgctccggttgtagaagtgctggtttgaagcctttctttctaaagctaagcagagacggggccaaccatctcttaaagcctctcctatttcatggagaatagtgaaagggaagattatgtttagctccttcaaatgttgttttctgtaattaagttctgtgttacagatggggggtcaagaacacttctatgtttcacttacatgttgcttgaccaacgagaaccccttcccccggccttgtaaccaggctaataggaaacaagggatactgcaaatgtcactttagtacacagaggtctacatcaagttaatgaagtatagcccaagactgatttccaaacacagaggaaagtcagtgaaagcctccagcagtcctgaggttactacccacacttttctgcatgaggtggggaggagtcatacagtggtcgggagtgaaaacctctgtgccagagatcacctgctcctcaagaagaaaggtggactctgaactcctggcctggcagattaacaagccacagactggcatgccatttaggtgaaatctcttgtaagttaatagcaccataattctggagaagtaaaagatagcttaaaaaattgtcattaaccattaactgcaccctggctataaccacagggaactcaacctttagaggtgtcaaggtagatgggggctccaggtctgaattgctggaattgactttctgaaagactcaattaatagtctctgaatagttttgggtgccttaatttttttgctcttttctctcattaacgtttttttttgtttttaaaggatgtaattcaagccatcaaggaaactgcatttgtcacatcagaatatcctgtaattctctcctttgaaaatcactgcaggtataatgatccattctgccacaagtctctatgtggtattgtttcctaacccctaatgcccactcctgctctacaactttttaaatagctgaatagtttgttttgtgaagtactaagttcaaataattctccagcaagggcacctactcttatgcaaagcaaaaaacaacaaaaaaaggaaaaaacgacaaaaaaccacccttgtccccccaaaccaaatcattttaatgtgtttcagaaatacttgttccaaataaaagttcagagattgggacaccttacttaaagttccattgagctggaagatttgacagtatatttgaaatcagatttgatgaacttgaaagacattttttattcttctttccagctcttagttttggaacagaatctccttctccttcttttaaaattataccagttaaagtttttgatacatctcacattagcattaagaggacaataatgcattttgccaagtgagaatctttaattgcctagtaatgggtgtttcttattcttggacggttaatgggtgtttgaatttacaaatgccacttttttctctccagcaaatatcaacagtacaagatgtccaaatattgcgaagatctatttggggatctcctgttgaaacaagcacttgaatcacatccagtatgtatttttaacaaaccatatttctagcatgaatggatttgttttgaaaatttctgaagggtcaagtagtactagaggactaatgctaaagatcttcatatttatttaaattctttggtacggaaagcttacatcatgcttcagagggatgtaaagagacacaaaataaacatctggttcaatttcatttggaggatctttgggtcttatggttttcagatctcagtcttaaagtttcataaagcacccaggccaagagtccagattcaggtcagttgttctcaaattcagttacatgttagaatcacctacaaaactgttaaaaacacctgtgccagggccccacttggagactgatttaattgatgcagggtcagccctgagcatggtgttttaaaagccctccaggtgaactgtatatgcacccggtattcagaacccatgggaggctcatgctgtggaaagtgccctggattgatgtcacgacatcctgaagttcatgttcctaactccaaaataaatcactgagtaatgttgcacatacatttttgaacttcatgttaaacctgctaatttcttcataaagcaaagaacattaacctgtgctccatagataggctttatgagatctgtgaattcattctaattgcatgcaatttttttgtatatactcattctagagagttaatcacatttttataaggatccatgacctccaagagattaagatccacaatcacaagatgttatgagctccaaggcagctaatgaaatcaaagtggaaagacctgctattgacagcagcacctgatgggctcaaacctggtagcatgaggtagtggcagaagaacatcacagcaaatgacagcaggaaggtgctttgtgctacatgtaaacactttatgaggttcttttcagaagtgtgtctatgggaactgaaaaaaaatatgagagacaaggatatctgtatcctttgtcccccttccttcttccctcgaacttgcagaagcagttgctgcaggtgacctgcccatatccttgcagtgcctcctgtttccctgaacactggcctgactttccactgccaacatccacagctttttgcctgagagtgagctctggtcactggagcctgctctgccacacatgaaagaccagcagtgccagggaattatcacccctatcccatgcttcatccctcccgaggtgggataaccctgagcacctgctcttctctgccttccagggtttcccagcaggatcgtgctccagctggctgcagtgataacacacccttgatgagctgcctgtcttctttttctcactttcccacacctctgttggagtttccttccaagtagacgacctggtgcaatactacttttctctgaggctgattttaagggaacccaaactaagaaacagctctgatttattttatttgtttttacctaggccctccatttatctttctgattaggttaaggtgattgcttttgtggaaagttcactgtattcttagtgaagtgatgtgcacatacttttaccagctgaagggtgtccaggttcttggcatcttgaacaaagaatcggacaaaatgcacaaacaaagcaagggaagaatgaagcaacaaaagcagagatttattgaaaatgaaagtacactccacagggtgggagcagcctgagcagaggggctcaagagccctgttacagaattttctggggtttaaataccctctagaggtttccattggttacttggtgtccggtctatgtaaatgaataggatgaagtaaagttataaagtcatttacttggtgtacatcctttgtaaatggagaggatatttcctgtcatagctgaagtgtttccatttgatttagttctaggaagtcagcatgaataggccttatattccctgcctcaagaccctattctcctttgaatacaggacaggtgtctggggaagcatgggtaatataaatgggaataagacctgctccaaaagctaaagagctttcaaccttgggagtgggagcaggacacaaatgtgaacacataactagaaaagaagatggcgtatggtgctttatttgttggaggtgtcctggtacaagagagatcactggggaatgggccagttataccacgctgctggaaggaaacagcatttcaacaaagggttttatttgaggcaagacagacatatgagtgcacagtgccttacatataataagtagtataaaagcaagttttgaaaatgaatggatgggtggaggggtgggtgggtgggcatatagagagatgggtggaggaatggggaatggaagactagatacaggacggttctgtagaccagaggtgatagcatacaggggcacctcctttgcagatataaatctaagcaaatgatgctgtagtcaagttcagattccaggaattggaacaactcccttcttgattcccttatcaaacctacaaaaccacaaaaccacaatctcaagtgttgagggttgggtcagcctactcagcagacaggcttactatacagcctgacacttggggggatctggggggcctctcacttgggaaagctaattctgaacccagccatcacaattgtcccttgcactttaccagatacttaaaaggtgcaaggccctctggggagcaggaacccctccccggcacatcccaggccagacccctgctccactggggaggttggagcagctctgcacacctctggaaactatgtggatttcaagtttgcagcactagtctaaggaaaagctcaatgggtgtgctaatttgggttggggagtgaaaacagaaggctgtgccgcctgccatctagtgggtgttgggttgcatcactcccaggcctcccaggctcctcctggactgggaaggagaatggagaagcacagcccttccttaattcagctctttctgtttctctctagcttgaaccaggcagggctttgccatcccccaatgacctcaaaagaaaaatactcataaaaaacaagcggctgaaacctgaagttgaaaaaagtaagtgaaacacacacatttataatggaagcatacataacatgtgtggacatttcagctgttgagaattcaatttattttaaaaccactgatttttgggggaagggtgtaggggtgatgttacaggtacttttcagagcaagattgccacatttccatttaaatttaatttccatatcaattaattcatgcagtaggaaaagcatatctatatattcaaatgccagaatttggagagggcccaaggaaaattgagaggaaagtagaagcattttagaatttctcaagatataaggaaccagcattttataattttatacactctaaagtcctcataagtttcccttttcagtttgccccgtgctctatacctatctagggatactaggtacatatgagtgtgtgactgtgtatatgtgaatagagagatctagagacaaatgattttatataaacatgtttccttttattctcccaggatgatttccttgaaaatattttctttcagagtatatcctagttcagtgaattaatggtatcaaatattggcatgattacacttcattttccccccaagtattctaaatgaaaaattttaaattatgttaatgacagtttattttattacaaaagcaataatgccatagaaaaatcaagacaatgaaaagtgtaagaaagtaacagcactaacatatattatacacgtattcatatactatagacacatgtacgtaatgtacatgtgtagatatatacccacatttttaacatgactgagatcatattaatgatactgagtttaaatttttaaaatttaaccaagtaagtatacttacatcagcaggatatacatctacatactaactttaatcctaatgtatgaaacactatatagaatttaatatatatgacatagaattgtatgcatttattatagcatgatgtaacgagtcccaagttgatggattttcactactataaacatgcttgaatgttattttgtatgtttgtgcaaccctctccttgaaatcaattggtgcaattagagttattcagccaaaacgtatatatattttatattgtgatatagtttgttatgctttcttttaggaaagttctaccaccttagactcttcaccagtcatatatgagagtgcctgtttcccaccaatatccttaatgctggctgttggccatttttaaatgtgtgtccaactcatagaaaaaaattggtaccttaggggtttttttatttgtgtgtcttcaataactccttttttgcatattactatttgtggtttgtccctatgtgttttcccatttttattattttgtttacctttatctttctgacttatagaaaaattatttagtcttattttgtatagtaggatataatccccattaaatcagttgcaaatattttttcctgaagttttgttgccaacctgcctattttctatcagttccccataactgttcgtaaaccttggtctgtgccagattctccaaattatgggcttttgttatctagccttaaatccttcacgaggactgaacctcctctcaaacttggtgaccagaattttgggcatttcacccatgtccccgcaattcttcatcatgtgtatataaggtggttgttgcaggtttcttacaaggtcgagaccaccaggaaatggcgagagagagatcactgctgaaccttagaaacatggtgccttggtgcctgaacattctatttcttctctcttttcacgtcctcctcagtgtcgatctcaaggcctagggtttgtatgttacctagcatctgtcaccatctctttgcgtgtttttgctaacagaacagctggaagctttgagaagcatgatggaagctggagaatctgcctccccagcaaacatcttagaggacgataatgaagaggagatcgaaagtggtgagctgtttgcttttattttaagttacatgctttgaaaatactttttaaataagaaaaccaggctgggcacagtggctcaagcccataatcccagcacttggggaggccaaggtgggaggattgcttgagcccaggagttcaagaccagcctgggcaacattttcgtagagatgagaccccatgtctacaaaaaataaaatattagccagacgtggtggcctgtgtctgtagtcccagctactggggaggctgaggcagtaggatcccttgagcccagaggttcaaggctgcagtgagctatatgtaatcctaccactgcactccaggctggacaacagactgaggccttgtttcaaaaataaatgagtaagaaaaccaggaatttctttcagaagacccttttatataataatgccgttttaattcctcatagtaatattttggtattcttggtattttgccaaacacttcccattttttctggctactaaattttaatggccttgtcatctcccttcctattggccattcagctattcagcagaaattcttagccagagaatccctgaagcacttgctgtagtaggcagaggaagcaatataaggcacattttgtaatccctttgtatagacaaaaacatgaacttgagtctgttaatgatgagagtagagaggcaaataatttaagagaccctcaggcaaatgattggtttgtctccacaaagtgaactagaaactaaaagccagtattaaaatttcaagttcaaattccttcaaataaccagctcaccagaattatctctgtgtagctagataattttaagaaggcagtcttgcttaaaatatttgagtatgtgctattaccttctcttttactttgatcacatagcaacaatcataatgttcagttgtaaatgggtcatttgagagtttggggatgattttagagaattatttgtttgttatgtttcatgagaattgatgaacgaaatgacaaggacttgtgttggttatacaatgccttggatttatatacaggcataccttggaaatattgcagattcagttctagaccactacaatgaagtaaatattgcaaaaaaattattcacaagaatttttgtttcccaatgcatacagaaattatttacactgtactgtaggctagtaagtgttcaataacagcattatgtccaaaaatgtaacttaattaaaaaatacctattgcttaaaaatgctgacaattatctaaacctgcatcatattgaaatctttttgtggagggtcttgccttgagtgatcagggaggcagttgccaaagattgggttggctgtggtaattttttaaaataagacaacaatgaagtttgctgcatcaattgacccttcttttcacaaaagatttctctgtagcatgcagtgccatttgatgacactttacccagagcagagcttctttcaaaattgaagccaatcctctcaaaccctgctgtgatgccttctcaactaggtttatgtaatattttaaatcctgtgttgtcatttcaacaatgctcacagtatctttacctggagtagattccatctcaagaaaccaccttctttgctcattcacaagaaacaactcctcatcggtttaagttttatcatgaaattgcagcaattcagccccatgttcaggctccttttcaaattctagttctcttactctttctaccacctctgcagtgacttcctccactgaagtcttgaacctctcagcgtcatccatgggagtctcccaaactcctatgaacgttgatatttttacctcttcccataaatcatgaatgttctttcttaatagcatctagaatggtgaacatcagaagcttttcagtttactttgcccagatccatcagaggacattctcttttaggaaagctagacatagagctaaaaatccaaaagttggaagaattaactaaccttattcaagactccttaataaagactcctgactgtggaacagactttataagtgattcagttgcatgtccagtccttgggtttgacattactcccagagaaaagtcataatgactgtactttcatttgttttatgtggcagggagggtctaagaggctaaagatatctgatactactcagttgatactcgttattatggtcatctgttactatgcaataaaccatccccaaatttaggggcttataacaacaccttatcattttctgtcataattctgtgggtcatgtgggcttaggttggtggttctcccttgggtttctcctgcttttgtcagcagatgacatctggggctgactggttcccttgggtgggttatcccggacggcttactcacatgctggcagtggatgctggctgaacgctgggagctccgctgggcctcactgaccatagtatccctgtggcctctctctgtgacttgggcttctcatagcacgatggctaagtcccccagatggaacatctaagagccagtgtctcaagaggcaggaagcagaagctgctaaattagttaagagctaggcctggaactggtgcagtatcacttcctctatgttttattcatcgaagcagtctcagggcccatccaagttcaagagggtgagtgagtgacaaggtcacgttgcataagagcacagaggagggcagatgatacggcagctgtctttggaaaatatagtcagccgtgatgcctactatattttttcacatgtttttgcaaataataaatctaaacaagatttaagaaaaatatatttatagaactgtgtttcaaatggtcaagaaaatactcctaagatacaaaaaagatgactattcagtaaaaccagttcctttaagttaaatttcatagatggtaattaaaatatgtaaggcattactgatacgataatccagtaaaacaaactgcagaaataatggaataaattaacaagaaaacaatgttaataataattactaccatcgttgtaccaacagtggaccaggcagcttacattatggccttatctaacctgtatacagcctgatgaaatgggtattattattattattattattatttttgagatggagtcttgctctgtcacccaggctggagtgcagtggcgcgatctcggctcactgcaagctctgcctctgaaatgggtattattacaccaatttttcagatgagaggactgaagcttagagaggtaacatattttgcacatgatcccacagcgggcaaccgattgcactaagattcaatcccagagctacctgattcaagtcaagacttttgtacgttacagtactgccctttcaattcacaggaatatggtgaaaacatagatatgcaaaaatacttttttaaaaaggagaaagaatagaacgaatgaaagtcaaagatgtgatgtttcctaaacacacacagtcatctgaaattagcatctgtatggcttcatgtattattcttaaaggtgctttcccaccatctacatccatatggtaattattcctccaggcagaaaaatatttgcctctagtgactcccatgttattccaaaatatacttgagatttgggttaagtcttaacagaaataaccacatgatttagtatccacgtaggaaagtacctaaggacagaatcatccacctagatggcacaaggctcctgtttcacctgttatgtgtgtgattcttaggttgcctcagtaatacttggctttggttctggtcaactagtcggctataattaccttagtgccactgtatgaatctactatctatgtgtggctagagtctctaatttaaatacatcaacacagcaggcaaggggaaaccaagcatagttcaataggggaggcctgcctggaggctgtagaaaatagaaaaggctttcagtcagtgaaagcaggtgcccaggcattaggctggatttagattcagaaggacatgtggctcccaggataggagacaagtagtggagaatatcaaaattgtatgtggttataggtgtgtctgtgcatatctgcacactcagaaagtgatcatgtattcatacaattctcttaaggtggttagtaagtctccaccacttgtttggggtatgccccttgccttcaagtggtttacatctgtattggcagtttagacataaattaaattaaatgaaatgaaattaataaattaaatgaaaatttaatagtgacatgagaagttttgaaatcttggttactgactgtaggtcatggaaacctagtcctggaagaactatgttaagaattcaagagacaggtagatccattatcttgctgtgtgatttcagacaagtcaaatcatatctctgcatctagttcctcgtttataagtaaagacagatgctggattagattattttaagatgtattccatttcctcaaatccttttcttcctgcctaagccttacaattacccacttgttgttgttgttgttgtttggattttgtttttttaatcgtctgcctctagaatatcccttcatcagaattgttagctccagaagaggaaggtggctgtttctttccctcaccctcctcctgtgcctggagagatacttcacaaaataaaacagtctatctagaaattctgaatccagatactaccagttgaaagataccactgttttattatgactaagaaagaaaaagtagtttccattcactggaaaaaaccgtcagttgaagaacacactgcaatatcagaaatattaaatcaaaaaaagtacatcttagaatcagtgaaatcatttttcatttactcctgttctttcattctcctttgtacttttaaacatgctttaaaaaaatctatctcattcttatgggtctactcatttcctttctgaatttctcagaaattattttagtgggtttttttgttttgtttttacagtaacgttccctcatgccctgtggtgtgaccatgtggatttatattgtcctcatcctgatgtctgtgggtttctcctgatcctggctagattttaggcaaattctttatctgggaattactgcaaatagtgattgtgtgaatccaaatctcacctcagcatgttgcacattttccagcaggtacttcttttttttccccacgaacatcctgggtggattctggcattcttgtcactttcctggaccaatgaacacagtgtgtgtacttcctttcacagactagaccacgctccagggacaccagctttatttggcacccacttccacttctcctcctacctgagcctgacaaatgagccctgagcctttgaaacctatgctaggtttgacaaatagtttgcaggagtagcacaatccttctgaggcctttcttttttctaccactccaagctataagtcattatgcccataaaattcaagtggacattttagtctctttcaaaattatccgatgtatttgttttcttgcatcttcttatttgctcttgatgtcatgaaagatcaaaacacctttttatgagttatagatattcctgcagtgtttgaggctttcatttttagaattagtatactagaatagaagtagccatccacttaaaaaaaatttattaagcatcaagcatttcaaaccacattttaggagcaggagaaataatacataacaagatgtgctccttgacgttgaataggtaagagtttagtgagagttttacttgaaaaaatactgcatatatcaatgtccccattttcttttagcatcctttttctctaaaagtgcttatgttctacccaagattgtgaacaaggtctgactacttggcagtggtttggtgtcatggattttccatttgtctttcacacagctgaccaagaggaggaagctcaccccgaattcaaatttggaaatgaactttctgctgatgacttgggtcacaaggaagctgttgcaaatagcgtcaagaaggtcagagtcccctttctttcatcactctcaagaggtagcagctgttatttatgaaattttggaaatgtgagaaccacaagagaataaagtaacctataattccccttctaaattgcttaggatacgagtctgtgctgggtgaccagaacttgacacatacacaatattaaatttaaaaggacatttaaattactcattagtcagggccagtgttaaccactacccatttggccagtgtcctctaaatattatcatttattgtgttattgcagctggggagggagaaaatgacagcatcccaggggtaagatttaatcttgaattcatcaggaaaatgacccctgaacatcccgagtctagccctcatttgagaactagtcctgctaattatataccttccccctaaagtacagtaagcataaaaatgtttccagatattcagccaaggaaaatagttattcatatacttaccttttgtcaggcatagtctaggccataatgacctaaaagtgtaaaacacacttgccttctgcccttaggcagctcatggccccctgtagtttagggaaagggatcggaaacagcaaacaagcaagtagtcaaataactatataattacaacttacggtgagtgcaattatgaacataaacacgcatgctgaagaataatgaagtagaaagaataaggaaaccagaacgcaaagggtcaagaggaattggccatgcacagaggttgatgaatcactttccatgcggagggaccacagtaacaacagcaagggctgtgagtagagtggcttgagtgagggtggagtgagacgagatgaggcaggtaggtgggaactgggtgatgtaggattttggaggccattatgagaaattcaaatattcagtgaaatgtgacactactgaaaaagtttagagaagggggcagtgtagcctgattcaagttttaaaagattgctgtggttgccatatggagactagtttaggaggaaacaggagtggaagcaggaaaagcagtgaggacaggctgctgctctaggccagacgagagtccccgatggtcaaaccagacaatgcatcagagaggactgagtggcttcaagacatattgagaaatgggacagcctactgatggatggaatgtgggaatgagagagaaagaagaagtgagatgaccctctagtgtccttgtttgaggaactgggtaggtgatggtaccatttactggcatggggaagaccgaaagagaaagaattcaggagtttcaaatgggatgactatttgagatgcctgtgaagtattcaaggggaggtgttcatatagcattgccatctgactctttctctgggttcatttcctaactgtctaactttgggtaagttacttaacctctgtgtaccttagtttcctcatctgcaaagtgaagacgataacacctatttcatggggtcactgtgaagagtggatggtttgtgacatgtcaagagcttagcgtggtgcctggtacatggtaactcctgtaaaggtattagttgctggtatattatcatccttttcatctttatcattgtcattatcctcatgatcactggcgtcattatcacgcgtatatagaagacaggttgagctagagatacaagttgggagttcaaaagatcgtatttgaaacaatggaaatactgagatgattcacaaggaaaggtggaaaagaaggcccaagtggagccctagttaaaagtggagccagaaaagaagagcaaggtatggctagagaagtaggagggaaattaggcagtgacaccaagaaaaccaggaaagagaacagtgttaacagaaggactgagtggttgactgtagaatatgttaaaaatcttagacaaattaaatttaacagagtttagttgagcaaaaaaaacaattcccaaattgggcaggacccaaaccagaagaggttcagagaaactccagtgcagccatgtggtggaagattttttggcagaaaaaggaaagtgacctacagaaaacagaagtgaggtacagaagcagctgtattggttacaggcttatttgccttatttgaacagaggttgaatagttggccacctttgattggctgaaactcagtgattggcacatgagtaggttccagtctgtttacacacccattcagtctacagtttactatgtgaaagtttatgaaaaaacctttagaataggtaaagagacacctttaggctaaacttaatttaacaaatgctactgactgattaagtaagaagactcaagagtgtcctttgggttgttagcatggaggtcgttggcaaccttaaagagacatttcagtggagtgccaggcagggtggtgacactggatcacacagatatgaatgactagagactatgcttttgagaagttttgatgtgaaggggagcaagaaatggactggtggccaagggcacctgaggagtcaagggagtgttttctttttcggatgaatgaatctggagtgtgtttgaaaacttggaagtggtgcagtagagaggaagagattagttttgcaggaaagagaggggataactgcctggaattccttgaggaggtggaagagggtgggattgctgtggtgcaaaggtgtggcccttcacaggagcaggaacacctgattagtgaagacagtggatgaagatgcaggtaggcagatacatttggtgataggaagaggggagagtatttgtctgatgagcaaagccaaaggaatattgcctttacacactatcttttctgatatagggaattgtgactactctgagaatattgaacatctattaagactcaagagtattgttttaatacaaaaattagccaggcgccatggtacgcgcctgtaatcccagctactcaggaagctgaggcaggagaactgcttgaacccaaaaggcggaggttgcagtgagccaagattgtgccactgcactccagcctgggcaacagagcaagactgtgtctcaaaaaaaaaaaaaaaaaaaaagttgctaaagccttcatcaatattgtcttagtgtcttagtcagttggtgctgctatcacaaaaataccattggcttaaacaactgaaaactatttgtcaccattctagagtctaagaagtctaagatcaaggttccacgcaatcagttcctaatgtggggggccttcttcgtgtttatgtcctcatgtggtggacagagaataaggaggcaagctctctcttggcttggccctcatgaccaaattacctcccaaaggccccatcttcaaatgccatcacatgagaattaaggtttcagtatatgaattggggacagtatggggggctgcaccagcaaacagtccataacaaatacccagacatgaatgctgagttactcaagagtgaccattcatgctgcttttcctaagccccatgactaaagcactaattaaataattataataaaacatctaagtaggtaaagactgtccacgaaggagggaaagagcattaagattagcccttctggtgcataaaacagtgaggccatccatggctttttgtcatcagtaatgtcccaccttagcaaataaatagaataacaagtttacctacacttatttaaatatctatgtatgtatggctaataaatttggaattttgccctttagagaagtaaacaaattatttcctttctctaattaggcttcagatgaccttgaacatgaaaacaacaaaaaggtaacaaaataattcccttgcacattttaaatcagatgcatctaatttaaaaaatcttcaaaggaaggaatcagttgtggtgaaaaaatgattaaatcctgataaaaatcacaaaactagggcagatgagtaagatgattttctaaaagtaggtatttaatgcagtaaggcattttcttcactggaattagagatttcattcctgcagtggaactacatgatcatcagcatattgaatttgaaaataaaaatgagtgaataggtcatcaaatccatattatagcataatagaaaggatgatcttagttcccactacattgacattctggaagatcactgattaattttacactgcataacttctaagagtattatttgatgttattagctattggccttattgtaggaaaggtaaagttacattttcactttctttcatcctcttcaaagttcttcaagtgatcacagtggttttatttagtaagtatttatggtttatcctacaacagtgaggctgacagccacaggcagaagtttgcctaataacttcattctcatacttcagaggttcggaaaatactgccttgctgcctgtggggtcctatcctatttgaagttgagatcgtatcttctcaccctctaaatattaaacttgaaagaattatgaataaatatggtcgcaggcctgtcccaaaatatttgtgagtacattactctcttgttctagaatttcataattcataatttgggtcaacagtatacagattgacatttggtcattgtcatttattagctaagttattttaattctcaaggcatcaatcttctcatgtggtcagtgggtaggactctaatcctcactacacatcacagacagtaatgagactgtgtgtgcaagaactcatcctggtgctcagctcatagcactggtggtatttattattattaaacacacatggaaggaacggacatggccgttgtttggtgggggagcaggaggacacattaagaaaatgataaaaacaaaaacaaaaccaaattacattacttgattattgtttcaggcttttattggtgaaatcagtttgataatttagaatgctcagattgttaagtgatcagttaagacaaacaaattgaccatttttttttttttttgagatggagtctcactctgttgcccaggctggagtgcagtggcgtgatctccgctcactgaaagctctgccccccgggttcacttcattcgccattctcctgcctcagcctcccagtagctgggactacaggtgcctgccaccatgcccagttaatttttttgtatttttaatagagatggggtttcacagtgttcaccaggatggtctcgatctcctgacctcatgatccacccgcctcagcctcccaaagtgctgggattacaggcgtgagccactgcgcccagcatctgaccattttttaactcatggattacatcatccaactaaggaatttatccaactagattcactttatgcaggaaatttagctttgcaaagttctcagcaaaaatattgatcacttttgaaggtatttttgttgttggttttattgttgttttttctatcaataaataaactaatttgttttcttttttctgtatgcaaagtaatgcagtttcaatatgtcctatgcagcaagttattaggttacttttaagattaagtgctttttaaatactataaaccacgtatgtatgttgcttacattctagagtgctacagtgaaacatagtccccaaagaggcagcatcattagcacctgggaactagttacagcaatgactggcctcactgcagactcacttcaacagaaactctgagtgtggggcccaggaatctgttctagtttaaaaagtcttccaggtgattctgatgcacgctaatgttcgagagtcactatttttgatgttgtgcctcaatttgtaaaaatatgatgctatatctatttcatagcattgctgtgaggtccaatatagtaatttctttttttttttttttgagatggagtcttgctctgttgcctggtctggagtgcagtggcacaatctcagctcacctcaacctctgcctcctgggttcaagcgattctcctgcctcagcctcccaagtagctggaattacaggctcacgccaccacacccagctaatttttggcatttttagtagagatggggttttgccatgttcgccaagtttgtcttgaactcctggcctcccaaagtgctggattaaaggcatgagccaccgttcccggccagtaatttcttgaataaagtcccttaaaaatctaaaaatgtcctacaaatgtaagataagcttaatattttatgattacctccttttgcattattcagagctacaacagacactaacttcttaaagtatcctttagcataattgaggaagaaaaagcctttacctttcaatttgtgtgtgtgcaattatctttattaaggaaatctgcagcacgtatccgtgggtcctactgaagtcatcaacttatatgttttcttccttgtgcttgtagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaaggtaacaccaaaggttaaatgcagtcgccttttttgcttgattttcttttatggtgctgatgagcttttatctaatttgttgccatttttctttgtgggcatgggggctgttccacctcaccttatttttgtttcacagaccatagaagccaccttggtatgtggtgacattacattgtcattcacgacttcaaccacaaggtggcgatgagagactatggatttgttagtgctgggcatgtagcttcttctgttcccaagtgcattcacaagactccttttaatcaaaagctggttttcaaaaaaacataagaagtatttaaaaacttcatttctgggctagagaagccatcgtaatcatcattatcatcaaaaattcatatttcggtggtggctgaaaagacagatgtctccatccacaggatgtcaatgaaagtaggagctactgacatgataatgtagcattagcctccaaggcctcatgattcagggtgtaattgcatttatttattgctgtttttcggtgagggtttgatggcagagttcctgaatccatctttgcttttcttttacagaacgcaatattcattataacatgtcttcttttaatgaatcagtcggtcttggctacttgaagacacatgcaattgaatttgtcaagtatccttatgtatcaagtggaatgagtggttgactcacgttggtttggcaagagcctctgaaatagataaatggctaatatctcattctggtggtggagttcataaaatgatatgtgggaaagaccatggcagctgtgacaatctgcccaaatgaaaattgtttttataatccacacagtgaactgtgatcttaagcatcatttgtaaatgtgaaatctgctctgtgctgtctacttgtttgtcattgttggcctagacctttgttgttttagctctttgttgtttatttttctctgctgtaggactctttttttctgttttccttaataagttacagttataacaaacggcaaatgagtcgcatttaccccaagggaggccgagtcgattccagtaattacatgcctcagattttctggaacgctggctgccagatggtttcactgaactatcaaaccccaggtaggagctgatgtccagtgaccccaaattccatgagaacactttgacaggatggtgccagcacttcccatcagttggctgtgggcattttttaaaggaagcagacatatggcaaagcaatgtgttattggatttatataatggtgagaaataaaaaaaaaaaaaccaaaatagagcaaacaatggtagaagataatgtgttgtgattggaatttaattcctttcataaatgccatgactattcctgctaaccattatcccatattccaaaatatttctcatttttcttccttttggatcaaagttgttatctttgtttccagaggcagaattaagtgaaaagaatttgagtatctttgtacagtaacagcgactcatttctcctttggcaaacaccctgaccactgtgaacattcagcaaatatgactgatgcaggggcacttcactaaacaaatacagaatattttgaagtaaatgccactaaaatggtatataaggagttacatatttgaagaggtactaatctataacttggtcctccaaagtgtactcaaagtcaggtttccaatatataatgactttttttttctggaaggaaaagagtaaatttttataattgataaacacatttttaaaatttttgaggtttgcttaagagcctaggatcacagtatcaagactagaggtagcaaaatagaaatagaatagatagaaatatgccacaaaccctcttcactgtagatggtcaattctacagcatggttcttacaactggtaaaataaaacaaaaccagaaagctcttttttccttcaactctttgctattaagagaactgcccatgcttcccaatttgaggattttttaaaatctattttgtattttaagaatccctgtcacttcgttccctgctatgtggattgagtggaagatcctttgactttcattcctttggcatgagtgtgagctgactgtgcttctcatgccttgaaggagcctccccagtgaccagaagctcctcctactggagtcaccattctgcatggggtccccacagtgcttgctaggttagactgtgacgtgatagctaccaatacaatcctgagtgtttctagctggggcccagtaacaaggctctgatgacttcacttacttaaaaaagcccaacttgtgttctcagttgtcagtgagtccataatatggattaaatggctaacccagcttatgttttattctataatattaggtttaaacacaacattttgaagaggaaaaaatatccatcagtttacccatttcttttgcggatgggaagaaagaaaaaatgttattcacttgcaagacagaagtcaaaagccatgtgctgccagtgtagaccccactagagtaattccccctgcctcccatcctggaagcatgccaccaagttttatgcgatacttacctagttcattttccagtcttttaaatcaagtttcatattcaccctcccgggtatctccagggttcctctgcccagggatcctgagacccatcctctcccactgtagcaggttggatatctctactctcaatactcatcaaacaatggtgtgactcctatattgaatccagttttaaaagtgacctttagcatgatctttatgaaaacacattttatgtttaatttaaatgaaacatgaggtcaattcaacatggaagagagtatgccttaaatagaccaagcagaaccttgtagtattaaagagggacctgtgggcctaggagcaatctgatacctattgtttcaaatcaccccgtcagggtcttttttgtctaggaagacaagatgctaaattatttttgtctcttgacagatttagcgatgcaattgaatcagggaaaatttgagtataatggatcgtgcgggtgagtaatatgatttaaactgttttcacctagattgagaactccatactacagctctaatgaagccatgtcattttcaattaggggctacagaatttaagctgggtttgagggatggaatagaaagaaatgaaatacctagagaatatttgcacatatacattcttcatctaccccattttactaagcaggttttgggttttttaaatcacaagtgaagcagttcatacatatgctacagtttaatcctctcactttaaaatcaatagtggaggattttatgtctgggacaggtaataatccctgcacacttggacattaactggagatgtaggcattaaatatgtgcattttacctaggacaaatcaaataatgaagttaatttcatatgtaatgaagttgtgggtgtcgagctgaatttcattcagttgggaataaacctttgtcctctactgattcttttttgtgtcttgtaagtagcagttatcaaagaataatgctgtgaatattgtcctagtttccttaaatagcactcttgaaaactgtgaaccaagaagtgaaataggaaatgttaattctacagaaacactgaaaggttaaatgaaaatataaaattagaattctcttgagataaaaaaaaaaaaacacaactatgtggtcatcccctcaccccacctcagcctcatgcatctgtccccaaacaagtaaatattaataactccagaccactgcccaaaggcctgtagaggaatccaatggaaaactatcccgtcataatgatgctattaggaatttcttcatggtggctcacctgattggatatctttttatcactgaacactgccagtcaagataacatttttcagtggttgtgagttaggaatgacttttcagcatgcactctgcctccctctgccagcctggtgaatggttctctgccaatgtggctgcaaacacagtgattatgctattccccaaatcacccaccacttacatacctggagcatgccctacattttcctctgctgtgtgctttggaagaaaataaattgtgtagctgggaagagaaagatctgaattcatatttcagaattttgtgaaagcaattttgttatttaatgccaagtgttccaacccaggagattttgcgcataaattgctttgtagacctcctcctctcccaagtagtgggccaaggcatcaagccccaggggttcagccctggactgtcagtaaaagccctaggctgggagtctaaagatcagggtttgagctcagctcccagctgctcctagttcttgctgtattgcctagagcaggtgtgttagacccagagcctctcttctctgcttgataaaatgaagacggtgacacctgtcgcacagggtttgttgtactcaaaggaaaaaaaatgtcttttttctagaacgaaacagggaactgaaaaagactttgtcctttgacaaaaaccgagtcctttctgatgagacccacctttgggcttccctctcagtcactgtagaatccagtctgagcaacaatcgtgctagttcagtttagtgaaaatccccagcccttggtatctgaccaccctggatatcctgtcactttggcctgccttcagcaataatcctatcaagtcagtttggccagaagtccttatccttgatgtttcctcatagtaattttccatctgctggcgctcaccttactccatggttctaaatctccatgtacgcttgttggggtaagggttgagcccttatacctatcaccatggctccctacccctttgaataaagtccactttaccatgtttaacaagtgtttgtgtacatttttttctttaacagtttacgacagctcagtcaggttgaatgagtgtacgaaagtacttcaggaactgcacatttctgtgcaaaagtgagatttaagaaaagcttaaggccttgtgatcaatcacacacacagacattgcaaaattcaatgagtgctctgttcagtcgtcctttaaggaccccaaggagtcagcctcagcactcctggctcttacaggacccgtcgggcatggctgtgctcacttctgaaaacttgcagtggcccggtgatgcttgaagcactttccttgcccacctcagcgatcacacctaagatgccatcagctgtctaacatgccatgaggaatcctggcagcctggccggatgcagggagtattgtttctgtataaaaaaaatcctgacggctcggcccagtggctcacacctggaatcccagcactttgggaggccgaggcgggcagtggctcacacctggaatcccagcactttgggaggccgaggcgggcagatcacaaggttaggagatcgagaccatcctggctaacacggcgaaatcccgtctctactaaaaatacaaaaaattagccgggcgtggtggcgggcacctgtagtcccagctacttgggaggctgaggcaggagaatgtcgtgaacctgggaggcagagcttacagtgagccaagatcgtgccactgcactccagcctgggtgacagagcaagactccatctcaaaaaaaaaaaaaaaaaaagtcctgacaatcctatgttgtttgtttttcctagaatttctgcttagccattattagcacgtgcagtgtctcactctctccaccgttatttattttttcttaagacagggtttcgctctgtcacccaggctcaagtgcagtggtgcaaacgtggctcattgaggccttgacatcctgggctcaatccatcctccctcctccacccctcaaatagctaggggtgcccaccaccacacatggctagtttttttatttgtacagatggggtttcaccatgttgcccagactggtctcgaactcttgagctcaggcaatctgcctgccttggcctcccaaagtgctgggattacaggcatgagctactatgcctgacctcactggtcatttgtaaatgcgttcatttattttaaaataccttcacagaaaaggatactgttgctactttagcctgaattctgtgctgatgtgttggacgctatgtgactgaaagcatacacctcaccagaaaagctgaaaaatagcctgtgcagtggggcagcccagcttgataaagtatcagcgatgctgttgactctgtaatctcctaattccccttcccatacacccagctggtggcaaaggctgtcagtgacagggaaaagagaagaaattgccgtcacctgcatgcctctgtgttccatggcgatggtagatgtggggcccggtgctgcacaggagctcctgtcactggtgctcgggcactgcatggttctcaccgtgtcacccttgtggttctcccacccacctgcaaagacttttaaaaactgcccctttgggctgagtctgaggactgcatttcttaaagaggcattctgtgccctttaggcctgtggaggcaaagaatccctgttttatatagaacatcagtgtgcaaagtacacaaacacccccaggatctagcaactgtagcaaaacgtcagataccctcctgggaaaaccctctgtgctccctggctgatcttgtgggaggacgcaccactgggcccaataagtgtgaatgttaccaggaaagtgagcagtgcttttaacagtctcgtttttgaagatggaaaaatggaagacatttccctaattgcaaatgaaacaaaatagtgtaaattaatacctaaaatctttttagactttcataggaaagtgagtgattgatatcaaaatggtatgacattttatgattcagaggctgttttttatacagcatttctcccttgcccacaggccgtacgttctaagaaccccagtggatgcctgaaaccaccaaacccaacatgtattatatatattgtggttctacacattgcatacctgtgataaagtttaatttataaattaggcatagtaagagattaacatcaatgactaataatggaacagttataacaatatagtgtaataaaagttaggtgaatgtggtctcaaaatatcttaattttttctcttttatgtttattggctatttggatattctgttttgtgaagaacttctactcattttcctattgggttttctatcttttaaaatagattttttatttcaaatttttattttccaatttttatattaggttctattttaatatttttggaacagagttgaccaggggtagctgaagcctcagaaagcaaaattgcaaataaagggggatactgtatagcatagcaacttgcagttatcatcagcagccattttgctttcttgcagctaaataaaataatggcatgttggacaactgatggcatcttaggtatgatgaaataggatgcatttccttatgaccccattttctcattcttggtgctcctatccacccacctggttagcaacccttcttctctccctcgcttgccttccaaggccttacacagtccacagaaaatccttggatccctgtcttggcattggctttggccttgtgcctgtgcctaccgcacagacctagatgtctggaatgagttcattttctgtaccagaaagcaccaaacagaccatctatgtcatttgcagggcccaatgcagaatgaaaatgaagggctcctgagaatttaggatggtggatgcagagcattaaaccaagcatggggcccttctgagttcagggccctgtagaactgcacaattagcacatccacatagccagctctggtgccagattctggcttcagcttccctatcaatgccccagccccctgcaccctcacagccaccagggatatgagaggcaacctctgctgctctctcagaccgccttggacccagaacagatgctcctttgaccttcaaagaaagcttgctaagtgtcctatcccaggccagggcttatctcatggtcctgacaagcttctgcatactctgttttactctcttcaagtatacaaaatgaacccatttcaccggagcatgcctgctttggagaattggatatgggtttcttgcccctttcccctgccatttctcattttggatcaattcactccttcagagatgagtgttctatgcagatttgaaaggggggatgtggaagaatgcttttgaccctgagatgtcattgtgatcccgtttcttattttggtgggtaggaagggctcttgatctttaacaaaggactgtggaaagtgaggaatctctggacactcacttcccaaggagattcagaactggaaaggtgactccagtcctgtattcatccaagtcccgaccttcctcgggaggcagaatccctcatttgccacagctggggtccaaatgctgcctgtgtcatgaaagccagacccaccattgttacctcccctcacagtctgtgtcggttttccttccagagaaagctggtgggcttccctcggagatgcaggcgtagtattgtagctactcacctactttccatcctgattctttaccttttgctgtatcatcatattttctagttgccaactctagccacaaaaaaagctgcaaatctaaaattccatgaatacagaagataatctcttctatatagagagcttttatattaatattgtgggttgcattctcttggagacaagagtgttcaaaattaccttcaacatttcaacaattgtgtaaatgtctatattcttgataaaaaatcagtgttgtctcttaaagattcctttttggactatcaaatgtaagggaatatttttaacactttgttttttgttcagtcttagaagataacaatgaatggtgactttttcaaaactaagaaaagtgacattaaactttaaagaaaaaatatcatgactcaggatcccttttgggttgtattttaacagataataaagttgacatcatctagacttgaaattaataaaagttatgcttctaagaaaaattagagatttgagttcccataattttgattcttttacatttaaaagcaaacctttacttttggaaaaaagtacttttattttcattgatgtactgctcatagtatggattctttaaatctatggttatacttatttctaataattttttaattttttttaagttttttgacacaagtttcagggaaattatggaatctgtgattatatgaccactaccccgtggacatgaggggcagacattgtgtagtgagggtaattgcagaacattttcatcgcctcaaaatctgtatcgtttagctttcatctcccaataggaattttaatctaccctctgtctctatatttgcctattctgaacatttgatataaatgaatttatataacatatggcctttcgtgcctggcttctttcacttaacataatgttttcaaggttcatccaggttgtaatgtgtatcaatactttattatttttattgctgaataattttccattgtatggatataccatgttttgtgccatacattcattcatcgatggacatttgggtaatttccatctctggattattacaaataatgctgctatgaatgttcatatgcaagttcttctatgaatatgtctttccatttatcttggttacatgcataagaatggaattgctgggtcatatggtaactctatgtttaactctttgaggaactgccagactgtctttctaagtgaatgcatcattttacactcctactagcaacatatgagagttccaatttctccacatccttgtcaacacttattgttatctgactcattaattacagtcatcctagtgtatacatagtgatatctcattgtggttttgatattcatttctctgatgactaatgatgttagacatctttttatgtgcttcttggttttttgtatatcttatttggagaaatgtctgttcagatcatttgaccattatttagatgagttattctttatgtattctagatacaggcctctaatcagatatatgaattgcaaattttttcctttttgtgactagtctttttactttcttcatagtgtcttttgaagcataaaagttttcaacagaaaatccagtgtatcattgcatgtgcttttggtatcatgtttagaatccattgccaaattcaggtcataaagatttgtccttatggcttcttttaggaattttgtagtttggctcttgcatttagttattttatcctctttgagctaatttttgtatatggtataaggtaaagatccagttttatttatttatctatttatttgcatggaactatcctattatcctgtcactatttatttaaaagactattctttcacccattgattggtcttggcatccttgtcaaaaatcaattggccatagataacgtggatttatttatagactttgattctgtctcaatgagttatgtgtttttctttatgtcagtaccagactgtcttgattaaatcttgtagcttagtaataagttttgaaatcaagaagtgtgagacacccaattttgttctctcttttaacattgttttggctattcttgatcccttgagtttctatatgaattttaggattagcttgtcagtttctaccaaaaagtcagctgggattttgatagagattacactgaattcacacatcaatttgagaaatacttccagcttaacaatatggtcttccaacccatgaaggcaagatgtcttcccatttatttagctcttctttaatttttttaaacagtgttttgtagttttcaaattgtagacacttattttttttaaaaaagtttattcctaagtggtttatattttgctgttgttatagaattgttttcttaatttcatttttgcatgttcattgtcattgtatagaaatacaattgactttttatatgtttatctggtatcctgcaatagtggtgaatttatttattccaatagtttttttagtggattccttagagtttttttttatttatgggatcatgtcatctgtgactagaaataggcttacttccttctttccaatctggatgccttttaatttgttttcttgcctgattgtttctactagaaatggagaaataatttatttttattttcacctacctctagctgaaatgtcaattacctttgattgtgaatgtagacaacaatccacagtcacattagtggtacccgtgactctctcaccaatgtaaatcacagacattgtcatatttcactactattgttacagctgtctcaaaatatttttgtactttagattattgtcatcataattagatcttaccattagatcttataatttaatgcattattacaagtacaattaatacagaggtagaatatcacatatttttatattttgataactatagctaatataattggtttttcattgttattctttgcattttattttatacatataaagaaaagtatttaaaggtgaccaggggataaaaaagttccagagaagatgataggatcaggaagtcctggataccactgaggctgcagctctttaaggttgtgcataagggcgggcacattctcttccatccttaggaccctctgcctaaaatcctagctcctgtgttacagatggagaaaaggaagcatccattgtttcaactagcgagtgttttagtctttgtaaaacctactaataaacttctatgctattgtcctaccaggtaccttctcaaaccagatttcatgaggcggcctgatcgaacatttgaccccttctctgaaactcctgttgatggtgttattgcagccacttgctcagtgcaggtaaggcccctgctcatcacaaggtagtataaatgtatacacaagtggtccttgaaagaaattataaaatattgaatgttaaattgcaagatccatgtgctgctcacaactttgacttaagattccaccccctttttaaaaaatgagacccattttttcactagtaaaattattagctacttaaagtgaaagataccatcaaaaaagtacctgctacttgattccatttatacaaaattctagaaaatgcaaattatagtgacagacagtaaatcagtgatggcctttgaaaaaagggcagggaggaatgggttacaaaagggcacaaagaaacttcaggtgatgatacaaatgtttatcatcttaattatggaggtggtttcgcagatgtgctcatatgtcccaactgatctaattttacattttttttttgttttttattttttgacactgagtatcactctgtcgcccaggcaggagtgcagtggcacaatctcggctcactgcaacctcctcctcccggtttcaagtgattctcctgcacctgtagctgggattacaggtgcccaccgccacacctggctaatttttatatttttagtagagatgggtttttaccatgttggccaggctgttctcaaactcctaacctcaggtgatctacctgcctcagcctcccaaagtactggcattacagggatgagccaccgtgcctagcctaattgtacattttaaatgcatataatttattgtatgtcaaatatacctcaaaaaagctgtttcagattgttagctagaaaataatgtaaacaaaaaaccctaataagtggctatagtcatttaaacactaaatgaaaaatcatctctccatagctttatcgtagatagactaacattataaaactgtcctagctgaccagtgtcaatatcagtaatgacagacaaattctagcttcacttttctgtgtgtctcttttcaagacttctaaaagaattcattaataagtatggcatgatggaatttcagagctatgaagggtcttaggacatacctgaattcatcacttcatttcataggtgtagacacttaggtgagatgaagaggccgtggacactatttgtattatgattcatatatattttttctttgttttttttctagacagttctagaaggtagaacatctgcttgaaacagctggggtttttttgcctatagtagttgttcgataatgttttggtttgatagaaatgaatacattattgccatagataattgaaattcctgctcccacccaaaagacagaatttcttacttcctgattattttttgctactgatgcttacacagagcttacttctctttgctctcgttcgtgctgctacaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtaggacattttcagcacgtcaaacttactctaataacttgggagccatgttttagttcacagacgctacacgatacaggggcacttattcaaccgacaacatcttctttttctcttctcctaatggctaacttctgtagctgtcataggatcattggttctatttggccctgcctccttttggttctcctctcctccttggaagagcccatctcctgcacagcagtgcctcagctctgggtttaccatcttttagaatgagtccttgctggtggacaccatcgtacactagagagttcttccctaccctggaagttactggtaacttacactattcctttagccaagtagtcaggtaagatgctgcactccaaaattttggtcaatagatgtcactacatgggtcagttggcatggtcctgtctctcctgaaagagtgacacctgttgcctacttgcaggtcttatccttcttgtactgttgttagtgttttatttttttctcctaataccgtatgttggatcctaaaaacaatcacagccattctctctaacgttcggttgttaatctcttattcaccttttcccttggtttattttttgtctattgaagatgcagtggaaaatccgcacaccggcagtgctgtctccaagaatgttcactttcctttcttacttactctgttgtcctgaccacaatgatttcttgctgcttctttaggcacaagttttccagctggttctgctccatttgtacatcatgcaacacagataatcagcttctttccttaacaaaatagggattatccatttcagaatagagtaactggcttacagaaaccaaatgaagggagatcaatgtaggtttgatgaaacaggccattttgacatttaagtttacgctgggatccacacaatcttcgcatcccattgtcttcttctctgcccctgtcaggatatggtgtaaattacatgcatagctgtgatttggttttttccttccctggtatttccaatttgttatagctggatccgttaccagtatggctagtgttctttggcatagtgaataatccctactcacatttctagaagctgagaaagttgactcaggcattctttgttttggatgaatgagaaaatacccagcttagtgtttatatataatagttctggcactagaaacgagatgccaattctgagtccttctctgttcttcagaagttaaatcgtttttttcattgctagcaagtgctttaaaaactttgttttctttcttgtcatttttgtatttttcactaatctcacatggcaagaatggcaaatcccaagcctctattcactgcataaggagcaagagagagggaaattggctaagttaccatggtttctcctcttcatcttcattaagctggaattaaattatagccttcagatgtaaataggcaaccagtccattgtctagctttaaacatagcactcagatcaagcaagatgtcctggttgcttttagccaataaaaaggcattcctgattaaacacattggataccctttttgtaatgttgctattttgtaactgaatcaggtttctgctatctgaactcagattttatgttcatttattccgtttggggatagcaggagtaggtgtcttagaatcaaagtatgttaatgtttctagctaccgcatcttactctatttaacatcccaacatttgctggaaactgaggagtacaagaaacaaggaggacccaaatttatgtacaaaagttatctcttatgcatgaagcatttattcagagatacttaatttatttattcagagatactttatttattcagagatactttcgtattcttaaaaacaaacaaatatagatgtcagcaatatgccagatattagatcacaggattagatccccaattcccaggccccactctgtcactgatatgtctaagatcaaggaaagtggctttatttctcatccattatatgggtggggacaaggatcaatcacaagggttgaagtggtaatctttaacattcatttcatctaacatttttcacgagataatttccaggaaacatgttccaattgcttttctcagtgtcttgggcactgtagctcatgcagtacattttggggaatgcagatggatcatggacttactttcaacatcagggaacatttaagaacagcatggatttggtccacactccttagagtcatggttcttgggcgctgcattggaaaaatcagtgaaagtcctgttctgtttgcaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggaggtaagataaacatttgggtacggaatatgatatagatgaggtcctagattataagattataaaacatcttgtccatgctttaaaaaacaataaaaatactgtctattcctgctaatgctgccaaccctgattaccttgaatacatcaagaatacatcataacctcaggtttcatagtaagaaatgaaagtacaaaacgagatgatctctaaagtcctttcttattttaaaatactataattttatgttgtttatcaatttttacaaacacattttgtgaagggtatatttatattgacaatcagactagggaaaaaaacataaataaggtgaaaccatagatatcttatcaatagtatcgctaaaagatttaaattgaactcagctatcaacatgcctgaattttcttccaaatccacaagaaagttcaatttcataaaaaatcctagtcatcaatccatatgctttaaggtaatcaatgggaggaatccaaagctagattaagtcatagaattttgcttacatgcaaacatgttaactttttatggcctccatctaagccaatacattaaaagaaagcaaagatcctctatattgtcagcctgttgaaccataaggaaatagtacagcaggatgatggcatccgattagccaagggttcaaatccttactctccactgctggcagggtgatcttgggaagaggatgtaacctctcaaacccctcatttcctcccctgcaaagtgaagataataataactacctccctcatagcattattgtgaggtgcttatcattagagtacatgatatagcaaggctcagaaatgtatgagcgcatgggggtgggcggggtgtctgtagacacagatataatttctatacttcactggaacacatcactattttatctggggaatatgggataattttgctgtttgtttttagtagtgcatgcttctgtggagggcagattttctgcaactaaaccacaactttaccagtctaatatcagagtcaaaaattaaaataagccatgaggatttttccatcccaaaattcatagtccaggctccttcctccttctcctttgtctttcataaaaaaaaaaaaggaagcacattagaagctacaacatacagtaatagaggtaacaacccataaaaagcctggaaagggatgctgtgaggctgggtaagaggatcagaaaggggcactggagacaagtggtaggtttaggagcagcagtccgtggcaaacctcagaaacctccctgcaacacagcatggtggtggccatggggcatcagctgatgagttaaatcatactccacatacgtgagcttagaaagcaggaactgtggaatacctcatacattttagaaatagttgtataaacccatatgatggaagatttagaagttttgcctctgcatgggttaacttcccactgaaactctaattcattcttgggaactaagccactcgaatagaaaagggaaagaaatcatttgtttagcttctactttatgccaagagctttatgtaaagagatccaaaagcatgaagttgttcagaatggatgtaagcatagggagatctgtgctgcagaaacatctgtatttacaatgtagcttattacccatgttgtatttaagtatttagccaaattaatctctttaatattagtcctgccagtattctttcctaacatgtcattgtggctgcttactttttatcagaagcgtttgaaatttctatgtaccattgatgagattctgcagtcgatgccttaaccagagttgacattcaaatacaatttattcaaaattctctggtcatttattttatatgtgaagaaaccagggacagacattatgcggtgtcagggacttccctgtagataacagaagaagaatatgagaactgtctttttccaaatctctgatcttctttatagcttcttgacttattcaaaatatacttatattttccctgtttagccaacctcccacattcatatctcagtgtgtttatgtgctgaaccagtgagataggaaatctatagagtctgtgttccctggagtattgatattccctcttcattccacaggaacaagttcaagatgaagctcagcaccatcacactcagcattttctagaaaaaaaaatgttttttttcccctaggaaaaaaaagaaactcatcaatatacatcattagatttatatttagctaaagaaagatagtgtggattttcattacttttttccacaaatatgcatagcaggtttattctataaaaagttaagtagctaaaatatgtatcagagagcaattctgagaacacagaggatcaaatgagggtcactcacaaatctgctgcccagagacagctattgtttacttccagtctctttttttcctgtttgtttatttatttatttgagacggagttttgctcttgtcacccaggctggagtgcagtgacacaatctcggctcactgcaacctccatctcccatgttcaggcgattctcctgtctcagcctcccgatagctagaactacaggcgtgcaccactatgcccagctaattttgtgtttttagtagagacggggtttcaccatgttggccaggctgatcttgaacttctgacctcaggtgatccacttgccttggcctcccaaagtgctgggattacagacgtgagccactgtgcctggccttttctgttttatttttaataaaattaaatcttactatactgctaatttggaattctaatttttttttagaatatgtttccatgtcatgaaatatttttatatttttattagctgtataggattacattttatgtcggccataatttagttatggataaacactgaagttttcttccttggccgctgaggaaacagagttaggaatttgagtgcaactccttctgcttctccttctcatttctatagcataaaaactctcaaaactggccaggcgcggtggctcatgcctgtaatcccagcactttgggaggccgaggcgcgtggatcacatgaggccaagaattcaagaccagcctggccaacatggcaaaacactgtctctactaaaaatgcaaaaattagcctgccatggtagcacacgcctgtaatcccagctactctgcaggctgaggcacaagaattgattgtacctgggaggcagaggttgaagtgagccgagttcatgccaccgcactccagcctggttgacagagcaagactctgtctccaaaaacaacaacaacaacaaaataactcccaaaagacacaaagaaataacagagcagtgatggctaccatgagttctgaacccttcctggctgtttctaagcagcccagatgcaaaatgtccaacaatacagtctcctatcagaaaaaaaaaaaaagtaacatttaggacagatgattaggaatgaatcatgaaaacttggcttaattttttcaatattattttgctacaaaacgtaaagaaaaacaaccctgtcttttactccctctgtcatacacaaatagaagtactagattgggtgctaggagcattcttcctttgtcaaatccaatgagactccgagtgctgggattatctttgctgctttatctgtgggtgccaacgccaccgtagatggcatttgcccattgcaaggctttatcagtgttagacactgctgtaggagacaggaagcagttccagggctaatggcaatgaaacgagggtcagtatttctttttcacccactgttgctttgggtgggttttatcacttgtgtttattttattattactgagtgatagggaggggagcaaataagagagttgatgctttgcttccgaaatctatggagcctcagcattgtattgaaatgtcactccccgctgtgtttcatgagcctcccagcgctttgttcctcgggcagtgctgatcattacttctgcaaccataaattttgcctcctcttctacaactattttatgtcagggaagatgaagtgaccctctatttctttgtacatttcccctttccaccttccctatgattaaaaatacatcttgggtctctgcccagggttttcatagggttgctttccaaccatttttacaaagatagttgactgtttcttatatcagatatttccagagaaagaatgttcttaattaagatgccattcctgggaaataatctcaggacttcctgatgcagtttaaacttgttccatctgtcctcttccttaagggtgctaaaatgtcatattttattaaatatttgttgaaaaacccagttgcatattcacagtgatatctttcttgtggccttttctgtactacagaaaatattagtcagacttcaagaagaaaagctctggaggggaagggggcaggatggattatggtaaaatactttggaaattgctagactaagcaaatttaaacaggcttatctattgcatggctcctgggatgtatggtgaatgcccaaggggagggggagaacatgagcatttcccaatcttatttgacacaggatcttgttgcccaagcacctactgtattttctaccattctaggaaatgcagtttgagaaatgcttaatcttttggtaggaacccaaaggactaagacaaaatcatagacttgggatttgcctttctttatcagcaccacattgcagctgataggggaaaaggatttttcttctgcctgtacctcttggtaagttaggaatagtagaggggaacgggagggaacctgggccaggagtgagcacataggggtggggagggggagtgtaggtgccatgggcagtgctcaccactgaggcactcaatgatttgaaaagcattggttaaacaaacgaaaatcaactgagttctcctgaaaagccaataagcatctggaagtctgtactaaggaattgctatcttcatttccattcttagagacacctacattgatgctttcaactctatatgaaagtcaggaagcatggcagggaggaagggaggggaaaagcagggcctacatggagagtctttactaggagagaccagcttcatggaaatgacattatgcccagaaatagatggtgtttttaaaaatacacataagtagagctttaagttaaatcttaatgaaagaaccaaatcagaaaaagcagactggtttcttttaaaaagagaggttccggagcccctgctgtggcctccaagaatctagggtgttttaggccacctacatgggttctgcagagtcaggagtttgcatgcatccatctctaccctgttagatgtacaatgtggctccccccagcaaggcctactcacctgccagtggatgccgatcagcactggaaatgaattcttgccacagtgatttatcctgtggaaccctaaactaaatgggaaataggcagccacagtattccccaataaaaggaaggaagcccagtgaaatgtcatattggcaccaaagaaagatactgggtttacttgaatatgcaaaactttggccaagaatataccagatttatttaaccacttcctcaagttatttttctgggctgaggcaaggaaaaaataaataccatttttcaagtacagttacacaagtaggtaagtatgagatatttgaggtagagcttttcattctctgattacagattattttaaatgtggctattaaaaatcaatttccttttttgatatgcagcactcttcgtatctacctatccatatgtctcacatatatatgcctctggccagtggagaaactgaattacaatgaaaaattatcttaaagatgccaaggcaggccttggctccctaatgctgagccctttgcactttggcagagaatttttgtcagaactgtcccaggtattcaaatgccattcttctgcattgttctataactccagctacagaatgaacacctgccaccacatgacccaattagacatcctagaaaggggtatccaatcttttggcttccttgggccacattggaagaataagaattgtcttgagccacaaataaaatatactaacactaacgatagctgatgagctataaaaataaataaataaataaataaaatttaaaaaataaaaataaaaaaagtttgtgcataattctcatgttttaggaaagtttacaaattcgtgttgggccacattcaaagccatcctgggccacatgtggcctgtgggccatgggttgggcatgcttatcctagaagtatctagtttgttatatgaaattgctaggaatgaagcatccatttcaaatagcctgctaactttagccttgctcaaggcatttagtccttttgtaatctcttttttgtcttatctgatttaatttgaacaaaccttactttacacttttcatatttttgttgcattttgttcaagaacattatattgcattattattgtatattgtaatttcttaaaggtaaaggcagcctctaactgcaaataaaacatctcaaataagacgtttcaaaaaataagaccaaataaggcagcatgttaggatctggcatcatatgtccctaatagtgtctagatttgttaatattggtaattcaagatagagttaagtaatgatatttatccagctaatggataaatcttcagcaggctccgattttgttgtatcatttaggtgacatctacataatccgatagcagatggctgatgagagcatctcagatagcttgcctgtgacaaacaagacaatatgtggattcagctaggtcaggattgtgtagaatcagccctagaagctgagaccaagacattgctgcataaacaggaggaaaaccactggtattctagcaggaggtctccaggggctgctggaccctccatagtcttaatgataaagcctgccttgtacacttaagcacatgactttttatggaagatgcatacccaagaatttaagtagtgaatttttttcccctcaattactgttggcaatcgaatgtacagttgtcttgttctccctctgccctagtttcctagaactactgtaacaaataaccacagactgggtggtttaaaacagcagagatttatggaggctagaagcctgagactaagtggtgggcagggccatgccctctctgaaggctctcgggaagaatccttccttgcctctttctggcttctggtggcttcagacagtccttggcattccttggcttgaagatgcaccactccagtctctgcctctgttgtcacatggccttcttccctgtgactccatgttctctcccttcttatagcgacactagtgattggatttagggcccaccctgatctagtaggatctcatttcagtcctcttctaaaacctaagcaaagaccctgtttataaataacatcacgttctgaagttctaggtagacaggagttttggtggacactattcaacctactccaccctcttaattctgcttttaatttttattttttattctttatgagacagagtcttgctctgtcgcccaggctgcagtgcagtggcatgatctcagcttactgcaacctccacttgccaggttcaagcaattctcctgcctcagcctcccgagtagctgggattacaggtgtgcaccaccacacggggccaatttgtgtgtgtgtgtgtttgtgtgtgtgtgtgtgtgtgtgtgtgtgtgtgtatttttagtaaagataggatttcaccatgttgaccaggctgatcttaaattcttgacctcaaatgatccacccacctcagcctcccaaagtactgggattacaggcatgagccaccgtgaccggcctccgctttattttcttagtactccttccattcatcattcttcaataactattttaaagcttattaagaataaattttgttaggaatgcctatcaggcatatgagttatataaagtgctatattatttaactaaaccattaactttctgataaaatgacaaagaaatcattttttgcactaagatattcctaaattcatctttttatagaaaagttgaaagcccatctaagtatctaccagtggggaatagtttgatatagaaaatcaatgtgacatttcccatttactaaaaataattttcagaactatgccgatataatatatgcatcaatgaaaatgcaggttatataacttctaataaaccatggaaaatatgtattcatgtgcaaaaatgacacaaaaatatacaaaaatgcttggttaggatagatggatcatttaatatcttgctttattgattctttaatgtcttgctttattgattctgtaacttgttttaagtaattaaagtattatctgttattcctatggaaaagactaccagttactcctcaaaaatgccatatactctcttcaggcccccagactgattatatgttattaaaaattagcgagtatttgtttcctaaccacccagtcctgtgtgttatcactgaaatgtgccattgggattggatgcttggcaaaacatatctgaagtgagaatgtacagagaagcatagaccaagtatatctcctccaaagaagggcagaaaagtttaatggatacaagttaaacctcactctgcctcataatggtgtggacaagtggcaagaagaggcatttgggagtcaggcacaaagagttgtgctaaaagtctaggttggtcaaattgtgtcttcatgtgctgaaggaccttaatcatgcccacttcatggcatcctgatgacgatgagaaagccatgtggttctcctaacacagcatcacctcatggttgaccagtgaccacagggcagaaggatgctgagtagaaagacatgaattggcatcagaggagtcttctgaacattgcatttcctctctaagcaatggaggtagaccctgtgtctcctccagacactactgactgaagagagatgtcagcaccatcagcaccactaaaagtaatgttgggagccaaagtattgccatgagaatcaccgaattgttgtgaagagagatagcagcagtatgaatgcagagatcgagttgccacctcctgcaagcacctctaaaagtaatgttgggagccaaagtattgccatgagaatcaccgaattgctgtgaagagagatagcagcagtatgaatgcagagatggagttgccacctcctgcaagctgccacctcctgagcctacttgaggaacttagcgtcacaaatgggacaaccagcctttatgtccctcaatgtgatgcatataaagtcacagcacctcctagaagtatccttaaagaaagatgtcaagagggattgctttagactaaaattgacttaagagacataattatcagagacatagtgtgaaatctggtaccttgattcaagcaatgtaactataaataggggaaatattaagatgggctgtgtattatatcatagtaaagaattacgccaattttgttggatatagcattgggatggttggctccaaattaaatttagagctgcagagacaagttattaggaattaaatgttctgatatatggaattcaccttaaaatatttcaatagagaggaaagagaaaaaatgaaaggaatataaaggaaatgtggcaaacaaatgtttataattgttgggttatcatcataaatatatgaggggttattgtactgttctctccacttttgtgtatacttgaaatgttttgtaacaaagagtttaaaatatataaataaattcctagaatattaacttgccaaaaataattgtctgtgatttttttttcctgagcaagatttaagaactaatttttccacagctgttgttgagaggcaaagagttcttagggatcatgggtgataaaaacagaccttctcacatgccactggtgggagaataaattgatgcaatttcggtggagtgcaatttggcaataactaccataggacaaatactcttacccatcattctaacttctaagaatctattctgtaaatatatgtagaggtatgctacgaaatgttcaaagacattcactacaatactttaatagcaaagaactggaaggacaagctgtctaccaataggaactggttaaagaaattatcaccattcagagaatggaaagtttaagcaacccttataattaatgtattagagctatattgccaatatgagaatgtttcccaagatatttgacattaaaaaatggtgcagaaaactatgaacccatttggagttttaaaaaatatcagaaaggatacaagaaatggataataatagttaccttctgggcgtaggattggcaggagagaaagttttcacttttcattttatatatttgaatgtttaccatgtgcagatgttattttattttatttgtttattattatttttttctgagacggagtctcactctgtcacccagcctggagtacattggcacgatctctgctcactgcaacctccgcctcctgggttcaagtgactctcctgcctcagcttctcaagtagctgagattacaggcatgcgccaccaagcccagctaatttttgtatttttagtaaagacggggtttcaccatgttgcctaggctggtcttgaactcgtgacctcaggtgatccacccttctcgtgttcccaaagtactgggattaccggcgtgagctactgcgtccggccaaccatgtgcaaatgttattttctgttataaaaaggaaaagaaaaaaaaattgaaacctagagaattatgtgccccgtgtactgagaatgttatcttaagaattatcctaagattgtaattaggaaggcgattctgttagggaaaactttataaacttacacagtatttaaaatgtataaattatggatggtttcaagttaacaagaataattttgccttctatagtatgagtaaattgtgcacgattatatgaaactctgaaagtacttggaaatcttcaaatggcattaatataaaatattaaattctactatcttttaagttcaagttatacctgagaaaacactagagaaagatttcattttgtctaccatggaaccaaaattggctttgaatatgtattatccttctgtatcgaaaaataagacctacctgcctcaggtactttttgtgttcatcatctcattgaattatcatgattattctgcagggcaggtggtatccaccctaatttccagataaagaaactgaggctggggacattaatcaacttgctgaaagtcacacacaagtgaagaaacagtctagaacccacacacttcactcagtttgtcctgacactttgcctccttcatatcaggaaaaactttgtatcaggaaaaactaaataaaaaaatcatctggtctttggcccttgcttttaactcctttcttgttttctgcaactagctgtgccttcctcagtgtgtcttatgtcctaggaaaagattattaacagaaagcacaacaggtatccaggattgtagtttattaagcagagttttaatgaatattttcagtaaaacagagaattaacggctcattgggtttttttttcccctagatatcgtggatgctttatcagatccaaagaaatttctctcaattacagaaaagagagcagaccaaatgagagctatgggcattgaaactgtaagtagaaatggttgattaaaggtggccaagttgtgggagtttgattatcaaacagtgtttacaaaaacaagacaaagtaatgaattagcaaatttaaggagggtttttaaaactgagctcatcaattcaacaatagttaactttctacaaaagtgtggcatgtttaataaaatgtgactgccatcagaaaaatccacttcatcatcagtggcttaactcacatctggggaccccttccccattagaaagaaaatgcaaaacatttgttatacttttgggaaagtttaaaatgtaggtggagcatttctaatcagaaaaatgcaacatccgaaaagttccaaaattcaaaaccttttgagtgctgacattggatagtcatacctttgctttttgaagtttcactgtacataaactttctttcatgaacaaaattactaaaaatattgtataaaattaccttcaggctgtgtataagttgtatataaaacataaatgaattttctgtttagacttgggtcccatccccaggatacctcattatgtatatgtaaatgttccaaaatctgatatccaaaacatttctggtctcaagcatttcagataagggatattcaaactgtactgtacaggatgtttctatgatacactgaaataccagttaacctagttcagtgaattaatgataattgctttttatttttaattatttattttttaacagataggatctcgctctgtttcccaggctggagtgcagtagtgtgatcatagctgactataaacttaaacttctgggctcaagccatccttccacctcagcctcctcagcagttgggactacagatgcatgccactgtgcctggctaatttttttactttttttgtcaagacagggtctcactctgttgcctaggttggtgtcaaactcttggcctcaagcaatcctcccaccttgacctgccaaagcattgaaattactggcgtgagccaccatgcccagccaaaatggcgtttattattgatttttcactgtttgccagccttacatcccaaccttctcccattccagtgcacacgtggattgtttctttgtttttaaatgttctctttaccagactcctcagtttggaatggatgtagcatctctccaatagctagaaaaagagaaagtattctctgcttgttaagaagttggatcttctttccttggctggatcctttgcctttaagagagtagaagtctaggaagagtatggtagaagtttactggattcagtaaaataaagaatgtacaagatatttgaccttgagtgacattcatttgggtcaatgtaaatgtttctgttccagagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtgagagagagccgttgggttccttatcttctgcacccaccttaattacacagtgtacaatatctatagctttaggaaatatataaattcgaagttctttgtgggaaagaaccttttacatagtgatgttaactaattcatccccactctcttccagaccctcccataggtagttacctggacaggccgtgggctcatgaaccaacatagttattcctattggacatttctaaattctcatactgataattttccctcataagtagaaacatgattatttgtttgtaaaattatcaaatgagcacttgaaggccaattccatgtgcttacctgtagatgaaacaaaagatcattaagaggtggcatcacaaagaatcacgtgtctcatattcagccagtatgtagggaaacaactgtgctggttattttaattggtttccatatgaattggccagacatccattgattggatggtgcccattccatactggagggaaagtgggcagggagaatgctgatagggagtggcaaggagttcatttttcttgttctggaaagaattctggggtcatcctgagaaggtcatgggaaatgagtcaaaggagtatttgaagaaaattatagtcttggcagaagaattcattgaaagtgggcatgctaagggcaaggtaagaattatgatactcatgcttctgttataacacacctatcacattgtgttaataaagtattaacaaccagagaaagaggtcattgcagatgagaccacacctcatcatcagtgtgtccctggaaccatgcctagttaaaatctagtagtctattttctcaggaagtaaagcgctgtttaatgaatgataggggcaaggaaatctagattaagttggaaattgtcaaaaggaaggaagaatagaaataagttggcagcttgaggccaggtgcagtggctcatgcctgtaatcccagcactttgagaggccgaagcgggcagatcatgaggtcaggagatcgagaccatcctggctaacatgttgaaaccccgtctctactaaaaatacaaaaaattagccaggcatggtggcgagcccctgtagtcccagctgctcaggaggctgaggcaggagaatggcgtgagcccgggaggcggagcttgcagtgagctgagatagcgccactgcagtccggcctgggtgaaagagggagactatatcttaaaaaaaaaaaaaaaaaagaaagaaagaaataagttggcagctttgatatgggccttaggcagaaaggggctttttggtaactcagacttcaaggacagatcccagagatagattgtaccattgagagaagtagaggagttaggaggaggagctgcttttggtaaggaagatgattttggttctgtatatcactgaggacaagctgttgctgatacatctgggcagaaatatgcaattaccaaatctatatcaggtggagaagaagaaggagggacagagaaacagaataagaatacttagaaggcagaatgaatggggaaaaaagagaaaagagagatctatgttctaagaagaattagttttgagaagatgctgtagacaagtccagagaagtgaagactacaaaattatagttgaaccaggggtgattggatgatgaaggtagaaacatggttaaaaaaatgtgagacataatttaagacataaaatggttgttctggaggacagtagcatgttggtaggaactaataaagaaaaacaaggaaaatgcaaaagagagtacatggtaaaacaaggctataaggaagatctgaatcaacagaaagggtgaaattcagctggataaggaaggaagagatatgttctgtctgagctaagaagaatgatgagtgaatagaagtttcaggatagacaggaagaattcttgacagacggtgtatcagtcagcttatgctgcataacaaatgacctcaaattttagtagcttaagacaaccaccatttattgagatcatgtttcattgggttggttggtctaagctggcttggctaatctctgtgtcttgcttatgcacctgtgatcagctgataggttgactggaaggtagatgtgggatgaccttatgcacacatctgtcatttggcaagttgtttcacattatcctgaagcctgagcaggcttgttcatatggtactccctgagtttaaagagcagcccttttccagcctctgctagtctcccattggctacagcaggtcacaaagtgaaccaatattcaaggggtagagaaatagactctacctcttgattagaggagaaagaaatagtggtcatttttgtagtataacacagatagattttatctgatctaagaagttggttaggtggctgctctctgctgagaaacgtagaggtagaactgaaaaacagcagtatagaaaagctttggagttgcccctggctggaatagaatgatccacaggaaataaggagaaggtctgccacatagcacacaggaccctggtgagggttggtggtgtgtactaagttgatgtagcttgatctcattacttcttcagcagtgcccagaaactcagcaacaactgtggacaaagtacagcttagggagttgcaagcctgaaattatcacaatttatatggtctgggaccaaaagtttgaagaccattaagttatgacactgtaacagttggctattgatgtgtaacaagcaatcacaaaagtcagtaatttaaataagtaagcatctattatagctcatgaggttgtctgggtggcttttctggttatgggaggattagtatcagtgactcagctgatcttagctatgcttattcaaatgtttggggttcagctaaagtgtcattggctgggacaagtgggctgtcttccttgtggactctcatctttcatcagcttagcctgggcttgttcacatggtagttgcagtgttctaaaatggaggtgaaagtacagatgctccttgacttatgacagagttacatcctcataagctgaacatatcattaagtcaaaaatgtgtttaatatctaagctaccgaacatcatagcttagcttagtctagcctattttaaatgtgctcagaacacctacattagtctacagttgggcaaaatcatctaacacaaagcctattttataataaagtgttaaatatttcgtgtaacttattaaatgcagtacagtgtagagtatacagctgattgggagctgaggcttgctgcagccccagcgcatatccctagcttaggaaaagatcaaaattcacaattcaacatatgctctctactgaatgcatatcacttttgcttcatcacaaagttgaaccactgtaagttgaaccatctgtatgtcaggttccttgatgagtcctagacttagaactggcatggcatcctttccactacattctgtcatcccaagcaagtcacatggcccagctcagattcaagagttggggaaacagattccacatattgatgggagaaattccaaagtcacatgtaagtaggtgtggaaacagggaggggtggaattttttggccatttttgcactcagtctgccaccctgatcataatatataggttaatgttccagtggggtagatactagaggagagagacttttctaggaaaggaaaaggttaaagggaaccaggaacaagatgaaagtaaaaagcttgcttggtaggtgtgagggagtgagtgaagttggcaggatggagattgcagtcagaaagaggttactctaagctacttgtcttggaggaagggcagtttcaagcagtgttaacatcccgtttacaactgtcagtgggaggtgaggtaaagtagagatgaagatttctagaatggaaggcatcatgaaaacagaaagaaaagtcactcagcacattcttctcatgcatattgaatcactgtgttggacgtctgggaatgcctgcataggaaaaccacaattcagatatgaagttcatggggccgggcagtgtgtgacctaaaaggacacatgtggaggtagttaggctcagcagagcctggtgtaagtgagaggtctgttcttttgtatgatagtttttaggagaatggcatggaagtacaagagagaagtctataggtgttcttcccacgcctctccatggattggggtggggtggggaataaactctactccaggagcctttgggggaagtgatgtcatttgagaaagcaagcctccatttctttccagaaaactgtcttaatttgagtcaccccaaagaccctgagagaaggcttccagtgcaagtagtttattctgggaggcagtggacatggatagagatgtgaagaagtgacaccagggagggaaggcagccagtaattagaatgttttaaagccagttgccagtaggcacctggaacttaatgccctggagaaactctgggggctggtattggacatacttctcagaggtctcctcttagagggatgagggagctggggaatgtataccctgactcctgtcagccttttcttgagggttcccgtggaagggataaattctcggcattcagacgctggcaattggaagtgaactagaagagctgatgtagagagggcatagtgtgtggctggagcagacggcatttgctgcagacctctatgaaggtggggaggtgtgaaattccaaactgtttttcttagacattcagccaaacagcaacaactgcaccaacacgacttttttttttttttctgattttaagaacaaaggattaagaacacccagctcctaacttccagattagcaattaagagaaaacaagttattgttaaggaactatgctgatatgaacaaaaactttatgtagtgaaacttcaattagctaaaacccaaaatgtgctgcctaacctactttcataccagggaagcctgtagacctgcacagtcctatatagtagccactaaccacatggggctaccactaaccacatagggctatttgaatttatttaacaattaacttaaaagttaaaccttgagttcctcattcacactagccacatttcaggtgctcaagagccacagatggctagaggccgtcagttggacagacccacgcatggaacattcccattattgtgcaaagctctatgaggaaggctgttcttggcacgcagatggaactgtcctcttctgtagagtgtggtttttttttttctaactaaatcacttatgggaatcaacatttttacaaattgtgtctttcccccaaaacacaaaaccaggtagttgagggaagtttatgtttttgtaggttccttttaatcaagacttagttgaaccaagacaaaaagaaaataaaaattgagagagagagtgtaagtttcatcagactgggtcaaactcagaatttgctagatctctggaggaccttgcatactccccaaatcctgtatgttcattttacagatgagagagctgaggcctaaagacagggagctctttgtgtgccaggagtcactcccttgccttaccctgcctcagtcactagagagacagcttgtgaaagccaacttaggagatcagtagagagccccatggaccctttataccccgatcataaaatgttacagatcacaaggctgatttccctcagccaaaactttccttctgcggcctgaccaccctatcattgaatgtgcacatcttaaaatgaataaaagggaaaaacaagagcctgggacttgatgcctatctttcttgaatatatcatacctagcctttgggattctaatggaaatcaattacagcacagagtacacattcattttgtttgcctaagatgaaaatctgcagtcaaacagaaactgtttgaggatctggctacaactgttgttgccatgacaacacctggcctagcatcactcagatagcaggatgacttagtgtattaccctagctcctcctggtatgctcctgttatacactggtttgattttattatttcctgtatgtttaaggcattgctgtgctcaatagcacattgcttaaatgctaagattgaatttggtaaaagggagaagccagaaaaaaatgttttattctttcacaatgactgaattgagaatagagttgggaattagttgactggcatgatatgccttgaaatacaaaggtaagaataaggataatagatacttttgtgcctgatcagctcccctttatgggttcactatcccatctcacagctcctatgaattttggctgattgggcatttcagctgcccttctccatagaattgccctgggaccatgagagttcccttgcctgaaaggttttgtgaaacctctgtagcactcagctgattgatccagggttacaaatgcccagcctctttttgccaaggtggaatgactcttgggtgccatttgtactgaagagctccctgcaggatcagactgaggctggatttctactggaaacacaccctaccttgttcctctgccctgctccacttctttcattcccttaggggtttctcctgagagtctgccctcaatcaatcacttgcacatgaatccccttctcaggctctgcttgtaggaaacctgacctaagttaagacattcaacatttcaattgtccagttaattgctttgtaataggaacttaagatgtttatattcatcatatgtaaagctgcttcaaagtctttcgatgagatttcgatatgtcagttctatattaccagttattctctctgatttttagtatacatagtgacttaattttttttgtttgtttaggtattgaacttatccctcaagtaaggatagaagacttaaagcagatgaaggtaaaattgcttgactattttgcaagcactcttgtattacacatattggtgacaccaatatatttttgtttctcaccaagtgtaatcattgtgattacaaaaagaaaaaacaaaaaacctatttttgattctatttttctcccaaaggcttacttgaagcatttaaagaaacagcagaaggagctaaattctttaaagaagaaacatgcaaaggtacagtgctctacagctactattttgtgttatgtatggatgaatcatttgtagccaaaaacactactttgaagctgataccagaccacttaacagtaataactcattctaactggttaacaatgaaattaaaaaatagaatcggtttgggagtgcttgtcacttgtttgtagtctgcatttctaacaattctttcaaatgcataacaaagcttcatccatttaaaaattgtttcactaggccgggcacagtggctcacgcctgtaatcccagcactttgggaggccaaggtgggtagaataggatgtcaggagtttgagaccagcctgaccaacatggtaaaacctgtctctactaaaaatacaaaaattagctgggtgtggtgacatacccctgtaatcccagctactcaggaggctgaggcaggagaatcgctttaacccgggaggcagaggttgcagtgagctgagatcgtgccattgcattccagtgtaggtgatagagtaagactccatctcaaaaaaaaagaaaaattatttcactaataacatgactatataaaatattgaagaccagctcacaattctagccactagttacctaaattgccaggtcactgtcacatagtttgccatacacactggtgcatggagggagatgctagcaatctgtcaacctcccactcacagcacctagagagagaacacttgtcactttttctcccttatgtaaatcttgcccagtagcctacttctgaaatagatttatttttgctttttacccataagaagtggtattttgacagtgattgtgaaaaattacaagagctagttgcaaattgtaagagaacagcaggaggtggccccaggaattctcctgtgggttgaaaaacgtcatggccctcaaacatcgtcacttccagactccctcacaggtaaagaagaaaaaggtagtacctctttccttcctaagaacatataataaccagctgctgctggtaggataatgtctgtcctcttttattaagggcaatgagagcaagagaaacttaatttataatttattaatttgaaagaacttctgagttcttttaaactaatcttgcattcctgtttctttattctctgacccaagcctcaaaccaaggcatgtccttcagaacttggcttgagtgatgtaccttttaatcattccacgtattgagatgccgagaacattgtctggaaccctgtcccctgtcatttctttaagagtttgtgctaacactgattttttgagaagtcatttctttaagagtttatcctaacactgattttttttagaagttaggcctaatcttatcctagtaatgttccctgtattacagaactgttgggctcaatggatttgctgatacagtcacttcacttcaaagactgtttctaagtttcatgaataattccattcagtgaaattccttacattgctcaatggggttattggagacagaacaatttaaagtaggggcttcaatgttgttggttattgacaacaggctgaactatggaaagccaacagaaaaagagtaagaatgagaaataagagagaaagcaccttaaatgactttaattatttggaatagagtggatgcccgtatgctgcagcactatctaacagatttttcttgcatttaaattggatctcttttattgagcagacacctcagtggcctttgggctagttggaaacataaagattttggcttcatttaatattttcttgaggcatggccagaaaatatgctgtggcgggtggtaataatagcagcaataatagcagctagaattcctgcatgctcagtaattctcagatgctgtgctcagcaccttatatgcattgtctcatttaagactctaccctgtaaggtaaattctatgtgagtctccatttatatgtgagggaattaggaattagtgaagttatctgatgtcccagagttaggaagcagcatagctgatatttgaaccaaaatcaagagtccagaatccatagtcttgcaccatactcctgtgtaggatatgggatgctcactaagtggacaagttccctcattgggtcaaatgcagtgacagcacatgggacattagggaaaatcactatcaactttgggcagtgttgatatactgctgattatcaggactgtgactaaggaaggatgcccctcaatttttagaacttaacctacatcagagttgtccattaactccctggagccatcatgcccggcccaagctaacttctaagatgaagaatataatgaatatttacttgcctaatatacaccgatgccagctctgttaacatattgtctttaggcgagacatggtggctcatgcatgtaatcccagcactttgggaggccaaggcaagcagatctcacctgaagtcaggagtttaagaccagcctggccaacatggcaaaaccctgtctctagtaaaaatacaaaagttagccaggcatggtggcaggtgcctgtaatcccagctacttgggaggctgaggcaggagaatcacttgaacccaggaggcggaggttgcagtgagctgagattgtgccactgcactccagcctgggtgacaagagcaagactctgtctcaaaaacaaaacagaacaaacaacaacaacaacaacaaaaacatgttgtctttaaaaccaaaaaatgaaaaactgtttaaggagaggggaacaatgtggtgaatctattaccattggacatacttcatgcctgatctccatatgacgtgtttatcctaacactgatttttctgtcagtcaacacttttaaagtggcaatactagcttgtacatattgatacttgcttaagcacatattcttaggtattctcataacagttatataaaggagtactataattatatgagttttgtatctgttagcttttgcagggtaacaaaccaccctaaaatgtagtgacttaaaacaatgaccatttatttggctcacaattttgtgcatcagtagttggagctgggtttagctggatggttcttctggtctcagctgtattcactcatgaatctgctgttactaccagtttggttggcagatgggggactggctgatttaggtcagcctctgttaaaccacttcctctctgctttatgtggtctcctgtcttccagcaggctagtccaggcttgttcacatggctggggtcctgagagaccaagcagatcaagcatagtttcttgtggccccagctcagaactaacacaccatcacttccacctcattttttggccaaagtaggtcctaagtctggccttatgaggtctctaccttttgacaggtgacaaagttacatcagaagtgggagtggatgcagaaagggaaataactgtggccatttttatagcctaccggctattcaacagattagcttattaatacttaaaaaaacacagcttcattaaatcatctagtttttaagtggtggagtcaggatttgaaccaaattcagcccggcttgagaactcagacttgtaaccactatactcagctgcctctgatgtttctcacactaatttttcttctcttcacacatctttttctttatggtctcactaacaggtttttaagagcaatcatgaacctatcagggcacaaatatcttgggttccttcaggactggtttttcaacataaggtcattgggccaagagctggaggctttacaaaaatatgtattcttatgcctatctgacacttagctatcatctctaagaaaagaatataggaaatacagaaatacattttagataaactcctctcctctgcatgctaaattttgaggactgtttttttaggaacattatgtagcactttttactatcttttgagcccttagtagaaaccccactaatcgcctgcaaagacacttatcaagcctccttaaagaaacagaggttttatcctcttgccacataatagtaagaattaattcctacatcctttctgtgaaaggacatctacagctcttttataatagttttcagccacccaacatggagctaaggcttaccaccccaaagccttatgtcataaaatgacctgctgatgaagaaatatgacctgggctgcactctccctactagtgtgcccctggcccaaacagcccttggtagctaagaacagggactattatttagtctatatccagcaactgtagggagatctcagctcttacatatcagcctagatcaagcttgtccaacctgcatgcagctcccaggccacatgcagcttaggatggctttgaatgcagcccaacacaaatttgtagactttcttaaaacatgagatttatgcacagactttttttttttttttctctcattggctatcattagtgtcagcgttttatgtgtggcccaagacaattctttttccaatgtggcccaaggaagccaaaagatttgccactgctggcctagataaataattctactttttagacttaaagagaagcagagaatctatgaactatatctcagcagtttaagaaataaatgtatggtcccaaggagagcttatttccaaacttgcaggttagctaccagatagaaaggaacagtggggtgagtgtgaggttctgccatttgcaaataggtgtgcaatttgctgttaggatattgagaagaaaagatgggggtaacgaccatttgcaccccagatggatataaaaatgctcattaaaatgtctatttttggaaaatggcaatgatcaactgcatttgaccctctgaatgtactggcaatcaaacttctacttgtctcatactttctagaaccacttcaattcgaaatggaaactagggtaatggtttttcaagtgtctattatatgagacacagaaaaaggagaattaattaacaataatcctcccccagcacatgactcattgggatccagagctgcagttactttcattaagagacaggcatgcttttcaattgtccaatgaggtcaattccttagagccaaaaatgtaaaacccaaagttggatacatatctccagtaacgtgttagaaggggaattacaattcaaatgcctatggggtccaagcaggaagtagctgagggaagttggacaggtgttgactccataaaagctgggagcactcatctctatccacaggccaagtcagtctgagctaccaccattggtgcctggagagtagatgggtcagtcgtgtcctcttaaaggagagtcaaaaaatcagaaagcttatctgaatttcctgatcttttactatcggcgtctaattcaacctctttttgaaactgcgtaggaaaaaacaaaacaaaatccaaaactaaaaactacatctgcaggcaggatacattccttaggccaccagtttgcagtatcaacattaaatgagtcaaatgaaatgcctgagaagcctactaaactctggcatttttagtaaagctactgatggaaaattttctctttgctatgcaagcaatttagccgacagcaccaagactgttgttaaactcatcaattttaattcatggtcagaccttagtaccagacctataacttagttttgcagtggaaaggggcagagacacagcagttgccctcagagtccgcctattggtaatctcagagttacatgctgagcaaacatgatttactccaatttttcagcaccctctgtggtgcgatcattcacgcccatagtcacatcagtcacaagaatgaattgcagcagcagttttccccaaaagaagctgaatttactcttaacttggataagaaacgtacacaaattcttctgaatgctatacatgtttttccccaaaatgtcccagttaagatttactttaagttaacacatttaattttggtactcttggcttgaatgaatgagaaatgtatgtctcttcaatagtgtttcatgatttaactaaggaccaaaagaataaaaccaataatggacattttttttaagctaagatggacttagagatcatttcatgcctccttcattttacagcacaatgagctgagacttgaccagagtcacatggaaatcagtaattaggatccccatttctttctgaaaggacaagtggtgtctgggaatcaagttatcccaaaacacttcagcaatcactgcctaccacacagggatggagttttgaataaaaagagaaacagagacaatttttcaggaccagctttcctgttactgacattaattatagtcactttaattcaatatgctttcagtttttcaaattatttttgcatatgtttagtaaccttgcatctcataagcaactcatgaattcggttaggcaaaggtacctaactcagttttcttttcttttcttttcttttttttttttttttttttgagatggagtcttgctctgtcatgcagtggcatgatctcgactcactgcaacctatgcctcccgggttcaagcaattctcgtccctcagcctccagagtagctgggattacaggagtgcaccaccatgcccggctaatttttgtatttttagtagagttgggtttttgccatgttagccaggctagtctcgaactcctgacctcaggtgatttatgcgcctcagcctcccaaagtcctgggattacaggcatgggctactgtgcccagccctaactcagttttctaataaagacattgaggcctgggaagatttatatatgttacacaagggcagttgtttaattattggctgagctgggaccagaatctaagtcctcttgctattttcctatgctgactttttattcatgcgataaatacttattgagcatatactttgtaccaggctttgtgccatgtactggtaaagagaaaagacctgccctgctcttgtagagcatattacatagagttgaatccatcataaacaactttgtggtacaaagagccctattcctcatatctaattggattaataaggttcaccaaaatattttcttaggaaaaaaatctgtgtcaatttacatccaagcctcaaagtctctacttgtcctgttctgcactaaaatatttaaagaaatagccttcaccctcctttcaatgatatttgcaagataatataggactgtggcacttctgatatattttgagacctgcagaaagccccttatttatttaattttttgcccaggaaaaattaacacatgggttagccaaccataatgatttctaaatcttagaaagaagactaggaggagggcattttagtaggtaccaaagtattacaagagtagttaaatacattcagggatacatcaacatgttcctctattcctggggcagtagatcaagcatggaggaaacatttattgatttaattagtctgattgatatccctatctcaagtcactctctgtgtgttatcatgggtattgaatagtatagataggtttgtatgtcactgtgttttgaataagctgtaacacacatttgatacattagattcacttttaatcctaacaaccctatgaagtaaatgtcactatcccaattataaagatgagcatactctggaaaggtaagtgactcaccccagcactgaaaaacccatgtccttaacccagtgccacattgcagaagctctggaggaaatgtgtttatagcacaaaggtgcacacacattggtaatatggctagatttatggggcattccaattacaaattaagcccagatccacagcaagcccacctagcctttgttcccactgtaagttcctatgttgggaatctccctatccagcatcacccttctccactccttctcctaaagacaagaatgctgaggccttgtgcatgaatgcgtttctaaagaatttatatataaatgaattgtagatcaagtcctgtgttaaatctcttagctgggaaattaaggaagtcttggtaaagacttaaaaattccttccccatttatattttatgaaaccgttaaaagaagttcatgaattagatttgcataaagtcaagcctaccttagaaagaaaataaatttgcttttaaattaaggcactattttcttcaataagtgaaaggaaatatgacggtgagaggggttatataacctgaacaacatgtacacccattccagtcatgaatagcatcccatttttctggttctcaagagtaaggttaggctataacatcaagtgtcatttagagttggaaatttctgattgtactgatttcctctgtgcttgggaggctgagcagctaaagaaatctgatttcatataagtcattggctgtagctaaatgcctttttcattgtccaggaagaaataatgtttatattgaaatacctactttccaaagcattgcagccccaatttcaatggttacgtgaagcagatgggaaaatgttttaaatatctgtaaaacagaaggccatagctcctgaacactttatcctcataaactgcttctagataagtaagccagtgaaaatattaagtgatgtagattcaaattcagctgatggtgacaaacacagtgatgcctctcattatataataatggcattcaagagctccaaaatgtgcaggtgtttagaaaccatgtcacatgatgaatagttacatttagcatatacaagagaagaaacatggtggctgaacttgcatgtttgaggaccaatgtgtggaaggggcagtaggctaattacatgtctcaaacagcagaacaaagatgaatgggtggaaatactacagagatgtgtatatgtagaagaaaggacttcgagatgattggcactacccactgctgagcaggagtgcatttgaactgggcatgttcactagactgaggctagagactcccatgttgggaatgcccttggacaaaaaaaccggtgttgaatgggagatctggagtctgtactgttctcagatttggttattccttgactttctaaatgaagactctagggaagctggtgaaagttatgccagccctatatggtgtgagccatgctaagagtccaattcataactgcaaatccttcttgttcaggaacacagtaccatgcagaagttacactgcacgcaagttgacaaaattgtggcacagtatgacaaagagaagtcgactcatgagaaaatcctagagaaggcaatgaagaagaaggggtaatactgtttatttccttctgaagactttctctatgtttatattttgtcttttcccacagttttgctgctgtttaggtcaaggaagaacttagtgttgacttgattttcatcattaaaaattattcctgggaagtaagaaactcattcattttaaatgctctaacatcataacaggtcaatgagtggatgtagcttctggtttggggaaggttctcagcagagattctgatatcttttaattcatcataattatttctaatatgagaaagaaatcttagcctcaaataattgaaaaaatacctctttactctgagaattgattgtcctttttgattttgaactaattttaaatttacagaaaagtttccaaaatactacagagttcccttatgcccttaactcactttccctaaatgttaacatctcacataatcatagtacagttgtcaaaccaggaaattgacagtggtgcaataccattaaccaagccacagtgatttttcacattttaccagtttttccacaagtgcttgttttccactctgggatcacctccaaaattaaatagcatttagttgtcatctcagtatgtgataattcctcaatctctccctgtcttttgtgactttcacttttgaagagagctggtcagttgttttgtagaatggctcttcttttggatttgtctgatattttctcatgatgagagtgaggttatgcatttgtggcaagcacaccatggaaacaatgctgcttccttctcagtccacgatattggggggatgggggtgtgacattgatatgtcccattattggtgatgttaacctggatgacttggttaagctggtatcttacaggtttctgcactgtcagattacttttttccctttataaatactttggggaaaattccatgagaccacgcatacattctatttatctgagaaattatttttcctgcctttgaccttctccagggattccctctggtttttatctctttccttcaatctctgctgatgtcttctagttttccacaacctttggcacaagagaaaaggagaatgagatttctttttcctacttgggttttttggcatttggtttttgttttttattttttgttttaacagtcacccaagatatacctagaaaactaaactctgaaaacagaacagattatgttagttataattttcttggacattggttcatattgccgaaatttcagatcccaagatctaagttcatgacatgaaaccaatgtaatttgcttgaggagtaaatggtgggtaactaaaatgcctgccctggtatcaggcctcactatttgagaggtaccctcatttttattaaagttgtatttttcagaaaaatacaaatcaggcactgattattgagcatctgttattatgcatcatctgccttttgttttccccgtaggtttcactgtgtattattgaggcagaaatgtgcctgttgcttagaaaacattttgatctgtattttaagtgagtaagtgagtcacccacctcggagctcatgtggcaatattggtagtgattacagtaagttttgaggagctgtgattcttctagattctaaccacatcagctttggcctatttcttttttgtaaattaatttctcatatttaatgacattttaggctataatattgaaactgatggtagacagactctaataccaaggagcaaattgttgatgactttatagtactctccaagaataaggttatttgtatttacaagatatcttttcaaaaaatgtttcatgcatttttgtggatcggtgtatttagaaacacagttttggcttaaccaaaccaaaaatttttattaaggagatttcagatccaagcaccatagagtaaatttctttgctaaaaataatattacagttttctgattcaatcaatcatgagtgctacctttagaaatttttaaaaaattgataaaatatatctttacctcatgattgtttttactctcaaagataatgtgggatcaaaatgtaatttattataaacttggtaattattagaagtgtccctggtgtgacacttaaccccccaaacaggctattgagtgctcttggaggtctctcagcaaataaagccctgttttatcctaaacgtagatgagactggaaaagtctaatctgtagatttcttcctgagcctctgctgtcaaacgcagcactcctagcaggctcttcacacagagcatttccaagtactctaaagagtagaatcttagcaatacattaaaagttacttcaaaatcagacatcagatactttcttctggaaagccatatctgaggagagtttctcatcattaatattcaccatgatatcaaggttgcctggacttagtcttgctatgttgcccaggctgaagtgcagtagcacaatcttggcccaatgcaacctccgcctcccaggttcaagcaatcgtcctgcctcggcttcctgagtagctgagactacaggtacatgctgccatgccggctaattttttgtatttttaatagaaatggggtttcaccatgttggccaggctggtctcgaactcctgacctcaagtgatctgcctaccttggcttcccgaagtgctggaattacaagcgtgagccactgcacccagccttcctggacttttaactgcaactgagttgctaaaaagttagtgaaaggggaaactgtgacagtccttggagctttctcatgcaggatctatttttgaaacaaatgaaaggtttccccttactcttacctactcagctgaaaggaaagattgacctgggaaagggaagctttattcaagtgcttccagctttggctaatgactacctctcatatgctttccactcaaggatctttaaggtgatggtaaaaagatgaatgggggaacaagggaagacaagctaaagttgggaaaattctaaattacagaaattattttgcatagcccgaatataaagaaggttgatgcactagaaaggggaaaataaaatcttgattttcaaataaatattacaagtgcatgcccttatgccctcagatgagagtgttgaataaaacctctcattgcatttactgtgaaagatttgtctagaattaagtcacgggaatgtttcggcagtgctgcaaacttattgaataacagaagagagaagaaacttgctcagtgccagccattgagaagtgctagatttgatgcgagaccttgcatttttagagtaatgcttctctcacaggaacttggaattatattataaggaagcattctgacttgagctataataacctagagtatacatgctgaagatgaagctcaggacctgttcttgtttcagcagcgatgtggatattccaaaaggaagacataatcactgaaataagcagtaatagttgctgggcactcgcctagcatatatttcctactcacaatagaataagaagcaaaaattgccctgtggtgccaaggattgctattttctccttcactggcatatttaaaagacaaaaatctggctttataatgaaatggaagaatgaaaaattcacttcaagtctgaggacctattttccagttttcatcccaaataatattttattgaataagtgaaaaatagcttgagaaaaacaggaaccaaaatggaaactgacaacagccccttaatgatgaaataattgttaggtttgaagtgcctctttgtatagtggttgaattgagtaatcatgaaacagataatattttgtaaggtgtgaatctattactagaaagaccagtgttgcccaatgagccatgacatctcatatttgatgaatatattatcttcatcagaaagctttgtagcaaagacccatgggaatgggaaaatatctaatttctggcatgcatttgcaactttccattttcaggggaagtaattgtctcgaaatgaaaaaagaaacagaaatcaaaattcagacgctgacatcagatcacaaatctaaggtaagaaaatgcccatttttacagcagtgacttgcagaagacactttgtaattttttagaaggagtacctagtgtaaattagaaataacagtagcccagagctggtctagtagcctgcagctgatctgggatgtcaggggagcccagggttcatgtttgcctcagactcactggctttaagaagagccatttcatggaacatcttcttttgtcttgtctgttgaactatgctaacaatatttatgttgcctgcctcagaggcatcaaggaaaataataaatgaagatactaaaaggaaatattatataaaatacagaatatacttccctatagaaataacattaaacataggacagaaaaccgcccaaattgggaggtgatacttactccatcctaactttacatggaaatttggaatgagaaaaaattaagagctgatattctaaaagagaagcctaattactcacattttcttaaagacaggagaaaataggagcttgagagactttaatcaactttgtgggcatttggagaactaagtgttaagtcccagttaagaatgaaaacaattcttccagcaatgatagtttttaaatgaaaaggaaaaaaaaagaaaaaaaaaaccaacaacaactgttaaagaaagctcccaaaaatagctgtggttgaaccagccagcctcatctatctatatgcagctgtgtcatctggcctaatggccctgctgcatgcatggagcaggcaagatgttcaagatgttcttggtagctgtatgttttgtagggcatgaactctatagaggcagtaaggcatgtgtctttaagagttattccccactctctctcttcttaactggaatgtttgagaattagtagttgtgcaaactgtcatgattcttagatgcttggcatcaataagaaaagccttggcaacagtatcagtttgcttttgctatataatgaactgtgtcaaagaagagcacattgaaacaactactacagtttattaggtcacaattcagtgggtcagaaatttgggccatacttctgctgattttggctggagacacttgtgtatctactgtcagcagggggcgtatggccttacttatgtatctggtagttgtctggctgttgcttgttttcctacatgacctatcaacctccagcaggctagcacaggctcagtcagagggtagccacagggatcccagcatagcagaagggcaagtactttccagcctctgcttgcatcacatttgctactatctcattggctaaagcaagtcacaggtcacccagcttcaaggagctggagaaacagactccagctcttgacaagaggcactgcaaaaccccactgcaaagagcttggatattgggtggggaggactttctaccctagtgtctatcagggttgacacagtaagtcatgatccagaaataaaagaacacacagctctctattcagacatgtgggcttgtggacatgaagctggagaaacataaggtgataaagaaaatcctgatggaattggtaaaagagcctaaggcccacacaaatcagagtgttggctgagtgtggtggctcacgcctgtaatcccggcactctgggaggccgaggcaggtggatcacctgagatcgggagtttgagaccagcctggccaacatggtgaaaccctgtctctagtaaaaatacaaaaattagctgggcatggtggcacgcatctgtaatcccagctacttgggaagctgaggcaggagaatcgcttgaacccaggaggtggaggttgcagtgagctgagatcatgccactgcactccagcctgggcaacagaggcagactctatctaaaaaaacaaaacaaacaaacaaaaaacaaaacagagtgttgctaagtgaggcagtaaaataagggttcacagttaactattcagagccaaagcaattgatttattttgataagcaataacttcctgcttcccattgattaatacatattattttttggtggttataggtgtctcatgattcaccaattaagttggtgggaggaacctgaaatacctgaataatgttgtgcttttgggttcatacctgacctatgaggattacaatggcaccgtcccctttttcccaaacaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacaggtgggggaattgccgtctccagagtaaacatctaatatttaaaaacaaaagctgattttgtgtgtataagagagccaaggtaataagtgaaatcaatttgacgtacaacatgtagctcttttgtgtatctcatcatatggctgattatgagcaagatgagctataagaaatggcacccaggggccaggtgcagtggctcacacctgtaatcccagtgctttgagaggccaagacaggaggattacttgagcccaggacttcaagacatagcaagaccccatctctattttgaaaaaagaaatggcccctgccatcagagggcttacaggtgttggcaagatacaacacccatatgaacagttaagtcagataacaaagtagcatatgacacatattttaaaatgtcatgggcactaaaggcatccagctcagaggagctctaccttttcagagtggtcatggagacttttcaaaatggtagggctggaactggcctttggagaatgatctggagtctcttaggtagaaaagacacacagagagataaagaccaatcagttcagctcctagagtgaccaggttctgatcatttaatagctacctgtggagagagtctccatttcccttccttacagtgttaggacttctgtgaattttgaaaagataagcctgattaaaaaacagcaaagtatcagtttattttggcctgtgcccacttcagcaaagtgaatattgcatttgaaatactgcaagccatgagctggacttatccctgagcagaagaaggttggtgtttgttacatctttttatcatagctcggttgcagcttgcttggttctcacttagtgcctaccgtatgccacagttagggtctcttgagacacaacaagagtagaaaatagaagcattatacaaataaatcaaacaaaaaaatgtgtttaatgccaactgcataagttatctggctgcatgcccaaattcccaacattactttggagtgacagatactgccacaagaacaaagtgtttttgccctggtttcccattctcatttgaggcaactaaatgcagtctcccatgctccattttctgtgggataatgtgctgtacccccatgcattttaaagcattctatttcgtcctataggattagaagttgtcttttcttttttccttagaaatgctcttgattcactatgcagaaagttgtgttcatcattctgcctttgatgattgctacaatgccagattttaggtgcctacccttattcaaagatacttcacggaatacagcatggcacttgtctaatcttcttttacattgttgaataaagagaaaaacattagctcacaacagtaggcattatctgaaaggaaaaaacaaaatatactaattcttgaattgcttaggaagtcatttgaagagatcatgacctagttactaaaatactttaaaaaataaatccatgggcttcattccaagatggctgaataagaacaggtccagtctgcagctcctagcatgatcgatgcagaagatgggtgatttctgcatttccaactgaggtacctggttcatctcattggaactggttggacagtgggtgcagcccaagaagtgtgagccaaagcagggtggggtgtcacctcacccaggaagcacaaggggtcaggggacttccctttcctagccaaaggaagccgtgacagactgtctctggaaaaacaggacacttctgcccaaatactgtgcttttcccaaggtcttagcaaccggcagacaaggcgattctctcctgtgcctggcttggcaggttccacgcccatgtagccaggctcactgctagtgcagcagtcagatcgaaccgtgaggcagcaacctggctggggtaggagcgtccaccattgctgaggcttgagtaggtaaacaaagtggccaggaagctcaaattgggtggagcccactgcagctcagcaaggcctactgcctctatagacaccatctctgtgggcagggcatagctgaacaaaaggcagcagacaacttctgcagacttaaacatccctgtctgacagctctgaagagagcagtggttctcccagcatggcgtttgagctctgagaacggacagactgcctcctcaagtgggtccctgacccccatgtagcctaactgggagacaccaccaagcaggggccgacagacacctcatataggtgggtgcccctctgggacaaagctgccacaggaaggatcaggcagcaatatttgctgttctgcagcctccgctggtgatacccaggcaaacagggtctggagtggacctccagcaaactccaacagacctgcagctgagggacctgactagtagaaggaaaactaacaaacagaaaggaatagcatcatcatcaacaaaaagttcatctacaccaaaaccccatctgtaggtcaccaacatcaaagacaaaaggtagataaaaccgcaaagatggggagaaaccagagcagaaatgttgaaaattctaaaaaccagagcacctcttctcctccaaaggatcgcagctccttgccagcaatggaacaaagctggatggagaaggactttgacaagttgacagaagtgggcttcaaaaggtcagtaataacaaacttctctgagctaaaggagcatgttcaaacccatcgcaaggaagctaaaaaccttgaaaaaaggctagatgaatggataactataataaacagtgtagagaagaccttaaatgacctgacggagctgaaaaccatggcacgagagcttcgtgacacatgcacaagcttcaatagctgattcgatcaagtggaagaaagggtatcagtgattgaagatcaaattaatgaaataaagcaagaagaaaagattagagaagaaagagtaaaaagaaaggaacaaagcctccaagaaatatgggactatgtgaaaagaccaaatctgtgtttgattggtgtacccaaaagtgatggggagaatggaaccaagttggaaaacactctttaggatatcatccagtagaacttccccaacttagcaaggcatgccaacattcaaattcaagaaagacagagaacaccgcaaagatactcctcgagaagagcaaccctaagacacataattgtcagattcaccaaggttgaaatgatggaaaaaatgttaagggcagccagagagaaaggtcgggttacccacaaaggaaagtctatcagactaacagcggacctctcggcagaaaccctacaagccagaagaaagtaggggccaatattcaacattcttaaagaaaggattttcaacccagaatttcatatccagccaaactaagcttcataagtgaaggagaaataaaatcctttacaggcaagcaaatgctgaaagattttgtcaccgccaggcctgccttataagagctcctgaaggaagcattaaacatggaaagaaacaaccggtaccagccactgcaaaaacatgccaaattgtaaagaccaacgaggctaggaagaaactgcatcaattaatgggcaaaataaccagttaacatcataatgacaggatcaaattcacatataacaatattaaccttaaatgtaaataggctaaatgccccaattaaaagacacagactggcaaactggattaagagtcaagacccatcagtgtgctgaattcaggaaacccatctcacatgcagagacacacacaggctcaaaataaagggatggaggaagatctaccaagcaaatggaaagcaaaaaaaaaaaaaaaaaaaaagcaggggttgcaatcctagtctctaataaaacagactttaaaccaacaaagatcaaaagagacaaagaaggccattacataatggtaaagggatcaattcaacaagaagagttaactatcctaaatatatatgcacccaatacaggagcatgcagattcataaagcaagtccttagagacctacaaagagacttagactcccacataataataatgggagactttaacaccccactgtcaatattagacagatcaatgagacagaaggttaataagatatccaggacttgaactcggctcttcaccaagcagacctaatagacatctacaggactctccaccccaaatcaacagaatatacattcttctcagcaccacatcacacttattctaaaattgacaacataattggaagtaaagcactcctcagcaaatgtaaaggaacagaaatcacaacaaactatctctcaggccacagtgcaatcaaattagaactcaggattaagaaactcactcaaaactgcaaaactacatggaaacagaacaacctgctcctgaatgactactgggtaaataatggaatgaaggcagaaataaagatgttctttgaaaccaatgagaacaaagacacaacataccagaatctctgggacacatttaaagcagtgtgtagagggaaatttatagcactaaatgcccacaagagaaagcaggaaagatataaaattgacaccctaacgtcacaattaaaagaactagagacgcaagagcaaacaaattccaaagctagcagaaggcaagaaataactaagatcagagcagaactgaaagagatagcgacacaaaaaacccttcaaaaaaatcaatgaatccgggagctggttttttgaaaagatcaacaaaattgatagactgctagcaagactaataaagaagaaaagagagaagaataaaaaagatgcaataaaaaaatgataaaagagatatcaccaccgatcccacagaaatacaaactaccatcagagaatactataaacacctctatgcaaataaactagaaaatctagaagaaatggataaattcctggacacatacaccctcccgagactaaacctggaagaagttgaatctctgaatagaccaataacaggctctaaagttgaggcaataattaatagcctaccaatcaaaaaaagtccaggaccagacagattcacagccgaattctaccagagatacaaagaggagctgataccattccttctgaaactattccaatcaacagaaaaagagggaatcctccctaactcattctatgaggccagcatcatcctgataccaaagcctggcagaggcacaacaaaaaaagagaattttagaccaatatccctgatgaacatccatgcaaaaatcctcaataagataaatactggcaaaccaaatccagcagcacatcagaaagcttaaccaccatgatcatgtcggcttcatccctgggatgcaagtctggttcaacatatgcaaatcaataaatgtaatccatcacgtaaacagaaccaataacaaaaaccacatgattatctcaatagatgcagaaaaggccaacaaaattcaacaggccttcatgctaaaaactctcaataaactagatattgatggaatgtatctcaaattaataagagctatttatgacaaacccacagccaatgtcatactgaatgggcaaaaactggaagcattccctctgaaaactggcacaagacaaggatgccctctgtcaccactcctattcaacatagtgttggaagttctggccagggcaatcaggcaagagaaagaaataaagggtattcatttaggaaaagaggaagtcaaattgtccctgtttgcacatcacatgatagtatatttagaaaaccccttcatctcagccccaaatctcctcaagctgataagcaacttcagcaaagtctcaggatacaaaatcaatgtgcaaaaatcacaagcgttcctatacaccaatgacagacaaccagagagccaaatcatgagtgagcttccatttgcatttgctacaaagagaataaaatacctaggaatccaacttacaagagatgtgagggacctcttcaaggagagctacaaaccactgctcaatgaaataaaagaggacagaaatgaatggaagaacattccatgctcatggataggaagaatcagtatcgtgaaaatgcccatactgcccaaggtaatttatagattcaatgccatccccatcaagctaccaatgactttcttcacagaattggaaaaaactattttaaagttcatatggaaccaaaaaagagccctcattgccaagacaatcctaagcaaaaagaacaaagctggaggcatcatgctacccaactttaaactatactacaaggctacagtaaccaaaccagcatggtactagtacgaaaacagagatatagaccaatggaacagaacagagcccttagaaataacaccacacatctacaaccatctgatctttgacaaacctgacaaaaacaaaaaatggggagaggattccctatttaataaatggtgctgggaaaactgtctaaccatatgtagaaagctgaaactggatcccttccttacaccttatacaaaaattaattcaagatggattaaagacttaaatgtcagacctaaaaccataaaagccctagaagaaaacctaggcaataccattcaggacataggcatgggcaaggacttcatgactaaaacaaaaagcaatggccaccaaagccaaaacagacaaatgggatctaattaaactaaagagcttctgcatggcaaaagaaactaccattagagtgaacaggcaactcacagaatgggagaaaatttttgcagtctacccatctgacaaagggctaatatccagaatctacaaagaactcaaacaaatttacaagaaaaaaacaaccccatcaaaaagtaggcaaaggatatgaacagacacttctcaaaaggagacatttatgcagccaacagacacatgaaaaaatgctcatcatcactggtcatcagagaaatgcaaatcaaaaccacaagagttgccatctcacgccagttagaatggcgatcattaaaaagtcaggaaacaacagatgctggagaggacgtggagaaataggaacgcttttacactgttggtgggagtgtaaatttgttcaacgattgtggaagacagtgtggcgattcctcaaggatctagaactagaaatcccatttgacccagcaatcccattactgggtatatacccagagaattataaaccatgctactataaagacacatgcacacatgtgtttattgtggcactattgacaatagcaaagacttggaaccaacccaaatgtccatcagtgatagactggattaaaaaaatgtggcacatatacaacatggaatactatgcagccataaaaaaggatgagttcatgtcctttgcagagacatggatgaagctggaaaccatcattctcagcaaactatcacaaggacagaaaaccaaacaccgtatgttcttactcataggtgggaattgaacagtgagaacacttggacacagggtagggaacgtcacacaccgggccttttggagggtgggggactgggggagggatagcattaggagaaatgtctaatgtaaatgacgagttgatgggtgcagcaaaccaacatggcacatgtatacctatgtatcaatcctgcacgttgtgcacatgcaccctagaacttaaagtataataaaaaataaataaataaataaaataaatccatggcagaagcacttttcaaagcaacagcagtattttagctttttctcaaacccctggtggttgtgtttcttcctcatgatcacaactattattcttggttaaaaatctttgctttcttgacatttgtcagcaacgtttggtcattggtgtttgttgaatgaatgaatacagaaaggtcaatttcctaacaagttatggtaaaatctgagagtgatcttcttgtgtccagagtttctatacatgttcctgctggagtggctctagggtagctgagtgagcaactctccagttcagtattgcccatctctttggatgcagagcaaatagcagtgcctaggtaacctgactgcttgtatgctggtttccaggcagtgctttcaatagatctccataggttatagaaaaaaatttttgtaataatatactatgtagcattttaagttttattcctttaatgcatgtgtgtcatgcatacacatgcattcccacatgcagtggttggtcacctgcaaacctacttttttgctattccctgtgcttacttgaaaccatttagtccctttcattcctgtggctgatagaaacaggaaggccgtttgtgatggttagaacattttctctctctcttccagcccatctgatcccaaataatatgaagcaaaactgagatctttatatttatgggcaaaaatactgtctcctcatcacaggccatcactgtcacttcaccactaggtggccactgcccctcaaggatcagcatccacatagcttggggtcccgtccctcctttttccaaaatacagaagtcgatgagctcaataatagaaagaaaaaaaaagaagagtgagaggagtgagcctagtcatattgctataaacagaagtatttttgtttttttccatgcttaaattatgtctatatatataaaatgtaaactttactgttgtaaccattaagtgcatgacattaagtacattcactttgttgtgtacccgtcactgccacccacctctagaactttctcattttccccaggtgaatctctctacccattaaacacaaactctccatcccccctccctgtttgttttcttgtttttaatacatagggaaagcaaggaaatgcgagcacaccaggctaagatttctatggaaaatagcaaagccatcagccaagataaatctatcaagaataaagcagaacgggaaaggtaagtctgagagtgttcactgcaggaatatggcattgacttgaggacacagtctcaactttctttatgtgtgtacacacacacacaactgagacagcaaaacacttgtggcttttgactaggaattctgctattataactgcaatggagatttgttattatcactgtagaacaatcgtccacattttctggttgcttactaccaccagtaaaattagtttacattcaatatatatgtgctgctttacaaacaaagttgcataaaatatgacataataatataattcttttttttattttattcatttttttttttgcttgtttgttttgagatggagtcttgctttattacccatgctagagtgcagtggcacaatctcagctcactgcaacctctgcctgggtttgagcgattctcctgcctgagcctccctagtagctgggattacaggcatgcaccaccacacctggctaatttttgtatttttaggagagatggggtttcaccatgttggccacactggtcttgaactcctgacctcaagtgatctgcccgcctcagcctcccaaagtgctgggattataggcgtgagccactgcgcccagcctataatcaatataattctgaagcatccttcccaggttccactgggtcattctgcaagcctctcccctgctcaggtgtcagtccgttctggatgggccagttctgaatagcagcaacagtcaggagggcggtcttcttcagtagtccttcacatgggatcatcttgaaagcccccatcccatttgtctcatttgtccttatgttaggtgagttttctggaagcagatcaaggcaggaattgatgtgcttgtgattcactgaggaagggaccttcagagaaagggagtgagaaagcaggaaggcccagggcaggccctaagcaaggatgtggtctcacctagggtcccagtaacctcaaataaaaaattccaccacagatttgtccctctttgaagcaagagtacctggcttttgtgtttccatattaggcagtcattggccgcctgagactggggggaaggtttgtgtgtcctctatagaaggtgccaagtgcaagccctttagacacagctggtgaaggggatctgaggagctgtcaatagtcatgttacccaagggataggcacttaattcccagcgatcaccagtgctgcccatcatccacctcaaggaacatctgagaatacaaatgctatcagctccataaccaagagcctggattacgccaccagcagttagggacagtggggttccttcttttgggggaataatacctagcaagaaggtggccttttggccaaagtccaacagagaaaagctgttttatgagccaggtgcagtggctcacacctgtaatcccagcactttgggaggccgaggtgggcagattacctgaggtcaggagtttgggaccagcttgaccaacatggtgaaacctcacctctactaaaaatacaaaaaaattagctgggtgtggtggtacctgcctgtaatcccagctactcaggaggctgaggcaggagaattgcttgaaccccaggggcggaggttgcagtgagccgagatcctgccattgcactccagcctggccaacagagcaaaactccatctcaaaaaaaaaaagaaaagaaaaaatgtcattctctggatgttattctcagataagcaactttgtttaagggccttatatacatggaaatgacaccttcttcagtttgaaaacaccaaatattccagccatgataaaacctcatgaatttgaactgttttagactatccaaagtgaaatatagaattaaccatgacaaatgtgccaattaatagctttttaccatctttttcaaatatgttacaaagtagactttagctcggttgaggtcaaattatcttcaatttggagttactgctaacttaattagcaagggtcttaaaaatttatcttattttgaaaactgtacttatttgttgtaactttctatttttatttgtgcaactgtatgggggtacgtgagaaaactttacatgtatacaatgcccagtgatcaagtcagggcatttaggttgtccatcacccaagtactatacatttgtggctaagtatagtcaccctactctgctatctcttataagtttgtatccagtggtatgtggttccaaaatatctacaaattggctgttttttaaaaaataatttttctataccaaatgatagttatattctaaacccatactgtgtgtatgtttgtatccactttatcaaactgaggagaaataaaatttaaaaatttgtcatagcactaagaaagatacatagaaactgaaaatcatacttacatttttagatcaaagaagacattttaacagaaattacccaatatttataactgaatgacaatgtaaacactatttatcaatgtgtagagggtagttaaagtgatatttggagggaaaaatatagcctagatgcatatattttttaaaagatgtgaaaattaatgagctaaccactcaaagagaatatgaagttggaaaaacagagtgaacccaaagatctctgatggaaagaaataaatttaaaaagcaaaaaatactgaaatagaaaacaaaatgcaatagagaacattcagaaaaacaaaagcttatttgaaaagaataataaatcagttaactttcaccaagactaaagaagagagagaaagcacgaattagtgatgttaggaatgaaaaggggaattaactacagagaaaaacgctttgaaaaactaagtctactattaaaaaaaactaccaataaatttgaaacgttagatggagtggagaattgctttgaaaaatataaatatccaaaactgactgaaaatggagaaaacctgaacagactggcaattattacagaagttcaagaagttataggtcttttcactcatgaaaaacactctacctcaccagtagtcagggaaatgcaagttaagacaataagctccattccataggagcatccaactgacagaaagtctgatagtactaagagtgggcaaagatatggggaaagggtaacacccagacactgcagatggaaatgcagttggggacaactggattggagtaaggaagagcctgttcgtaccctgccaagtgacaagtctgagtatacaccctacagcagcctttgcctgtgtgcacaagaagatatgcaccatacttcatccactcatctgtttattcaacagacacttattgtgtcaggtattacagggcccacgcacccgatcgttgtagcgttgtttgaaaataacctaatttttgttaatggcaatgaggaaatagtgtagtctgttcataaattgaaaagtccatacagcaaatgaaaataatgaagtggtctggaacataggtgtatctctaaaacataagactaagtggtaagctatgggaagaaacccagactatgttactctatgggtacatttagaaaacacaggaagcgatgccactgtgcctggccagcaacatcagcatcacctgggagcttactagaaattcagacctcccaccccaggcccactggatcaaagtcactaaggggaaggcacaacagtctgtggtttttatcatctctccaggtgattggtatgcacaggaaagtttgagaagctcttatattacacatgggcacatctgtatgtggtttaaaatattaaaacatgggtgagaagatccacaccaaattcacaatagtggtaacctctggggagagaggaataaggaaaactgaatcaggaagaatacacatggggctttaattacatctggaactgtttattgcctttaaaaatgtgagataaacatggcaaaacattaaaaatatcagttaatctgagggacacatacacagatttttaaatattcttctctggacattatatgtttgaaaatactgcaataacaattagaaaaataaagcaataattccatccagagaatttgatggaatatagctctttattatttgatataatattaatttcattcaatgtcataccaaccgttatttgtgcccattgcttttaggcgagtcagggagttaaacagcagcaacactaaaaagtttctggaagaaagaaagagagtaagtattttattatatttttggcattcttcctttaaaaaactataaacaataacatgcttagccaccagatctctagctaatttgtttaatttgatttttctgtacattaaacattccagcttctctgctccctgaaagctaaaataatgtctcactaaaatctttaaggtaatgatttggcaccattttatacagaaaatgaagccaggtttagtcatgcgtaagtcctctattattttctaagattttagcaggaaagatcttcccagaaataattatgagtttaaactctccaaattttgagatgattttttaaaaaattattatctctttcacttaaattataaagttacaagtcatctctcatccctgttttaagattgtaacccaaagttcaatcagaattttttttttttttttttttgcagcttgccatgaagcagtccaaagaaatggatcagttgaaaaaagtccagcttgaacatctagaattcctagagaaacagaatgagcaggtattttacctaaaatacgtaaaaacatgcaggcagctagccagctttgggatacacatgccatggcccacagtgaccagtggcttgcatattgtaattgaaaggtagatagaagaatttgttgcccattactatattttctccattatatccaaaaagaaaagaaagtaccagtttttggagcaggagcagaatctggctgtgccaaaaaaagaatatttggataaattatggggattatgtgaattctaagaatgaaattactaaaagtgagaggatgaaaaaaagagattacgaagtatttctccattttcatttagagttttataatttgcaaactataggcaagggatatgatgtttaaaagcaaatgagagaaaccacctattttcaaactcaatctgaaaacgaagtttaaaaacctccctgggacttacaggtggtatctaaagtcatgagcccccatcactctacaaatcactgagcatgagtggataccatagtcttggtctttttccctgcaagacaagacactaaataaagaaatatacacaaataaagagttatccaggccgggcgcagtgggctcatgcctgtaatcccagcactttgagaggccgaggagggtggatcaggaggtcaggagatcgagaccatcctggccaacatggtgaagccccgtctctactaaaaatacaaaaattagccgggcctggtggcatgcacctgtagtcccagctactcagttggctgaagcaggaaaatcacttgaacccaagaggcggaggttgcagtgagccgagatcgcaccactgcactccagcctgagcgacagagtgactccatctcaaaaaaaaaaaaaaaggagttacccaaacaccaactgtttagttaggccaatgggcatataccagcaccaaggtaaatgtatttttatctggtgcatagtacaggtgggcacctttccaaatgggctacagcccatcagccttctacagtaacctttaattaatggaaatccctctagttcctatggcaacaagaccctcagttatcatttacatttcagactctctcagttcaaatgttattctttaggtgtagttggtatagaagttattattcctaggtaattcaatttagaaacggagaggttttgatgaaatatgtacttgtgccacattattccttcctgttttctcccatctataaaacaatcctatttaaggaatacttttttccagagtaaatgactccccttgaagaatacttaagtaggaattatactaaaaagtacctttgagaaagtaaaaataaaataaaataaaataaaataaaatcttttttgtatggcaattgggtaacagataaatctgacttctagtttcagattctttactttttggtggacagaaattttattcatcaacatacttcctagttatgtttcccatttccttttcagctaagtgcttctattcataagcaagtccactccaaggggacaatacatggttattgtcccacaggtacaattcatttgaccaactcataaacacatcacattctggtacaagttacctagcttatgtttttgctcttaaagcacttctcagaaagtgctcctgggggaaatatgggaatatgagtaaggataaagtcaccatctccaaagctttagaagccacttcagtgattcaacaatgggtagggataaggatgccttggagaaggtttttaaaaattctccctagaggaagggcacagtgaaaggtaaggcacagttatgtgttagttaactaaattaagaaactacttggaaattaattgtgttgcttagcaacaagtttgactaaagaatgtaaatgtgctcagaattactcatcactacaatagtggtgtatgccagagctagagaaaacagtcatcttgtgtcgctagctttggagccgaagtacataatttttaaaaatcagtttgagcttttatcctaacacatggctaattcaagccacaccagagttcttgcattaaactgctagattagtgatagctgtattgattagattgtattgggagggtgctggctttttgttgcagaaattcaaatatgtcttttaaggtctaccacccacaactgacactttgagtcacaaaagcttgggaaagcatagaacatgaaaaggcttgagacctgataaagatttaatgagattcaaggaaaagacattcaagatatcatactgatgcttctggcaagcaaagaatttggacttgagtttctgtgttaagctttgctttagaaatatggcctgttcaattgcaaattcaatcccagatctttctagtatacattttttggcatttaagggtgagaaagctctcaattcacagttactctgtatggtacaacactgtcatgggcacagtgcaaaagatacagtgacttcatttctttcctcataaaaaggcaaggtctggaactatatagtataactgccttcataaccaggtaaacatttcatcagcaagaacagttctttgtctccagacaatgcaaacttctacaacaatcttctaaataattgttaaatcccaagacattttttctaagccagagataaatgtaaacattctcccatagtatttccctcaaaggtttctttctgttctcctgtgaccctactcctaatcggtgtcccaaatctccccttccaaagcaaggcctggaatggattcagtccattagctaaaccagtgttgggggcactggcagaaacaaaccaggcgtcagtatgttttggtcctgattctggatcctcaccttctaggttatttgtaagccactttatgtccttgcctacttggtcagccaactattcacttaacactctgaaggttggggatgtttttcctacttgagttttttcatagacttcccagctacacagtatatctcatctgtcttgacatgtaccatttcaaacattaacgactccattactgtcacacactcgagtctcaaaaattgatttttatcatcaatcctatcatttaataaagagaggtaaaaggttttgcttaaaggccaggttctccacttactgccacagaagagaggcacagtctgggaatgacaggcgttggttgtttgtttcgtttcttttttttctgttgagatcaactaggggaaagtttgtcactgaggggtgtgtacatgttttatccttagctttttgcttttctgtatatggttttgcattcatttttcaaattcacttcaatattcatttattttcttcgttttgtatgtatgactcaattttgacattactatttttgtacaaacagcttttgaaatcctgtcatgcagtgtcccaaacgcaaggtaggaccgaaactctgataagcaagacgttgctttccttctcgactacgtccgtattctctgtgcagtctccatttatgagtcacatctggtcataactaatatctgaagggtttggatttaaaagcttgactattccatgcttggatttctgatgtcatattcatgccaaaatgccctaagtctttagagaattacttctgagggtatttgaacctgtattttctattgcagatttaggaaacagatcatggtaataaagacataaccagaacagtgatgtgcagctgtcatttggactgaccagagctaagacagggtcacagagtcaggtcactcacaaatgttaatatgactccaattaatttttaaagcgctcgctgaaagttggttggtggtttttaatgatggagctgtgctgtgcatgtagaaaccttacacgatgactcttgtcatgctctctgctaagtcccatctgccaaagaccctaatcactcctcataagtaaggtggtcatataatttattgtccataccaggatagttttgagagtgaaaggcagctctgtttataatatctaggactacaggcataaactggaattgcctcagacaaatgagaatgaatggtcacccaactcatataagaacttagctgttggaatagtcttgtaatgtcctatgattcttccttctacaccgtggtcaatactttcttcagaagctaaagggggacaagcacagagaatcatttgctactatttaccgaacttggaagtatttaatttccagtgctgataatgtttcactgtcatcccttttgaatactgtttgtgtcatagtttcatgtttgtatatttttctccatttcttcatttctctattagagtattactatactttaggcataaaaaatatctgggcagagggaaccaaccatcccaaatttacacagaaagatttaattctttggtgttattatatccatcctcaccaaaatgaagcttaacgccaaaatatagaagtaagaagaagaaggaaatcacagtatagtctgtgggttaaattaattttgtcacaagaattcatttggaagatgcttctcatatatctacagagttgaccaaatcccctcccagtgaccttccatttagttggaatatctaagcagacataaatagtaacatcagggcacttcagaatcttcatccgatttatatcttcataggtccatgtttctattttcaaatgtcctttatttcaaagcagcatgtcactaaaaaaaagaaatgggcaatcatcattcctcaaaagatacgtgcatttggttgggcaaaatcatccaggctaccagttggataataaaagtcgaaatgtactatttgattttttcctatgtttccaagcaagtatttctcaccagacactgcccccatcatatcccctttcctcttctcgaattagctggttttcttagtgacaatctgaactcatgaggttgaattcaccattgcttacttcctggtagtccataaaaagtaccctagagaagtaagagcccacagggatagagtttgcacaataagattcctgaaagcctgcatgttcctgtaacattccatttacagaagactccagccaatccaatgtaatatgctctcacctgaacttctctatcaattagatttttagggaattacttttaactaaatttcaggctatttaggaaataagttgtacataagcaatacttattctaatgtgataaaattatctacacacagtcaaagcaacgtgtcaatctgtagaaactaaatcaaacagtttgtggtatggtctaaagataaagcaagtggtctaccctcttctcaagtggttctcctggcactgtgtaaaccagtccccaaaatttaatgtgtataaaaacttcctggagatcttgttaaaatgaagattttaactgattcaatagatctggggtagactccaagattctacgtttctaagaaggtcccaggcaatgctgatgctgcttgtacatggaccatattttgagtagcaaggatgtggtgacaggatcatatttatgggagaagagaggccagggttgttaagtgccttcagataaggatttcaacacacgtaaggccatgtttctgatgttataggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 429 - DNA, 10722 bp, Homo sapiens
ttggcgcgtaaaagtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtacggaccccagggacgccgcgccgacagcgccgcctgtgccccccgcgcagacccgggagggcgccgtgtttggcctggaggcggcagggggcgggggaggggttgactgaggcgcccaggctgggcggtgcagagccggggttgggcctccgggccccgccctggggtgcggggtgacctcgggccggtccctgtttgctgctctgtgctctgcgcctcagcttcctcaccggagcctccccagcgtcggactcagtgataataatagcccacgtgtattcaactggcgtttactgcatgccaggcctttgggcgacttcaagccagctaaaactcacaaccccgctgtgagctgtgttgtcactgtgcccatctgacggaggaggaactgaggcccagagagggaaagtgacttgcccctggtcacacggctgcaggtggtggggctgggatttgaactgaggcctgctggcttcagctcagaatttgcatctcggtagtgagcacagctgctaggggaagtgaaggcggggcggaggaaagtcctggggcctaaccgttggtgagccattgaggagaccctccttcctgcctcgatgctgactgccaggtgcaggcctggccggccaggcctctggggacagccctcctggctgggaggccttctctgcaggggcggggcagctggaccagctgctgatcccctccctctgcctgtccttccatctgccaccctccaccctcccaggccctggttgccatggaacctcattaatcaggcaggccgacccctgagtctctgtagaaggactaggtgggctgggcctctgggagctggagaggaggcccccagtgccaggagagaaaatgtctcagggagatcctttaataaagccctccctgatcgctgagctcaagacgaattcagactggagggcccagaagaggcggctgaattccagtgggagaagggattggaggcgtagaagcctggagctgggaactgtggggcacagggcagggtgtggagaccagtttgactggcgcagcctatgggtgaaggtggggctctggtgtgcaggcggggtctggccaggcaggatggggtctcagcagggaacttggagcaagtgggaggggtgaggcaggactcaggacaaggaggtagaagctgcctaactgctgatgggggtgtgggtggcagctggtccctgaggcatcctgaggaggctcccccaacccccttggccccatgcccagtgctgccttccggaatcaccacaatgctaataataataacaatagcagccaccattgttttgaggatgtcttgtgtgccaggctctgtgccaagcgctttacttaattaactcatttaaccccatcagcagcagtccctttttacagattgggaagctgaggcctagagatgttagaatcttcccatgtcattctgctcttgagtggggagagcagtctgcgtttcctctgaggttgacctctgggatgccttgctttctggggatgctgatacaggttgaagaaagggcaagaagggcttttaggggccctccctcttaatgagtgggtgggagggggttgtaccaggggtgggccaggtggcctgtctcctgtactccaggggcctgttcctgtgggtaccacttgggacctgggcaagcatcttccattcagctgtgtgacaagcattatagaaggctcaggtctgcggaaatctaacaacctgagggtcttgtcctcaaagatctgaacaggattatgggttctaggatcaaagggagggacaggggcaaagaaaaatgccctccactccacctgtcaggggcaggctcattggcctgggcattccattcattcaacagttgttgagttagtgaatgcccaggaggcactaggcccagagacaaggagccctggcccccagtgtacttaagggccaggaggctggcaccattctggaactgaagtccagaaagtccacaggtttggcttttggcctctctgcactggcatttgtctggcacagtccttgaaataagctacaggcttagcttctataccagcaggcattctgtatacaaggctctgcaattcagccattcctcttggccctgcctgtccacttccacaaactcaagtattataactataatacatgtttaatgtagaaaacttaacttttttatttatttatttattttttttttggagacagggtctcattctgttacccaggctggagtgcagtggcgtgattgcggctcactgcaacctctgcctcccaagttcaagctattctgtgcctcagcctcccgagtagctgggattacaggcgtgtaccaccatgcccagccaatttttgtatttttagtagagagagggtcttgccatgttgcccaggctggtcttgaactcctgagttcagacaatctgactgtctcagcctctcaaagtgctgggattacaggtgtgagtcaccatgcccagctgaaaacttaactcttaactcttttttttttttttttttttgagatgaagtctcgctctgtcacctaggttggagtacagtggcgccatctcggctcaccgcaacctctacctcctgggttcaagcgattcttctgcctcagcctcccgagtagctgggactacagacgtgcaccaccatacccggctaatttttgtatttttggtagagatgaggtttcaccatattggtcaggctggtcttgaactcctgacctcaagtgatctgcccgcctcggcctcccaaagtgccaggattacaggcgtgagccactgcgcctggccaaaaacttaactcttaagaaactagaaagttgacggcaggatcccagccctattcatttttttcctttttttccctaaggctatttttgtttgtggtggttgtgacagtttttgttttttaaagttttaaaaattgtagtttttcctgtatcattcacaccattcagatatggcactggtctcccacagtccttccagaggctgccccgaaatgtattctataataatataaactgaaccagagaaaagtttcatgagctttttaatccaaaagggatcatataaatatatcgccctgtgacagtgttttgcttgtctgtatgtgtgaggggattcttgtcaacctgcctcggtccttgacagctgcgtggtgttcaaggggctaaacaaagcacagctttcgtgacccccttcatggatgggtgttcgagtcatccagattttttcagcagtgaatgtcttcacccctgcgtttcggggcccctctgccagtgtttatctagggagaagtggcagaaatggcatccactcaagcctttgttttagggcgtggcactgacctgccttcaggggtggacaagggtggggatcccagggagaaggcaaggggtgcagatggcagaagcatgctagggtttgggccccaggggcgagtatggagggggatacattctggctgggttctggggaggtggggcacgtggcgggtatgagtgtgggctctgtaccagccaactagggtgcaagtcctgggtccacctctcactgtgtggcctctctcaggtggaggccatcatagcacctgccaaaaggtggccggagggttgcaggggaagcagttgagtacacagtgcttagagcacaacagctcttctttcccctgggtgccttcaaaagtcagtgaatgtgcacaagagggagtggttcatcagcatggggggggttcattcagcaaacatttgttgatgccaggctccatggcagacactatagattctcaagtgattcagacacctctgagggtgagatagatacatctgcagaaatgtgtagggagagacagaatgtggcaaaaggttgggtttgaggcagttcagagggagaagaggtgacacctcctagctgatgcgtaaggtttctgcccacagaggtagagggagcaggcgtgaagtggggagggtgggagggatgcaagggcagtctagatttctgggaaaacgtgactcgggttcctctagagaagcagtggcagatgagagtacaaaggcaatggggagctggaggaaggccttaagcaggggcggcggcatggtaaggtttgtaggaggactggctgcagcagaggcagggagaccagtgtggagtctgctcagcagcccactgggaaggtggtgatcgccgtggtgatgagcagttcttggtagctgcatgtgaggagggtgacaggtcaggaactctagctcaggaaaccctgtggatggtggaggggaagatcagtctggttttggtccgggtacttttgagcagcctgtgagacctccaggacagtcccaatcctggagtgtctgaactaagccagagtgcttagagcttgggttcttcctcagaccgtcttgggtacaaatcctgactctaccacttcctgggcctccctgggctttagttgccttatctggaaaatggggccatttttatacagccagtccgttgaatggaatgaactaatggatgcaaggaacttgatgagcaccagctgctaccatgcgtatagattagtcaaaaaccagagagaaggtgatttagccaagggacctatgtaatcagtggcttagctgggcatggtggctgactagtcccagcacgactacagtgaaggctgagatgggagaattgcttgagcctaggagtttgagaccagtctgggcaacatagggagaccccatctctacgagaaatagaaaagttagctggtcttggagggatgcgcctgtggtcccagctgtttggaaggctgaggtgggaggattgcttgagcccaggaagtctaggctgcagagagttgtgatcataccactgcactccagcatagtcaacagagcgataccctgtctaaaaaagaaaaaaaaatagtgccttaaaacaacaaacatttattatatagtttttgtgggtcaggaattcagggaagacttatccagctctggcttggggtctctggagattcagccagtgtttgggttctggctgctaacagaagttgtgactaagtgttgctgttgggaggaggccatggtttcttgcccatcattagggctacttgagtgcccatatgatatggcagagtaagtgacccaatacagagcaaggaggaagctccagcgcctctgacccagtctcaaaagtgacaggccatcccttccaccacattccattcattcatccccagaagcaagttaccaggtctggctcataaggggagaattaggctatatcttttgaaggagaaggatcagaaagtttgcggatgtgttttaaatccaccgctagaccccagagaagtggtgaaaatggaatgtcctgtgtggtaggactgtgactctcaggctatgtcccctctgatctccctcagtcacacactcaggcatcctgctagagaaactgaggcgagggtagcccagaggcacccagccttaagccaggtctcttctggcctcactcctggttactgggcatcctcccgttttcgccacaggtgaagcggaggctggacctggaaactgaccatcagtacctggccgagagcagtgggccagctcggggcagaggccgccatccaggaaaaggtacctatggagcttgggctgggcagaccccctgtgaccaggcccaggttagggatgtgaacagacaaacatgcttgcaagctaacgtctggcttgtcgggcttgagccaggcctctgaggaccctgatgggcagttggagtggccacctggcttggtttctccaggccctgaggggtgaggagttccccagccagaagaagaatgctgtggttggcctcgccaaggggaaggagctggctgtcccccagcccccatcatcctgctgccctgcactgccagagtggcaggcctggctggaggtgggggtggatgctgaagggccctgtcttgcctgaccacacccccacaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgtaggtaccggccacacaggagggcaggcacacctgcccatgccagcctggaggagctggtagtaatacccactgtggctgcctgcatccccatcttatagctggggaaacgggctcagagaggagaggtagcttccctgagatgatagatggtaaaaagcacacaaatcttacatatccacctcagttgcagctttacttttttcttttttagatggagtttcactctgtcacccaggctggagtgcagtggtgtaatctcagctcactgtaacctctacctcccaggttcaggtgcttctcctgcctcagcctcctgaatagctggggatacaggcgcctgccaccatgcccagctactttttgtatttgtagtagaaatggggtttcaccatgttggccagtctggtctcgaactcctgatctcaggtgatctgcctgcctcagcctcccaaagtgctgggattacaggcatgagccactgcgccccgcgcagctttatatatttattcatctgggttgccaccattcagatcaagataagagcattttcaacaccctagaaggttctcttgtgcccctttccagtcattgccaacccctcacaccgccaggtcaccactatcctggcttctcatgccctcggtgagatctgtctggcatagatattttattcttgttttattttccccctctcgccttcgcgccagtcatcatgctactaccctttctttgatacacctgccgtttcattttttggtagatcgttccattctgcatcttttgtggttttttgggtggaggggggtggtttgagacagggtgttgctctgtcgcccaggctggagtatggaggcacaaatacagctcactgcagcctcaacctcctgggctcaagctccgtacctgtagctaggactacaagtacatgccaccatgtctggctaatgtctttgattttgtgtagaggcagagtctcactgtgttgcccaggctggtctcaaactcctgaggctcaagcaatcctctggcctcagccccccaaagtgctgggattataggtataagccaccaagcccagcctttttttttttttcatttgacagcatgtcttggaaatgcatgtgtgtgtgcatgtgtaatatttcgtggcatgtcagtcccatcatttgtttatcccgccctggttgagggacatgtaggtgtttatattcgggccagacttcaagcccatgacactctgatttggagcccagctgaggagccagacccagacagaagcaagggcttgcctaggcctcacagaacagaggcaacagcagactctgtcctgaggcccagggctcctggccagaggggccaatcgctgttaaccctaccctccctggtgcctccccacaggggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgatatccttggattggccgtagggtgtggaaggcaggcttagcaggcaggggctccacccaagtgggactagagaggcttggatttaagagagagctctgattttggttgcaagtcctggctcagcattttctcactgttgtgacactggataaattgcttaacctcttggcctcagttttatctataaaaggggaataataatatccaattctgaaattgtacagattaaaaaagaaaagtggctaggtgcggtggttcatgcctgtaatcctagtgcttcaagaggctgaggtgggaggatcacttgagcccaggagtttgaggctgcagtgagctctggttgagccacatcactccagcctgggtgacatagcgagaccctgcctctaaaaaataaattcccagcaccaggcctggagttgtgttgaacattttacatggaatcgttcccggtagccattattaccttgggattcaatgggtagagtgatttcattatacagatgtggaacttgaaactcaggcgtgaggtaggttttgagtgggtaggaggttgggaggacaggagtgactaggcaggtgtgagccctgccttgtgagctgttggagtgagtgaccccctagaagtcaaaggtcatgtggtccttgactctgccaaccctggcctacgtgacgtgtcaggaccttcgtagcattgcagaccctgcagagcagatggttatggtgatcaaagcccctcctgagacccagctccaagccgtggactcttcggaggtgagatctgggaactccgggcccaactgggctgggctgggctgggctggtggtcacctgggcctcagtttaccctgcctgctgcttccacccagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaaggtgggtgatgggtaggtgggtggggtggggcagggcccctcttctggggggtgggcaggcacgacagcccctgccttcctccctgctggggcatccccggcctgtgatgctccccgtctccccagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagatgctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatgtgtgcgcgtgggggggctctaactgcactttcggcccttttgctctgggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggccccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 430 - DNA, 117320 bp, Homo sapiens
ctctgtcgccgctggagcagctgcggctcggggacccacagacacagccggggtcgggagccgcccggggcagggctcgggagagcgggtgagttccccggcggcgccaccaccctccttgcgctctgcggcttcgcagggcgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctgcggccgtcgtagaccgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcgcgtggcggggcttggtcctggcgggcagcggcagggcgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcccggcctccagcttcactggagatgctgatgatgcagctcccagcccttggaggataattgagcctgggagagctttgaatctggccctcctgagaccccagggctgcgccgctgccgcgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggcccggaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctactcgtgggcaaggtacttggcttctggagtctcaactgcctctaagatacggggctaacagccgccaggctgtggggagatgagggagaggctgggtgcagcagagcgggaggatgaacactccttggccaatactggccgccctcgggattggctttgagtggggcgtgtctctcttagacaggtgcagaagtggagccctggtgggtggttctgcaggggctgggggagtttccacatcttcctcccccagctctgtcataaaaagccagcttgcaggaggccggtgggggccagcaaatccttccagccggctgcctgctcacacggcccttcccacacaaatctcccatgcccttctctcccacctgtcacccaaatcccatcttcctggctgagtccccaggatgctgggggcaagatgtcaaccaggccaccctggactgtcaactctgtgcctacttgtctactggggtctacctaacagtgttcccctgtcctggaaccttcctggctccagctcttcccagcctctgtaatgtcttctttcccctcttttggtctcctaccaccgtgacactcattagtggctctgtggttcatgtgtcaagggccccgtgccatctgtgctctccagatcatccatggcctagaaagacacggtaggcaaggccctgtgcccactcagactttgctctccctggtaattgacggagtggaggttaaattctaatctagctgttaagtcatttcaggagcttgagccacagggctaagaggatactgatgtaggcaggtggtttttccttaaagccagaacctttctcctttctgcagagcccatttgagccctttggaaactaggcctatgtgtgatggcctcacagaatcctcacaaccccgtgaagtaggcattactgattcccattttgcagatgggaaaactggggctcagctcctctcaaaaccagctccatgccccaagtgtagcaacagaggctgcagccaacctggtttaggagaaggcagaaggcacatacctgaattcaggtgctgtgcttggactcttgggaccccatccccccaacctttccctcccctctcccaacctagccaccacccctcctgcacccaggactcttgtcacatttgttgaccaggaggtcccaactggcactcttccagcagagaccaggaaaaccttcactgtcctgagtgcatcttagcaattgggcttcaagaagggctcggacaagcctgcctcttacagaaagctacgagtatgaagagtgagggagccagagaggtctaattttaattagggatctatacctaaaagctctgtgaccctgtatacatgacttaatctctctgagtctggttttctcatttgtaaaataggtatcacagtaatgcctactttgtgggattgtaaggattccatgagaccattaacacatagaaagtgctcagtactagggtggagcatagtggctcacacctgtaatcccagcagtttgggaggccaaggcgggaggatcactagacgtcaggagttcgagaccagctggccaacatggtgaaaccccatctctactaaaaatacaaaaattagtgcagcatggtggcgcatgcctgtagtcctagctacttgggaggctgaggcacgagaattgcttgaacccgggagcaggaggttgcaatgagccgagatcacatgactgcactccagcctgggtgacagagcgagactccatctcaaaaagaaaaagaaaaaaaaaagtgctcagtacagcatctggtgtgggtaggaatgcaggaaatgatcattgtcaccatcactactatttcctcctttgtgttggactctcaaaggtcccacctcctccagtgctagggtggggagtgagtgcgaccctgtctcttctgcctgtagccatcaggacggggaaagcctctcagcctgtctcctggggcgggggtgggggctcactcctgggaacttgagtctagcaccagcttttccccggggagtctgtgagcagccacttagcctttctcagctgactgccattttccaggattcattgattcattcaaaagacgtttattccatcccagcccttgtgcttagcaagggatttcaagatgaatgaggcagctctcagagttctccctctatggggagaggcaggcctggagacagataatgaggacactgtgggataaaggctgcaacagcaagaagagagagtgacgagcagatccacatggctcaggctgacccaggtctgaatcttgaagctgccaccttgtagctgggtgaggatggacagaggccttacctctcaagcagataagccacctccctaagatgatgatgtgaggagagaagtgagacactgtggataaaaaacctagcttggaccaggtgcggtggctcatgcctgtaatcccagcaatttgggaggcagaggtgggcagactgattgactccaggagttcgagactagcctgggcaatatggcaaaaccccgtctctacaaaaaatacaaaaaattagccaggcatggtggtgtgcacctgtagtcccagctacttggaaggctgaggtgggagaatcacctgaacgggggaagtggaggctcctgtgagccatgattgcgtgcacctctgcactctagcctgggcaacagagtaagaccttgtttcgaaaaaaaaaaaaaaaaaaaaacaaaaccaaaaaacttaaaaacccagcttgggctttctagatattaataagtgctcacagatgttcgttgctattattagtctattattgccaataacaggtgggcaaaagttgctgtgggagcatgttgagcccttcagtgacagttttccaggtggtagggcagccctagccgggagaacagcatgtgcagaggcaccgaggcttaaaagtgctggatgtttttggagagcagtgggaggagttgctgatggagcagagtcatgagaaagtttgatggaggcagaagcaaggccagggaggtagcagaggctatcctgccgggagccccgaaggattaaacactcactgacccgaggcagtccctctgcaccttccttggagggtggttctctagtgagggttgtccaggaaacttcaggattaacttttgcatgggaggaagggctggtctctgctcaactatccatacattcaccatccttccctcttcattccacccaggaagcacgaagaagaagaggtccactccctcttcctgagatgcttttcccacctctgcacttgtttctctcttcctgggactcagtttctcacctgagagaagagggtagaagtggaggaagcgtcatgacctgactcactgattgatcatgatatagcaccaagtgcatttctggatgctggtcactgtcaaaggtctttacttgcatcgccattgaattctcataccaatccgttgaaatgaatgcacttatcccccactgcacagagggagaaaccgaggcacagagggtgaggcaatttgctaaagggcatgcagcttgtaagtgacaggaactcacgtcttggggggcatctcaaagttgccatgtgctatccttcaccaccttcttcacacactttgtaaatctaaggctgactgcagaatatctggcctcttttgctttgtgtacctttgggcgctgggcagtaggcattttggagatgggtcacagtggggtgtgctctgggtatgtaacctgactttggggaaattcctgggtgcagacgctttgtggggaggtgttcttggatgtctcagaatctagaatggcattccttcgcccacagatgtgccttgatgcaggcaatgtgcagcttgattgatgtggcaagatggtggctgagccccacggtggccccaggaaggaatgaatgaatcttttaggatggctgatcagagcatcacatgaccacagaccctccctgtttcagaggacatccaaacacaggcttacatttccttttacatgggggcaaagtttggggccagggttcaaatgctggctctgcctccactggctttggggcctagggaaattttttcacttccttgaaccttaatttcttcatctggaaataaagatgaagaaataagttgctaattttagcatcttcaataagttgctaaatagtaactcacaaacacaattctgaattgtcataaggatttgtaatcatatggaaaatgcttggcttccaagctgtagataatattgatgtaatatccagcagatttttctctgcagtacttataattgtgattatatggttatatgtgagcattactcttttagtcttctgtttcatccactagacctgtggttctcaacttggggcagtttgaccctccccaggggatatttggcaatgtctaaagacgtttttggttgttacaacttttcgggggatagtgggggagaggagctactgacatccagtgagtagacaccaggggtgctgctaaatatcctgtggtgcacaggagagcacccccacaacagaaaatgatctgatcccaaatatcaatagtgctgaggttaagaaagactacactggacgatgagccccataaggtccgtgactgtgtccaattcattcagctgtgtgtctccagttggccagcgtgatcagcatgatgtccagcacacaggagacaatcaatatgcattaaaggaatgaatgaggacttggaaggccttatgtcccctggagtcccaggggtttagcttgtggaacattttgaataggcagaagagatttagatgaacttgaatgatgaacagccaattagtaactcaggccaaagacattcagaccgagctctctgttttccttcccaagcaggtgcttgggggcccagattatctgaattgttcctgccatcaccactgcattttacccatgtagatacaggacccgtctttatctggaaagtaggctggggcagaggagcataggtgctgtcagctgggcccttgggatttgccaagctggggcacagctgcttgtcagcttcctgttttgtccctttctagtggaatgaaggaaacccactgaatggctattttccactgacatttacagcaatgtgataggccttggattaatgaggtcaaactgcagtgtgaaatctgcctgataacttgaagcttggccaacgggaagacatcgcttgttttctttggaccgtttgatgtccctggatggctttaggcaggaaagcaggggtctcaattctgtacgaaagaggagggtgttttacttcctggaattatagaggccagaggtgtctctttttcaatttattgggaaggtttattttaatatggacttagaaataaataacttattaaagtgaaggttcacctggagccttaggctggctgctaagtgtgagtctgggctgttgaagggactgtgctgttcttctgggtctctgtaggagtttgaaggagaagactggccccaaagggtgtttgaacaggttagatgtgcccattggttagaacttacttggatagggagaagggatctagggcgtatccacaaacttgcatatggatcccctttggtttcctgctaaaatgcagaaactgactcagtagggctgggtatggagttttctgcatttctaccaagctcccagggggtgtcaagctgctagtctgtgaactgcactttgagaagcaagggtatgggagaccccaagtctacaggtgagggttccctggtgcaaaccgcttaagcatgaaagcaaatgcagcctgttgtgcctgttcacacagccatctgctgtgctggctggcttgcggagtcacagatgttcactgtgccccttctctgtgtgcccaggcctgggaccagacttgacaaagacgatgcttggtctcaaggagcaactcagacagccagaatgtcagctagaatgatgagctttgagtactttcaaaaacatgtatccaggtacatggtgttcctgggtcatctggtcacctgggacttgtgagaagtacagatgcctgggccttagcccagtccacctgtgttagaatcagccaatatagggccctgaaagtctgtattttctcaaagtgtgccaggtgattctgattcacagccagactgatggaagggaaggtgggaggaagaactgccagtacatgcaggttaattgctcagcaggacctatgtaaggttgtagagttgtgtattgctgatgggcacagtggcactcggctaaaggagaggctgaaatctagcctgtggatccacttgccaagctctgcaccctgcagggttgcatctgcttagagggacgggcacctttttcttaatattcatcataatcacttggtacttattatgagccaggtgctgtctacttaactcctttagtcctcctaacaactctaaggggtgacatcatcatcatcatcattattattattattattattattattattattattattattattttgagacacagtctcactctgtcgtccaggctggagggcagtggtgccatctcggctcacggcaacttctgcttcccgggttcaagtgattctcctgcctcagcctcctgagtagctgagattacaggcacccgccaccactcctggctacattttgtatttttagtagagaaggggtttcaccatgttggccaggctggtctcaaactcctgacctcaagtgatccacccggctcggcctcccagggtgttgggattacaggcatgagccactgtgtctggccaggtgtgactttagtgctactctgattttactgttcaggaaagtgaagcagagaggttcaatgtcttactcaaggtcacacagccagtaaatggaaaagtcaggattccatttcaggacatccggcttcaaagtccttgtactgaatcattacactctctggccctttctttgcataaaaatgctgtcttctctttatggggctatccctactctgagggagtaccttttttcttgtccttccttcagaggggggaaggctagcaatgaccttggctggctttagagtcaggtacgggtttgattcctacctccagcacctactgcaaccttgagtaagttacatgtgtgtatttgctgagccacaatttccccatatgtaaaacaggaataataatagtataatataaattgatatgattaggcatttagcctctgcttggcaggtaggaggtacctgatacatgccaactattcttatggcattattatcattagagttagtccctaggagtattcaggagctagggaaataggtgagcaaagcactgtgtcattatgtccccaggagctgggtcattcattttgttcactaggttacttatggccattacttacctgggcatccctagtctcctccgcttcttggccccagagtctgtgccagcctggagagttctcagaatgtcttagttcagactcttagtcagaactgcctttgtttcctcacatccaagaacaagtaaaacatacaaattttgacacttattctctttaggtctcttgactctttttggtgactttctctgtctcctgttttctttctggaactattgctgtcgttggctatcccatggactggatagagaggaaatgttgccttataaacattgccaattaccttataaaaatatagggaagattttcaccaaaatgtcattcattttttttcttttatatataaacttaagcttttgttttcctatggctgtatgtcatgctttttaattacacaaagtatataagtgtatcataagtaaactttccccatcttctcagccactcatcccttttccccggaataaatctataaatgttttatgtatttttccataaatttcatatgcatatataaacccatattcatttacatgtttatccatttttctttttaacacaactatacaaaactctcctgagatcttctttttcagctaatttatctgagcacatgccaacacacagatatacctggatctttaaggctatctgatagtccagtgataaaaatgtaccatcatttgttttctagtttcttgatgatggctaagatagtttccagtttttttcctcctacaaatgtataatgttgcaacatccttgtttgaacagtgtatatatctttgtatactctacatactgatgattttattcataaggaaaattcctggcagtttcaactgtgatagacattgctaacctgttctccaaagaggctgaaccaatttctgtttcctcaacagtgtatgactgtttcccccatctattctccagcactgaggattaagtaactttcatttttgtcagtctgacagatataaagcagaacatttctgcataaggttctacagtaatttttagattttatgaccctttggattatgcctacataatgatgatcaaatattcagaaactacattgtacctggccttaggcttggaattggatacaaaattaaatgaaaccagcttttgccctcaggttgatcccatctcctggagttggcagacaaatgaacaaataaaatgagagcaaaactgtatggttcacattgtgctagagaaatgcataagcttagctaacttttgtttgataaactctatattcattaatatcacaaatgaattcataaaataccgtatgcattatgtcccagggtgtgaggaggcttgaaattctcaaaagaaaacaacttgattagaagcaaaaagaaaaaaaaaaataatggagcttatccttagtgggggcagcagaagaagtgggaagttaggaaggggtgagtaattttagaatagtctctttggtagtttccatgttcacaaatagggtttgtttgagggagcctgtggggaaacccagctgagtttgcagctggcactgattaccgatcactcaaacccgggcagatctgtacgttggtccagatagagtgggagcaaggaaacaggaggctggctttaaaaatcagcaaccttgaagctcatagaggttggatgtaggtggcataaataggctgtttaccacagggattacaagcaggtgtgctctgaacaggcctgtggtagagtggatccatagaatggttttcaatcaatgaatgaacatcaaacatctgtctatgtattgtaaagggacctccttctcaaaaagaataggtccatgtagaaaggggtatgatcatctggtcgacccacctggggggaaccaagccttagctatatacattttctttgggcccacctgtcctagatagctcttcattcacttgagacatcttaaaagcaacacaacacaaggagcagttgagaaaatcaactgaatcagcgctgtggaatgaacctaaccattgttttacaacaaatcccctcagcagcgatatatagagccaattgcaaagcatgcagagtggaaaagggactgtgaagaccagcacaatcttagtccaccctcttacaggaggcaaagggcaggggccaggcgaggtatgtcctggttctggtcccagggcccaccctcctcctcccccattagccaagtctgttttgcccagtttgatgttacagctcttgttctaagtcaaaggaccactctctcatggcagaacagaaattcttcatgaattttcagtctcttggccagcctcctgtccaccctctcccacgtattgaatacctaccatgtgctgggtggcgctatcatgggatgtaaaggtgaacaatacatatcccttgtcttctgagagcatccagtccaatggaagaggcagatctgaaaccagcaattaccagagtgctgagtgccacagaagagatgtggtcaaatgccttgggactagagagtggaacgaagactgtttggcacaggagagataaagaacaattcagaggcaatattaagacattgaggctgggtgtggtggctcacagctataatcccagcactttgggaggccaagctgggcggatcaccttaggtcaggagttcaagaccggcctagccaacatggtgaaaccctgtctctactaaaaatacaaaaaaattagccaggcatggttgtgtgtgcctgtaatcccagttactcaggaggctgaggcaagagaatcacttgaacctgggagccggaagctgtagtgagcagagatcgcaccactgcactccagcctgggcaacaagattgaaactccatctcaaaaaaaaaaaaaaaaaaagacattgagacaatattgtctaaatgagacaaggcaagtgctgagcacggtgcctggaaagcccttaagagatgatagctattgtcattttagcacttgagctacctctcaaagaacaagaggagtttgccaggtggagagaaagaagggtactgccactcataaaacagcatgtgtgggtcgggcgtagtggttcatgcttgtaatcccagcactttgggaggccgaggcgggcggatcacgaggtcaggagatcgagaccatcctggctaacacggtgaaaccccgtctccactaaaaatacaaaaaattagccgggcgtggtggcgggcacctgtagtcccagctgctcgggaggctgaggcaggagaaaggcgtgaacccgggaggcggagcctgcagtgagctgagattgtgccactgcactccagcctgggcgacagagcgagactccgtctcaaaaacaaaacaaaacaaaaacagcgtgtgtgaaagtgaggaggttagtgtggtgtagtgaaaattgcatgggctttgtagcagatacatcttggttcaaatcttagccctgccacttcctagttgtgactttgggcgtgtcaagaggagcctccttttactaatatatccagtgggggtaatgatgcctgtttctaagactcattgcggggattaaagtcaatttatgcatagtacctggcacacagtagagtctcagcaaatggtgagtaccactggggaggagtgaatcatcagtcctgttcggtgcagctggaaaattgggtatttagtgagttgggggaggggagggaagtcaggctggccagagagaaagctaaaatgtcaaggcccagatattggacggtttaggctgagagcttgaaactggacagcataggcagtgggagccatcagatgcttccctccaagggaaatacaggatcaaacttggtttaagagtgaaaactccaccagcgttgtggatggctggttggaaggtaagcggtggaggcaaggaaaccactttgggaactgctgcattcaatattcttgtcttgacaacagctcagattagcatagcaaaggctcagttaactcctgcagtcaagtgctgtctgggcaggcagttatgggcagtggtcgagtgtgtaggcttcactgattgtcctcttttttttttttttttttccccttgagacaagatctcactctgttgcccaggctagagtgcagtgatctgtgatcgtgcagtggtgcaatgacagttcactgcagcctcaacctcctgggcttaggcgatcctcccacctcagcctcctgagttgctgggactgcaggtgggagacaccacacccagctaattttttaatgttttgagatgaagtctcactgtgttgtccaggctactctcaaactcctgggctcaagccatccttccatcttggcctcccaaagtgctgggattcaggcatgaaccactgtacctgaccccttgtaattcttgcaagaaaaaggaaaaaaaataaaaaagagcatgggcttcagtgtcaaagccaatctggatttgaatcccacccctattgcttactggacattgggcaattacttaaccctatggagcttagtttgcccttctataaaatagggattaatagtacttttctcataggcttgctgtgaagattacatgaaatagtatgagtagctaaaacacatagcttagctctaggaatgcagtgagtgttcagtaaaagttgataattgtgataaaatatattactagctgggcatggtggtagctataatcctggctgcttagggaggctgaggcgggaggattgtttgaacccaggagtttgagaccagcctagggagcatactgagaccctatctcaaaaaagataaactaaaaaataaatatattatgtatatgactatagaagacttttttcatgtaactcctattaacatcctctggcgctactagtgttctaccaaaaacatcctgctttcagacttcctggagaagcagcagcactttctgctccaagaaatagtaaggagagttgccaggttctgacacagtggttcttgggtgcacatgagacccacctggggagcttttaaaaacgtcaatttctggctgcgttccagaccaattaaactagaatctgtcgaggtgggacccagagagcagtatttaaaaaaaaaaattgtgatgatttcttaaggaaaaacaaatacacaaaagtacacaaatcttaagtggatcaatttttcacaaactgaacctatctatttaacccatatcctgcttggagtgctaccagcactccagaagccccctctccaaccccgtatgtccctttccagtcactccctacaccctgaaaccacatagattagttttgcctgttgttgaattttacataaatgcaatcatatagtatgcatttttgtgtgtttgggttattttggttaacactgtttgcgagagtcatccatattgttgagtgtaattgtatattgttcattctcattgctgtacaatgtttcattgtgtgaacaaaccatattttttctccaaactacttctgggggcattttgggttgtttatactttgcgtctattagaaatagtgcaattaacattcttgtgaatgccttttagcgaatgtatacagaaattgctggccgggcgcagtggctcatgcctgtaatcccagcactttgggaggccgaggcgagcggatcacctcaggtcaggagttcgagaccagcctgaccaacatggagaaaccccttctctactaaaaatacaaaattagccgggtgtggtggcacatgcctgtaatcccagctactcaggaggctgaggcaggagaattgcttgaacccggcaggtggaggttgcagtgagccgagactgtgccattgcactccagcctgggcaacaagaacgaaacttcgtctcaaaaaaaaaaaacaaatttctgttgggtgtattcctaggaattcaattgcaggattataggacatgcccgtgtttaattttataagacattgctgaacagttttaaaaagtggttgtaccaatttatattcccactcagtgtgtaagaatttttgccaacagttggcattttctgtcttaaaaaaaaatttgagccaggtgcggtggctcacgcctgtaatcccagcattttgggaggccgaggtgggcggatcatgaggtcaggagatcgagaccatcctggctaacacagtgaaaccctgtctctactaaaaatatatatatatataaaaattagctaggcatggtggcaggcgcctgtagtcccagctactcaggaggctgaggcaggagaatggcatgaacccaggaggcggagcttgcagtgagctgagatcgcaccactgtactccagcctgggtgacagagcaagactccgtctcaaaaaaaaaaaaaaaaaaatttggccattctgatagatttgtagtggtctttctctgtgatcgtcctgtatattcccagcatctccaagtgattccaatgccaagtttgagaacgtctttcctaacagattttgcaaaagcagagtagaactggggaaagagatgttgtaatggtgagtgcctccccatggactccctgtgatgtcccagagtttttggtagaactgacctggctatcagccagtggagggagaatgttcacatgtgtcaaacctgacagcctgcctctcattcctatgtgctttatttggagcaaatggctccaccagaagtgatctggaagctaagggggaagcactatgaagctctggaaagatgccacagcaggactttcatctctttttataatttaagacctgaatgagaagggaagatatgagaagtgactagtgggctatatacacattgtcagagaagaagagctggtctttgtgacatatttttttgccccaaaggctgcctagaccctggcacttggaaggtgctaaaaaatggtcattgaaataaacatattagaactatccctagtgagagacaccacccaaagaggtgcagaggaaggtactggtgagaatttagtggaattgatgctttgggttcttttctttgtaatttctatgttgctgctgagatttcctatctgttcttttattacaagcataatttcctttacattcttgagcaaagttataactgctttaacaatctttattatttccaacacctgggtcaccttgagattggtctccattgattgccttttctcttgagtttgagtcacattttcctgtttgtttgtttttaatttgcctagtaattttggattacatcctaaatgttgtgaatgagacctgaagagactctgaattctattcctcagaaatatatatatattaatatatataatatatattatatttacattatatataatttataatataaatataatatatatatttttttaatcaggcaattaacttgaccaaactcaaactccaaactcagtctttcttgggtggacaacatctgaaatctttgctgaattcatttagctttagttgaactacttgaagtctgccttgtatgtacatcattcagtgagatttgggcactgtttatactcagaatttggggctactgttctgtgattcttttctgggatatttctccttattttccagctgtggttacctgaactctgtctttaaactcctcaaatagtaagagagtagttttctatccaagttttagctagtaagtacagcactgactgggcgcttcccgcaaataaaaagccattaaaaacacgaaagttatctagtgccatttctttccttcaggtgttgcctcctctccagtttctacttgcttgtagttgaacacatttagtgccttccaatcttttttttttttttttttttttctgtctagagttcgtaatagttttgtgtgggaagtttggtccagaaagagctactttgcccttactagaagcaggacctctctgatcaatagctttgttcatttagggatccttagacccaccctactttattgcctacctcatatagatggcaataaatatttgtttattggctaaataaataggatttaaattaaaaatggaagtgaattttcagagaaaattgccagaagaaaaccctgaaactagtagttacttattgttggcatcaagtatgaaacagagtgttcaggaatttgctgagtagaaggatgggtgtggtagtagagctccagacatttgagtgtagaccaaagcagttaacaaagtgaacctgagattttcacatgaggagataaattcaattgtgttagcaataccactttcgtggggtgaaactatggcttatagagaagttatcatgttcaaaggaaatacaaccggtgagagggaagcggaggtatgcttggagttctgtatacccaagaggagggaatcaaagtggaggaactttggctggagatcaaagaggggaggaacagaagtaatgctctaaaggcagaatactacagcctgcttctctgcatggtgacctggaaggtcatagatccagtactgagacttcaaaacctgcctatgggatggaaacttcacttaccaaaatgtagggcatctggaaactttctgatttattgtactaacagtttcatctctcagacaggagaggagagaggccagttgctgttgtgaatctggtttgggagttaccggatgaagtgaaagtgctcactgaggccaggcacggtggctcacacctgtaatcccagcactttgggaggccaaggctggcggatcacttgaggtcaggagttcgagaccagcctggccaacatggtgaaaccttgtctctgctaaaaatacaaaaattagctgggcagagtggcacttgcctgtagtcccagccactcaggtggctgaggcaggagaattgcttgaacctgggaggttgaggttgcagtgagccgagatagtgccactgcactccagcctgggcaacagagactttgtctcaaaaaaaaaaaagaacaaaacaaatccaaaaaacacacaaaaatgctcactgaaaaaaggagcacccatagggggttgagcctataggggtttggaaagcagattttatgaaatttaggatgagatatatttcctgcccaaggctccaaaagtgatgacagctccaacagtaagggaagttatgactttaatcagatatccttactctgcatagatttcatttattttccttcaaggactcctcttaccgtcatgcctccgtggctcatctttcctgtctgacatttttttttttatttttaaggagaggggatattaaaaatacttaactaatggcatagagactgaccaatcaaaacagatgccagactaatcagaagagatgctaaccacacacaactggaacatcagccctagttacgagttccctaacctctccgagtcccagttttctcctctctgaaatgggaacaatatctacattgcagagttggtgcagtgattcccagaaaggttacatgcaaagaacttggcaggtggaaggtatgctggacacagaagctgccatgattacctggcattctttgtttctaggttcatttcatgtatctagtttataggttctgcaatgttagcctttagtttcattaagcatgttttactctatactgacttcagcaagtatttgttctattaccagttggtctctctggttttttggccaaaatgtccccatctccctggtcacgaatactgtggattttctgaaatcttcttgaaattcatgagaaagatctgttaaagatggttatggttcctttagagattttcccagttccttcttctccttctgctttttatgggtgtagcctttggagttaggcagacctgggttcaaatgtcagttccatcccacactggctatgcacttaattggaatctgctctctgcgttgccctctgtcttcctcttctcattcttttgtcccccagggtaggactttttccttcaagttcaattctatgcttttaatcgtccttgtttccttggaattattctctgagcttcagtgaacaaactatatgaaaagtttttaaaaattcccatcccaggctgggcatggcggccacgcctgtaatcccagcactttgtgaggcaaagatggatggaatcactggaaatcaggagttcaagaccagcctggccaacatggtgaaaccctgtctctgctacaaatacaaaaattagctgggaggctgaagcaggagaatcacttgaacccaggaggcagaggttgcagtgagccaagatcatactaacacactccagcctgggcaacagagtgggactctgtatccaaaaaaaattctataccaactacttcctaactggctaagaatatccctggctaaaggggaggagatagcttgttagggatatttgaggtttctgaaatggagagagtggtcttataaggcagcaaattgtgttccccttcctcttatgctggtaatggtgtggagcccaagatgcttcaaatggacaagacagtgatccccagacctggatgaggaagggtgtcagtggcgacagtgccttggtccttttccattcctgaatggaccctatccaattaccaacagcatgctgtctccccacattccagggccagccttgggagggggaagtaggaactagaaaaaaactgtaaaagagccgcaagtgctttagaagatcttcctggtaaaatgcaagaagatatcagaaaatccattgtattagtgatcagggagataaggggacattttggttaacaaaccagatagaccaatttgtaatagaacaagtacttgctaacgtccatatggagtaaaatagggactgccctcctctgcttgagttcctagagtctggatctagtcaccttatcagggtggagtacagttcttcctttgctccctaggatgggttattggaaacattcctatgtgaacctgagatttccttgatgcttatctaccatggatgccacagtgagttgttgctgttgtttggatgatattctgggatttgaagggcctttccactcatacctgataacttcctagatccttggcctcccaaagtgctgggattacaggcataaagtaccatgcccagccaaggattttaatcagtggatacaaaggcaactactggatgatgtagaacagaattgcgtactcagtgtgcatgcagccacttcccacctcttcagccatggcaggctttgctaattgatcacaacacacgttctccctgttatcacacatggcttcgtaatccctctcctcacagtgcaccaagtagccaccaccaacctaagtggtggcacaagagaggaaagtttggtcatgagtgttgtgctgggagagaaaggcagggattagaggccacccccagcctacccgatgtgaagggccatccccaatttaataactgtgtaacccaggagtgtgttcggtagccacaggtggcctcctttggaaaatgatccctccagctgcaaagggagtttttatctccctgtgaagggagggggtggaccacactccctcaagcctggagaaactgtttgtaatttgactcccgtttccccaagcttagctattacataagcttctttagaagacaggctgtttggtttagcaccgtgactgtgactgactaatgcgtttgtagacatcatgttagctttgtgtgtgcccctgtccttggcacccttgttcctgtcccctacggccttctccacactgctgtacttacccaaaagtgtgtgggcttccctgggttcaagttcttgcaggggaagctcagcatggaagaccagtgtgttcatgggtattcctttacctgtttgagctgtggcctcctttgaagttttcttggagctgagcctgagagagcggcttcaccctgacaggcagaaccaatccaaatcatcaatcagcacctgcttaaaatgggccttgcaagttgtgtagcctggtggttaccaaatgctgggtgcagatatgcatgatagagtgcttagtcccaatacgatgccagcccctgcaggccaggattggggctcatgggccttcatggggccattcccgtctaccacccaccatagacctctaaaggccatggagttcctggtagtggggactccagcatcatgccatggctggactttgttgaattatcactgttagacagtttatcctcatgccaggctgatcctagttgttctttttaaaaaattattcatgtatttattttttaaatgatttatttttattttttagagacagggtcttgtcctgtcactcaggctggaatggagtggtgtcatcatagctcactgcagcctcaaacccctgggctcaagtgatcctcccacctcagcctcccaagtagctgggactagaggcacacgccaccacacctggctaattttaatttatttttgtagagacggggtcttgctatgttgcccaggctgtggatcccactcttcatattaccatgcctaagcctcactctgccctccagaggcctggaacaaagccgatccttttttgttgccttttgttaacacctggtctgctcccaatatggcccagccagttcagacagaggtcagtaggtctgttattgttccactgctggacatgatgacatgattcttctcctgggaaagctcaagatgcatgagttgtttcatcactctttgttcttgttaaatgtgtggtttttgaatcctgcctcctctaccttcagcctccccaacacacacaaagtcctgctaaatggggttatagtcaatgggcttcaggggacagtgacaagtcagagatctgaatgaaggagcacagctgggagaattggagttacggagttgacctgtggggatctgagtttcacgactgatttaaaaccaggagatctgtctatgatggcaatgcccaaagtctagaaggttcatcctagcaggagtaggacagtcagtccacaaaaatcccatgggaatgagattaggggagacaacattgatttctaattcaggtatttggagcaccaagggccccagaagtctctttgctcatgagttaaagcatctttatgctggaaaaaaaaaatgacgctattattcaaagaagtgtgttgtgggagggcgggggtgtacatcctttaggagagaaagtaggtcccgagtgagatcccaggagtaggaaagccagcactgtttgttttgttttcttctttccctcatgctcaatggtacaggaaacacaaggagaaaaggacccatcgccttcctccaggctgctgccaatattgtgtagagaagaatagctgaagaacatgaaaacaaatcttcacatttccttttaacagtgtgaactttgaaacactttctgactcatattttaaaatctcttaaatttgaattcaccttccttcatgttgtttttctcgaggcactaggcttgagtccaaaaatgtgtcaaccgactgctcccccagaattaagcagtcacaaagcctgggcccgcttctcccagctgagtgggcagggaaacctggctttgaccttcctacccttcctcaaagctgggcctcacctcaggcctgaagagccaagaaataaccattgtaaggggaagaggaggtatttggtaatatgcctcagcaagaggccattcattttgctacaagcagcagttgcctctggggtccctatttctgcacccctaaaaacatcattgctgtctcttaaggtgcttttggccacaggtggcaacatccaattcaactggctcaaataataaaggggcttttgttggcttggataactgaagtcctgagaccccttacttaaaggaccctgtttccctctggtgaccgccaagcattggtttcatccaaaagccagcttcctgcagggatggtggcaacaaggcttccaggagcaactgtgtgttgtgcttccagttcacagattgtgagaagagagagcttctgattgggccaactcaggacacgtgcctagcctcaaccactcactgtgctgggctcaggccgctgctgacaggctctggcccatcaggacccagcactgagtaataatgtgggaatacacagatcaccaccaaaccagtgcctctgtagttttcccagaggtatatttattcccccaaataacactcttgtaatagtcttctttcttttttgaaggtggagagtgtgaggagttctgtagtacatcctgcctactcccctgccatattttgggcgatgctattattcaaagaagtgtgttgtgggaaggcgggggtgtaccctgccatactttcttgcctttcccttaaagggtcagccctctggagctgagtctctgcttccccagatatgcactgactctgtctctccctttggggtcaacaagaggaatggagttcggactttgtcagacaagaggggctgagttaaggctctaggggaagaggtgaacacacctcagtggcctgttcctgcttccccaagggtcaagtgccttggcctcagacttcctgctggccacagtcaaactattttggttcatccacccagatgttagaaaaattaagtaccctaccctatttccccttgcttctgatttctcttctcatatcacagatacttcctggatgacctcacccgacctggcctccacagatccctgccacagatatcttgccagttctggacactctgttgacttgtgggcccatgtatcccattctctgcaggatgttccgtctggattttccgatgctgggcttgctatgtctccatggagctggttttcctccaaatgaggtcttccttggggatcccctttaagtcttgatgataaccattgctctcccaggtcctggcagtttgtgctgtgttcccatcaccctctggggctttctctggaagtgtggataggtgagcccaggtcttacaaggaggacagtctgcagcctattggagccatggctgccgtgggctgccccagcacccaggccagtgccctgtcttggggccaccccgctgctgtgtttgcagcaccatggcagttctttaattagaccaagcagggatttctcagacgggggtgggaggaggtgtgcgggtctattgggggaaactaggtcacctgaaaaccagtaatcaagagggagctgtcctcgagccccagctccaaggaacccagaggggcaaggtgggaggggctcgcggggagggccaagtcagagaaaatatgcctctggccccttttactggcccttgggagacattgttctcacctttctccagggagctgggcaactgcccttaattcctttgctgggagtagggaggacactgcagtggtgccttctgtctgcctggggcctgccaccctggggcccatggagggagcactgtgctgtgagtcaggccccaggtttagttactgctcagcctctgtatccttggagcaggtcacccactcccatgtgtctgtgccatccatccactgcacagggactgtgtctgcctttaccctgctgcctctctagccctgagcacaggcctggcatgtggtagatgccacctaaatatttgtcaaacaaaataatgagtttatatgagtgcttctcttgtaagattattgccacgaagatcaatggcaagatgggtttcccaaatatcagtcacttataagttttgccaacactaaacgccattgtcattaaatttttctttactatcaacttcctatttccaactgaaatagatttgtttaaaaaggaaattttatatcacaaccataaacaaacagtaactgtgaaaacaaatccacaggaaacaaaacaatgttattacattctatcctagatacagtggcttgcccaggccaggagctgaggcctgctttctctttgttttgaaggaggattggcatagttataaagatgttaagggtctgttagcattggactgacacttttctctggagaaagtctgaaagattaaaagagaagtgaaaagcctatataccctgctctctgtgtgggtccatgttacgtcaaggcttgttcctgtacttttgaaaatttccttggaatggattctccttccacacttagggaagcacttggctgagatgatggctggggaagttctttgaaagggataaagtgctgtaacagcgcaagtgattggtaccattactctttacttttagcatgtttttggtaccttccactcagaggtgatcagtcataataatgaagaaatgagtaactgtgttcaggatcttagggctgaaagacatctcacagaatacttaggccaatctgacacgggtggacattttatcctccagtgagtgacgaggaacttgccacctcctgagacagccattgaccacgagcacctttgtcgaattgcttgttggacagctctagaggccggtgtctgttcttggggtgcacacagctgcttccttgtacttccttgttcctccaaatgaggtcttccttgggggtcccctttaagggttgatgataaccattgctctcccagatcctggcattgggctgtgttcccatcaccctctgggtctcacgaggaggccagtctgcagcccattggaacctggctgccgtgggctgccccagcacccaggccagtgccctgtcttggggccgcctagctgctgtgttcaccctgctgtgtgttggggagactcacaggctctctttcctttcttgttcagagtggagctctggttatttggaaactgctgtctcattctgcctaagacagagcttgcaaactcaaatgacattggagctggcaaatgatgtcagttagtgagggcagtcaggcgggagtaatggggagcattggggactatggtaatggagagcgtatgtgccctatctaaaggggacagcccgactctacaccagttgatggtgatgccgtgtgagcccactgtggccccataccaagatgttctaagaaaagcagaccccccgatgttggatataaaatctccaagttgtaaatgtcagcaatgaattaaaatattttaaaacatggtgtggacttcgaccaaactaaccaacaaacacgatgtggatcacaggaggctttctggtcaggcctggcccacagccacaagtggctcatcactgccaacaagacttctctgctccttttgggctgggcagccacgtcctcttcgggccatgcttgtgcatgttggtttccagagttccctccattgtggtcagccactctgtacacctttgagcgctgcctaactccctctcagctcgtgtctgctcctttcaactggtgaaatcctacttctgcactgagattcaaatctgttgtcctgtattctggaaagccttccttgagaaccccgggcagactggctcttccactatctagcggtggtatgttgggtaaatgacttaatcactctgtgccttagtttcctcatctggaaaatgggcatgatagtacctagtactactattttattaggttactgggataattaaatggatttatgagataaattgacagacagaaggcagaggtggtccgcatccgtctctgaatcagggctcgtcacagagcaggacttcattaaatgtttactcactcgaggaagtggagtgaaataaacttgtgatctgctagctcccagagaggtctgactataataatgatattgtgtggttgtgaattgaactcttttgaactccttacttctaaaaaagcaaccaaaacatctatatctaagtggctaaaatagaaagcagtgacaatcccaaatgctgaaggggaactggatcactcacacattgctggagggtatgaaaccagcacagccattctggagaacagttgggcagttttcttttaaaagtaaacatgtgccaggcgcgggggctcacgcctgtaatctgagcactttgggaggccgaggtgggcagattacctgaggtcagcagtttgagaccagcctggccaacatggtgaaaccccgtctctacaaaaatacaaaaattagccgggcatgatggtgggtgcctgtaatctcagctacttgggaggctgaggtgggagaatcgcttgaacccaggaggcggaggttgcagtgagccgagatcacgccattgcactccagcctgggcgacagagcgagatctcaaaaaaaaaaaaaaaaaagtaaatgtgcaattaccatatgccttatcacttgtactcttgggtatttgctcctgagaaacaaaaacttatgtttacacaatctgtagatgaatggaacagccttaaactggaaacgatgcagatgttcctcaataggtaaatggttaaacaaattggggccatccataaaatggaatactacccagcaacaagaagaaacgcactattgatgcatgcagcaatgtggatgaatctcaaaggaatgatgctgggtgaaaaaagccaatcctcaaaggttacctgctatctgattctatttatataacatcttttgaaatgacaaaattctagagatggggaacagattagtaattgccaaggcagggacaggagtgggttggagggggagcctagagaaggagataggtgtggttatgaactgaggtggtagatacattgatacaattgcataaaacaaaacacatccaaataagtacatgtgaaactagggaaatcggcataagattggtgggttgtatcacgtcaggtttctggctgtgatactgtatagtagttttcaagatgctaccactgggataaactgggtgaagtgtacacagaatctctctgtactatttgttacgctccctgtgaatctacaatgatctaaaataaaaagtttaattagttgaaagtgcattgcaagtgtattcaaaacagaaatcaaaacaaaacaaacaaaaggcaaccaaaaccagctagcttgtctcccattgagccttgccattggcttatttatgctggaggtcacacccactcagaccctggaacttttgccctttgggcattgccaagccaaccccttccccattctgcctgcttactctccagtctccgagctgggagagacatgaagaacgatctggatctgacccaatctgagcacctgaggatttagcctgagccctgctcttcagcttctgtagaaagggcttttggaggggcgggtgacgcaggcgacccaggagattaacaacgcttcctgaaaccaaccaggggctaacccaatactctttgagacagtggaccacatcacacagatgtagactcctgccattctttcctgttacccaacaaccataaaccagccttgcctgctggttcacaaacatgctgcatttacatctccctaccattcctcctccaagcttgtgtctcattgtttagtgtcttaatgtttagggccagctcttttttaaaaaattattttatttttttgtagagataagggtctcgctatgttccccaggctggtctggaactcctggcctcaagctgtcgtcccaccctggactcccaaaatgttgagattgcaggcattgagccagtgcatccagccccagctctttttattccttgcacctgtaacttctgggaggtggataggacactttgcaggtggaggaacaggcttagagaggatcaagtgattgtcctaagaccctttccctctgtgtctgaaagttcatagagtccgtgctgaagaccagctggctttagactttgaaattttgttgacctcatgttatttgaaactcatgagagcaaggatgtaatttttttttaaaggtcatccaaagagagaaactttaactaagattttctatgtcccagtagttcagcagtttttaaacttttttgtcttaggatttctttagttccttaaattgagcatcccaaagagcttttgtttatgtggattatatctgtcaatatttatcataatataaatgaatattgaggaatttttaagaatagcattaattcctttaagataaaaccataaacccatgatatattataacaatataataatctataacatatttttattagactgttataaaagcataacatataatatataacattttgatgaaaaatagctatttttcaaaacaaaaaaaatttagtgagaaaagtgatgtttaaaaattttgcaaaattctttatgttgagcttagcagctggattcttgtatctacttctgcatttagtttgttgcaatgtcacttttcatatagctttgggaaccactgtatactcataagataatgagtagaaaaggttagtaatatcttagtatagttatgaaaatagttttgacctatggacttcttgaaatggtttcaggaattccctatggggttcccagaccacactttgagaagcactgcaatagtgtattgtttcttctggtctctttcttgtcctgtctgtcccatctccagtacaacttgcatcccatagtgatcagaacaaaagaggcttgagcagaagtgtcagatgttcataattctgaggccttggatgtttgtatagtctccagatttttgggggcctgcagcccccatcatgtcctgaccctccctgcaccccttctgattccagcactcagatacccaaatccttaaagtagggtgactctatacaagaaaactaaaatggcatggttcttgttaaatagctgtggctagagaggcagacaaccaagctatccaatagagctttctgcagtgatggatatattctttatctgcattgtccagtatgaagcatgtggcgattgtgcacttgaaatgtggatagtgcaaccaaggaattaaattattttactttattctaattgatttaaatttaaatagccacaggtggctactggctgctgcattaggcagcatagccagaccttgctgatacttacagggccactgtaaggatttgcacttctcttgaggagcaatggaaggaaaacctcaaaagcgtttcgaacacggggcgttgggggacgatcagatctgagttgtggagtctgacacatgtgttcatctgtgtctccctccctgccacaggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcggctgcgggctgcccagaagcgccgggcccagcagctgaagaaatgggcacagtacgagcaggacttgcagcaccgcaagcgaaagcatgagcggaagcgcagcacgggcggccgccgcaagaaagtgtccttcgaggccagcgtggccctgctggaggcctcgctgaggaacgacgccgaggaaggtaggcccctctgtgccttggcggccacgcagctgccttggcctctgatcagggtttggaatccaggttctgtgcagtagacgtgtgggcaaggcaggtctgcagacccacttccaagttccagcagccccattcctcttaggaagtggacgttcctaggaacttcgaatttatcttagacttcttttttttctaagacagggtctcgctctgtctcccaggctggagtatagtggcgcgatctcagctcgctgcaacctctgccacccaggctcaagtgatccttccacctcagcttccctagtagctgggatcacaggtgtactgccaccatacccagctaattaaaacaaaaaaaatttgtagagatgggggtctcattctgttgccctggctggtctcgaattcctgagctcaagtgatctgcccgccattggtctcccaaaatgctgggattacaggcaagagccgcagcgccaggcctagactttttgtttaaacatcttcgttcatttgtttttatttatttatttatttagacatagggtcttactgtgttgcccaggctggtctcaaactcccagcttaaagggatcctcgtgcctcagcctcccaagtagctagtattataggcaggccaccttgcccagctgtatttttttgggaacaaggattccagcctttggctgaggaataccataataactttctttccctcccacaaatatttacagacaaccacaaatacttacagacaccttcttttgcattactttcctagatatagtggtgaacaagttggatctggtttctccccaccaaaagctcaatactcacaggatcttgcaattcataaagctctcctctgtgccagaccccatgcctggcaccctctgaatgctgttccgtgtattccgtgtatgtagcctttgctgcagtcataaatggtgtagagggatggactctgaagtgagactacctgaatctaaaactggctttctcagttccctacgtgagcttgacaagtagacaagtctcttccactctctatacttcgtttacacctctgtaaaatggggctaataagaaaatccactttaagggcttgctgtgaacattaagttagaaaatccctgtgaagttcctaaatatggtcccttatgctgaggaagtgattattactgttttattttattatattagtatattttatttacattatcaaaggatgtccataaagtctgaaaacagatatagacaatgctatctaggatattttcactctgtaaagtgaatgagtaaataaatataaacaaacatgtatacacattcatacaatctatgtttccagatttttttcttttttttttttctttttttttttgagacagagtctcactctgttgcccaggctgggcagagtgcagcggtgtaatctcggctcactgcaacctctgcctcccaggttccagcaattcttctgccttagcctcccgagtagctgggattacaggcgttcacctccatgccctggctatttttttaaatttttagtagggatgggatttcgccatgttggccaacctggtcttgaactcttgacctcaggtgatccacctgccttggcctcccaaaatgctgggattacaggcatgagtcactgtgcctggcctatgtttccagattttatggataccttgtacttgccatgtttaatttaattatattatttttgtgtctcatgagctagatatcatgatctgtactatgtatagtgctttaagagccatgtatgataacacccattttacagatgggggaattgaaactcagagaggttcagaaccttgaccaaggtggcagagcgggatcagaaccactggcatccgactcttgtcactgccctcatggccttataggtttgcttcctgttgtaggaatgaatggagaatccatgatgtaaccacagcccccttccctgggcttgttcagaggcggtctcgcctgctcattgtgagccaaggtctgtgcacctccctgttccccttggcgcccatggcccatccctgtataataagccttcctggctgtccctggagaggcctagccatgcttcctgggtccctgcacacaccttccagtcaatgaaagagcagagaggtgtggcacttctggcccaagagggtgctgggttttagtcaccttgctcttcaggttctagaaccctctgagaagtgtaattccacttccacctggctgcacagggctctaggaaacgagccaagaggcatccctggaaccactctgctgggagctgctccgctgaaagcctggggtgagcagcctgggtgaaaagagaggtggaatcttgggcttggggacatggccccgaggctccttcccacgtgcagtttgccaagtgatgcggcagccccatccccacgcagtgggtggcttgtcatgatgtctaatttttgttgggggcggaagttcatcagctcttctctcacccctcgttattgactgccttcttccctgacaaagccccattgcccctccctgaggggctctgtgcatgggctgcgggcttcagaccatcctcccagccccctgcccagcccctaccccttgctgatgtcttgtttcctggttagaaggagcactgggctgggagtggagggatcagtgccccgcagccctgcctgtgactttgagcagcttgtttcacctctatgggtccagtttttttgttttgctttgttttgtttttgagacgaagtctcgctctgtcgcccaggctggagtgcagtggcacaatcttggctcacggcaaactctgcctcccgggttcaagcgattctcctgcctcagcctctcaagtagctgagactacaggcatgcaccaccatacccagctaatttttgtatttttagtagagttggggtttcaccatgttggccaggctggtctcaaactcctgacctcaaagtgatccgcccaccttggcctccaaaagtgctgggattacaggtgtgagccaccgcgttcagttttttaatctgtaaaatcaggttttgaaagcttgccctcaagagggtatggcaagacttagacaaggtcctggatgtgacagttctttgaaaggttaccctgagacctgtaccagcacggtgataacgcactttattttgttttgttttttacagactttaatgtttttcagaacctaaatatgcacagatacattcttcttgtaaaaatcaatcaacgtagaagtgtacaaagtaaaaagtcctttctgtccctcccttcctccctctctccttcctcccctcctttgcttctttttgtccatccatcactactgttgttagtttgatgtttcttttccaggtatttttttcatttgcatatgcacttgtggacttaagagaaatatagagccaggtttcttttttaaaaagtttttacataagtgatggtatcctggatacattattctgcaattttctttttttttttcccatccaacggtatatcttggagacgttttcatgccagaacatgtacagtacagatctgtgccattatttttatctgctgtgtagtattccatagtatggattaccagaattttctaactagctccttattgatgcagatttttccagtagcttcgcttttgccacagtgaatgttttatttccatgtgcaaatgtttatcgaggacagatgtgatgaaatgaaagagatggatctgaaggtattaaatttgaatgagaaaagtgctagaccccatgggctggtccccctgtctctatggggcagccaagtgaggggaaggggccagaatactgtgctctgtggcaggctcgtgggttggttttagggtccacagttgcctgggtttggatgaggggtgtgaggctgccatcagtcagcccttgacctcactgggctatgctcagcttcctggcagcactacagagcctgctgctttcagcaggctgggaacggctgcttcttgctggtggagctggtgtttgggaggctgccggggtgttagctcacagtggcgtgggagcgtggggtggcagctcccccactcccctgagctcacagcagcctctgagtcaacctcccccacctgcctggggaatgtgagttgtttccagagaaaggcaggctaggaactcactgagtttcatcctctggtcccatattgcctttagactagtgtccttgcccttggacctgcctgagccccatgctcactgctctcactgccatcaccctctgccccaggcgacgccagctccaccaagatcctcccatattccctgcgttatcttacctccacacctttgtatatgcaattccctctgtctgggacactcttcctgtgactaactcctgtaaccctcagctttgagtccagcgtgatctctggggagccatctgtgagccttttcccggccctggttaaagtagcaactcaatacgtagctgatgtttactgagagacagtgtagtgtcatggctaggagcacagaccctgcagtttgtcctccaggattcaaatcctagctctaccgtttactagctgtgcatccttgggaaagttactttacttctcagtgcctccatctccccatcggtaaaaatgaggatgatgatgtacccgcttcataacgttgttggggggttaaattaagttgataaatgttgaagtggtatggtcagagctacgtaagtggtataaattgttgttattctacactattctacatttacgtaatctattattacagcatattctgattgtcatcattgttattatttatcaggtgctttgtaccaggcagcttgccttacatatgttatctcggttaatcttcacagcaactctctgaggttagagagtcaaaccccatttttaaaaaatagcttggggttcagtttacatattataaaatttgcccactttaagtgtactattcaatgattttcagtaaatttacagaattgtgcatccatcagccacaatccagttgtaaaacattgccatcgctgagtggtgtggctaacacttgttatcccagcactttgggaggccaaggtagaggatcgcttaagcccaggagttctagaccagcctggagagcctgtctgtactgaaaaaaaaaaaaaaaaaaaaaaaaaaaagccagccgtggtggcacttgcctgtggtcccagctacttggaaggcttaggcaggaggatcgcttgaatccgggaggttaaatctgcagtgagccatgattgaaccactgcactctagcctgggtgacagagcaagaccccatctcaaaaacaaacagaaagccttttcatcatcccaaaaagaagcctcatgcccatttgcagtgactcctggttcccagacccaggcaactataatctactttctgtctgtatagatttgccttttctggacatattatttacatggaatcatacagtatatgatctttgtgattggcttctttcattcagaatactgctttcaaggttcatccttggtgtgacatcatatatcagggcttcattccttttcattgccctgtagtattccattgtatagatattccgcattttgtttatccattcaccagtaggtgaacgtttggattatttctattttggggtaggatgaagaatgctggaaggcaaatttgggtacaagtctttgtgtggatatatgttttcatttctcttgggtcattacctaggaatagaattgttgggtcatatggtaaattatgtttaactttttaagaaactgctgtactgtcttggaaaatggcttcactgtgtgaattctcatcccccattttacagatgagaaatttgaagctcagagagactaagtcacctgccaaggtctcacaggttttaagtgtcagactcaatcccaggattcaaacccagatcagtttctccgaagcccatgtatttaaccaccaggcagtcctgtacttcctgcttttgttttcactagaaaactagagaaccctcagttgctgtactgatctgtgtttgttttggccttaggcatcctggtgtttctgctggcatcttgggccctttgatttggggcccccaagataaactctttagccccagatataacttctttctagggccacaatagcccagcctcccttgaaaccattgaatgtatgttaagttgttagagacttctgtttttctctcagaatgtgtagggttttctttatggaaattctcattcaaaaaatgtttgagtgattcttctgtactctaaatttaactcttattaaatttaatgatttttctcactgtaaaagttttcaaactcttttttaagcagtggaaacttttctttaaatgagatattatgcagaaacccaatatgtaaaacaaaggaaggagctgttctgactggggtcaggtgggtggggtgctcagtcatccctgccacctgcaaccccctcccccacccccaggcacagtgctggacacctgggccttgccaccaccatcttaaaccagcagctcatctacaggaactagctcagactttcacttttggtccttttaaaaagggaagtttcttttcttctaattattaaaaaaaaaaaaaccctgttattgttacagaaacttttagaagtacagaaaaaaagaagcattaagaagaagataaaatcacccatattccccctgaacagcaacaaccattgataatattttggtattgttgtgtcaggcagcgtcctgggaggaaacaaatggtgattttatatggggtgatttgtggaaagtttgataaaggggcagtttgtaaagggtttagggaagtggtcctcaaactttttggtctcagaggccctttatattcttaaaacctgagaactcctaaaagctttggtttagctgggttctatctacccatatttactgtattcgaaatttaaacggaggcattaaatatttattcattcattaagtcagaatgataaacacattatctgttggctatctgcttctgcgtagcagatgaactcaaaatttagcagcttaaaacaataaacatatactgcctcacacaatttctgtggctcagggatccagagcagctcagctgggtggttctcgttcaggatatctcataaggttgcagtcacttcaggatttacctggggctggagaatccacttccaagatggctcactggcatggctcttggcaggaggcctcagttccctgccatgtggccctctctataggacagctcgagtgttctctcagcatggcaggtggcttttttcagagtgagtgatccaagagatagaggaatccgcaatgcctttatgaccttgtgttggaaatcatgtaccatcacttctaccatcttctattcatgagaaatgactcactaggtccagcccacactcaaggggtggggaattaagcttcatcttttgaagagagaatttgtggacatgttttaaaaccaccacatgttaacataaatatttttatgaaaaattatatttttcaaaacaaaaaaaaaagcaatgaggagagtagccttgttttatatttttgcaaatctttttaagatctggcttaatggaagacagttggagtatcttatctgcttctgccttcaatctgttgtgatatgttattttggttgaagtaaataaagaaaatcttatgtagttggaaaagggaggaaatattttaattgctttttcagatattgtggatattctttgatactacatctaaactcaacaagtagtagtttcttaaaggttagttgcagtgctgaatctgaagccatatcaatttacatcaaaatccattggtctgtctggcattttgaatggttcttttacccatgtgtacttttttttaatgtaatatattggatctgttagaaaatattggttcactgagttacacagatcttccaaatgttgacacattgctttatacaatataagaaaatgtatagtttcaataacaatcttgccatacaattattcaggtactgggaaactgtaagttcgtggtagctataaaagttttctaaaatttggatttttgcttaaaagttcaaattctatcattggtaacaaatgctgtcagttgtgagaagatccatttgccctttttaggaaaaaaaacactgcctgttaaatactcaagtctgaataaccattgtttgctagacatcctttaagtaaaactagtgctccatgagagaagagactagcttagcacacagcttaaaaaatggctcaagtaatgcagttggagacaatgattattctttttttgaacttcccattttgtcacatggaatattaaaaggacatgtactcaaggattaaggtttcataaaattaatacattttattgctttatcaaggacatttttaagggaaactggtattgatttttttcttttgattgcacatacaaaacaatgaagatggtgattgctagtacagcttggtgccactaagttaattctgttaaaacaacagtagttttacccaccattgcttttacaccatcagtgcaaatgtcaacacagtggaaaatgcaagtaatttcttagtgttactgtgaaaattattttgatgttttaataccctgaaagagtctagagaccactttgagaaccactggtttatgggggtcaacaaggaatgggacaataccctgggatagcaaaagttgggagatcttacccaccccaccccaccccctgggcctgaaggagacaaggaaatgaacctactggaacctaaggaaggcaccgtatggagagggctacctaaaggagcagtggctgccactccatgcccctgccattctggtgctttcggtgacaaacctaaccagaaagcagaatgcaaggaagcctttgatgtagtgcaagtcaactggcttcctcaggcacggagaggggaagatctagagggacagatggggcagagagtgagcccagctgtcttcagcccttcggatctacacacaaacaaggagtgagtttgtgtacatttaaaaaacaacttttagggccaaatgtggtggctcatgcctgtaatcctagagcattgggaggctgaggtgggaggatggcttgagctcaggagttcaagactgcaatgagctgtgatggtgccactatactccagcctaagtgacagaggaagactctgtccctaaaaaataaataaacaaataaataaaaatgtaaaagtaaaaacaactttaaccctaacattcacttgtgaattcagcaaaattagtcatctgctagagctgtggtatcagggagagcctgtctgaggaggtgatttgggctcagacctgaatgtggaggagtctggaggaaatgtacaaaggatgtgtgatgggaacagggttggcgtgtttgaagacaggagaaagatgggaggtggaagagtagggggaggaggtggttgagggagagcatactgaccgtagaagactagagtaggaactgtacatttgatttcgatgaaaagccactggtggttttgaaaggggaatcatgtgatgagatacagattttgaattcgggatggattttcctggttgctgagtgcagaattgactgtagcaatctattttcgcagggctgtgaggggagcagggaggctcatgagaagccctcacagtagcgtaggtgagagcctatggtggtcactgggcgatgcagaaatcaggaggtggagcccacagggcttctgtgtcaagtgacagaggagggactcagtgatggcttttgggtttttggcttgaacatctaggtggatgacagtgccacattttgagactgggaagatcggagtaggagggaggaggggatttggagagaattgagttctataggactgtccaagttgacatgtccttttaacatccacatggagatcttgaagaggcagatgaatatgtgagtctggagctcaggggagatatcagggatggttataatacttgggaagtcatcagcatgatacaagtgcagtattttcaaaaatgcaggactgtaggaggtcatctaggaagcaagggtagttggagcagagaagggatcgcagagaagggatcactagagaaagctctgggacacctcaatagctgcatgttgacccaagaagaagagaacaaaggagaccagaatcatctactcagaaggtagaaagaaaaccaggaatagtgtggcatctcagaagcctggaagaaaggactgtcagctcagtcaaatgctgttgaggggttgaatattttgtcttatctttatatactctttggaaaaagagatttctaatgatgacctcatatatcctatcatggatgttccataatttatgcagctactcccttattattgcattttgaggccattcccaatttttgctactataaattatgccgtggtgaatatcaatgtataaaagtatttggttggccgggcgctgtggctcatgcctgtaaatcctagcactttgagaggccaaggcgggaagatcacttgagcccaggagtccaagaccagcctaggcaacatagtgagaccccatatctacacgaaatttaaaaaattatccaggtgtggtgacgtgtacctgtggtcttagcaacttgcggggtggaggtgggaggaacttttgagcccaggaggtcaaggttgtaagctgtgattgtgccactgcactccagcccaggtaacagagtgagaccctgtctccaaaaaactaaataaataaaataaaaataaaaagtatttggccatagctttgattatttactaggtagattcctagatgttcattggctttgaggtctcgatataaaccactcatttgactaccagagaggttgtatcagctgtgtgtatccatccctgctatctccccacctcatcactacctgccacatcaatgctggatgatgacattgaaaacacacctttgctgatatatttgatatatggaaaatagtcctgttgtcttaatttgcataaaatcgagacagttaaggttgaatacctattcataagcttactggtcatctctctccttctttgagttgtctagtttgtttttttgttgttgttgttttgagacggagtctcactctgtccccaggctggagtgcagtggcacaatcttggctcactgcaacctccgcctcctggattcaagcaattctcctgtctcagcctcccgagtagctaagattacaggtacccaccaccacacccgggtaatttttgtatttttagtagagatggggtttcaccatgttggccaggctggtctcaaactcctgacctcaggtgatctgcctgcctcagcctcccaaagtgctgggattacatgcatgagccactgcacccggactatttgttcattttttttactagtgtgcttcttattggtttcaatgattgtgtacgtttatgtttgtgtgtgtgagaggagacagggagaaggtgagaaagggggagaatgacattggagggagagatgccaactctttgttgtcatgtatggttcatatattttctgcagtgcgtgtatgtgtttgctttaatgttttgtttatagtaattttttatgctttggagttcttattttttatattgtcaaacctaatgatacttgatttctttttttaaaatcattttattttttttatccctttaaagcagggaccagaaaactgtggcctgaagtccaaatcttcccactgtctgtttttgtaaataaagttttattggaacacagccatgcccattcatttacatattatctatggctgctttcacattacaatggcagagttgagttgtaacagcgaccatgtagcctgcaaaggttaaaatatttactttctggccctttatagaaatactttatgggctcttgcactaaaatgtttcctcatctagtgatgtatattaaacctatgttttcttctagggttttttggccttatttaaataaataggtagtatttctggacttcattttagtatagagtactaaatgaaaatctgtctatattttgtttccaaagcatcagcaattgtcccaacatcccttccttccctacaagtttgtgaggccacccttgtactctagagcctcatctgtaatgaagggtaactctccaacctgtctattctgttccagcaacctattttggtgccagttacatactgctttcatccttgtaggtttatattgtggcttaatatgtgataaaacaagtttttcctcagattactcttttttttcaaaatgttcctggttattttcagctgttcacataatatttaggactgtttggtcaagttttccctccaaacctcaaaaatagatttctccaaagctttgcagggacatggatggagctggaggccattgtccttagcaaactaacacaaggacagaaaaccaaatacagcatgttctcacttacaagtgggagctaaatgctgaaaacacatggacacatagaggggaacaacacacactgggtccctattggagggtggattgtgggaggagggaggagatcaggaaaaataactaatgggtactaggcttaatacctgggggatgaaataatctgtacagcaaactcccatgacacaagttgacctatgtaacacacctgcacttgtacccctgaacttaaaagtttttaaaaaattaaaataattaattaatttggaccaaagtgatatgtttatcatactgagtttttctaagcgggcaaatagcacatgtctctgttaagcatgtattctttcttgtcttttaggaaagctgtagggttttttgtttgtttgtttgtttttgttgttgttactgttttcgtataagtcctgtttaatgtcttaaaaggagggctttgggttttgtacattaatgttataccaagcgaatttactgaattcaccttagtcttggtttttcagtgagttatcttgggggtttctatttagaaaagaacattatttgcagatgataaggttgtctgatcattccagtgtttcagtaagcctggagatctgagtcctatccagattctatcctctctccccttctctccaggctaactacttccgttccttttcatattcttttatgacatgtggctttgagatttgtgaccatgctctactctgtctacgttcttcccaaagtctgatctggctcactctggagtgaatggaactgtcactttcctcgttctggttgcttttgcctgttagtatgacttaagtttccattagctttttgggtagctgctgttgactcatattgaatttataagaaaacaaaacccccaagtcagcttcccattaatgaagctacattttccccatcctgatttaaaaacaacaacaacaacaacaacaaaaaaaaaacaaaaaactgtttgttgaagcataatcatcagacagaaaagggtaaaactagttgtattttcatgtgctgagcatacccatgtaactaatcagcactcagatcatgaaacagaacattaccagcaccccaaaagtcttcctggacacacggttgatttttaacattgaggtcaagcgctgcatttatcttgttgagttttgagcccaattatctacctgttcagctagttttggattcttgaatgatacgttaggacttttgtgtcaccagtgacaaaaactcaagctaacaaggttaacaaaacagtgttcacgtagtggagagttcaaagatagcacagcttcaggcacttgtggatgcatgagactaccaagaaatgtctctgagaagacgactatcagcagcttgaaatatatatcctaaatccttttggcaacctcagtaagaataatttattttcccagaagtgtcccaggctcaacaagtcccagaatggaacctcattggctatgaggtcgattcctgagtcaattgtaatggctagataagggaagcaatgctatgattggtctggttggagccatatgcccactcctggagtctgcttctcccaaacacatggactgacacttggtattatgttgtacctacccactcccccaaaaatattgggatgatatttccagaaggagggagaatggatgcttgtcaggccataattaaatatattcacctcaaatgaaatattcaccggcagtttctactccatatcattcataattgcaataaggatttgccttctagaccagaattgtgcaatagaatttttttctgatgatggaaatgtgctgtccaatacaatagctgctaaattttttattgtatttagttagaaataatgtagtcaactgtggctaagctagaggctgctgacttagaaacacagtcataggccattatccaaatccctgataaaaatgttgaatagggcccagcgtggtgctcacgcctgttaatcgcagcactttgggaggccgaggtgggcagatcacctgaggtcaggagttcgagaccagcctggccaacatggtgaaaccctgtctctactaaaaaatacaaaaaataaccaggtgtggtggtgggcacctgtagtcccaggtactcgggaggctgaggcaaaagaattgcttgaacacgggaggtggaggttgcagtgagccgagatcatgccactgcactccagcctgggcaatagaacaagactccatctcaaaaaaaaaaaaaaaattgttgaataggtcatgggcagagatgctgcctggggccacacccccggagaccttttccagattaatgtatcaaagtcaactactgggaatagttgtgcaactgaaatgaacttaactacattgttatttgcagttggtatgtgggaacagtagcaggagtctcgacaattaaaaaacaattaaaaaaaaaaaaagctggctgggcatagtggctcacgcctgtaatcccagcactttgggaggccaaggtgggtggatcaccagaggtcaggagttcgagaccagcctggccaacatggtgaaacctagtctctactaaaaatacaaaaattagctgggcatggtggtgcatgcctgtaatcccagctactcaggaggctgaggcaggagaattgcttgaatacaggaggtggaggttgcagtgagttgagattgcaccattgcactccagcctgggtgacagagtgagactccatcttaaaaaaaaaaaaaccatctttcctacaaaacttagaagacgatttctctctgagggttaaattacaacaaaatgtgatggatcagagtagcaattcatgcacagacatttatggaacatagtctggacatcatcaggctggcattggttgttcagtggtgaacaaaacaaaatgggccagaccaccttggagctcagagtctagcaaagtcattgtgaagagagcatagtattaacatgcttaacaatggatggtgttattataaagaaggccttgctgggcatggtggctcatacctgtaatcccagcactttgggaggccaagacaggaggatcacttgagaccaagagtttgaaaccagtctgggcaacatattgagactgtatctctaccaaaaacaaaaacaaaaacaaaaacaaaagccaggcatggtggtgtgggcctgtagtcctagctgcttgggaggctgaggccggagaattgcttaagcccatgtgggcaaggctgcagtaagtcacaattgtgccactgcactccagcctgggtgacagagcaaggccctgtatctcgcggggacggcggggggggaaggccttgtcaagaacagatgccagaaaaagggggctaggagatcatttatgaacaattctatttaaatatcgttcaagggagaggacactgtgagcaacaactttggtgattaccatcccattgctaaggacaatctgattatggaaaaaggggacttcaacccatcttggtgatcttggcgtaatcattaaacatgatgattatgtacaaccttctgattataatttggcgtcccagccaggtctgcctacaagcacagaatgagttgaccgtgcttaactgaatttcagacatgcaaggcaattattctcctgtgatcctggcattgtgtttttatgcagcagcctcataaacttggatagtatgagactgctcttgggagaagaaactgctgttggtaggctggtcaaccatggtcgatcaccaaggtgataccatcctagggatcttggggatatttaaccaattggaactcccttggaacctcccccaaatcaaaccacaatgacactcaaccagcatttccccagggtgctaataaggaggtgtatgagaggcttgtcaggtgctcaatggagtctagacattttctatctttgacatttctcagtgtagtgaacccattgagaagatagatgaggcattgctagcatgattgattcttgcttggcttctagggaccactgtttcctttttttttttttttttttttgcggggggtgggggtagcatggggggataaagtcttgctctgttgcccaggctggagtgcagtggcatgatctcggctcactgcaacctccgcctcccaggttcaagtgattttcctgtctccgtctcctgagtagctgggattacaggtgccaaccaccacgcccagctaatttttgtagttttagtagagacggtttcaccatgttggccaggctggtctcaaactcctgacctcaggtgatccattcccctcggtctcccaaagtgctggaattacaggcatgacccattgcgcccggccccactgtttcctttctaatcgagtgagaaaatggtcagtatttctgtcaacaaaattcatgaggctctttgtacgcacagacttcaggcctttctctcaacaatcgccaaagctggagcatcacatggaggaacactggggtttgaaaaacaggaatgttccagaatcttctcagagtattacattttccaacatgtccatcccatatttgtaccaacaaacagagctggtcccactgccctcatcctttgtctaccatgttaggctgaggaagttgcatgcagagcagaggtgaagactaagagaagaagatacaagaaacctgctgagtaggggagagggaaatggtacctctgccagttatgctggaaaagctaaatgaaacccaaatcttgatggaggtgttagggttttcagtctttcaagagaagctcaggacacaggctttttggcttaaggaccccaaatttcctgggcaccacaaaagtagtaacggcagtcctccaggtgaatcagtgtcaagagctagactgtaatcacttgccttttgttgcattacaagccactcttgaaacacttagtggattgaaacaacaacttcttatttctcaatgattctttggcttgactgggcactctttctgctggtcttccctgggcagttcttctgctggttctgcctgggctcactcatgaggctacaggtagctgctgggtcagccagtgtctggggctcagctgggatgacctggcctctctctgcctgtggtcctttatccagcatgatggtctcagggttccaagcaagtaagccccaatgcacaagtatttatccagcctttgcctgcatcgcgcttgctcatgtctcattggctaaaacggatcacgtggccaagctcagagtcagtgtgggaagagtctatacaagcgcttgggtactgaaaggcatgattcattgggggccattgttataatctaccacacattctagactttgctttgctttagatccgaattctagcaactcgatgtgataaccctgggcacatcatgttgctcgaacactgtaattggctattgatgtccctggaatgtctgagatgtatggggtggaccaaacactgcctctctctgggaaccccggactttgggttgagaatgcctagtgtttaggtggcattgactctaaaaccatgtggcattcagaattcagcactgggcaatggcgcatatgctgatttaattttattagcctattagctgcatagacacaacagtgatttatgtgattttataatattatgttgaaccttcaataattgggattaaagtctggattgatgttgtaacagaaacaggagtagaaaaataatcatcagccagatggaagaaattattagttcacaaatgcagtgtgctcagtaataaaatctttcaaaatgtggatgacataggtgcaatagaatataaagaggccttcagtggaaagcttgggaagctctgcagagatgcagtggaccttgaaggttaagaatatggagtcagacaaaactaaattttaatctctattttgtgaccttgggcaagtaacttaacctcttttggactcagattcctcatctgtaaagtggagagaatgatgcagggaagggaggggagtgggtcaccgtgcagattcatggaaataaaggatagacagtggacacggtcagtttggctgttactatcatctgccagtagcctcagttacaataagccagaggcaagattaacatctcttcctttttctttctaattcttctgctccccacattgccataactactcccattttctctatctctgtttactcaatggcggccttctatcagtcagtcacataaaagtattcttattgcagtcatttacactttagtatgaatgagtcagcacttttttgcagcaattttcattggaagccagtgggaagtgaaaggctttggccacccctcataatatatgacttaaagcctgcttgcaatagagagcccttgcagagtctctaaaagaaaaggacctgccccctgaagaacttctgagaccatagacctcatggtgcccagcttttcctggttgccatgtgtcatctctaaagacagccatgaatatctgttttggttgacttgagccatttgaatgtctaaaacccatcttaataacaaaagctctttggagggaccctaattaacttctttaaattgctttctctaaacttttggaattaatacaatctgttcccttgttattaaaaaaaaaaaacaaaaccctaggatacttcgcaaaacttcccccaagttacttggcagctaacattttgtcaaggaggcatggtggccaaccttcccctgaatgggattggtttctatatagtcattccttccggctcatgactttcttctccatttgctgcccacggacgccgaaaataacttgttttctggcaagcttgggatgagattccttatgatttaatcagatccataatgaagctctcccagctttcaggagaaaacatcctgaactgcagggctggttaagggcagggccctggtgaagaggaggagccccctgcctgagcagcacatttggagccaggagagctgcaacagggccatgccacccacccagtggggtgcccccattgtggctgagactcctggcagtgctccaaggtgtgtaccatgtaagctgtgccttcccactccctgcagcccagactaaaggcctcaaagataataggcaggacatcgcatctgtaaataccagctgcttggtccaggaagagacagtttcctacatatatatatatatatatatatatatatatatatatagagagagagagagagagagagagagagagagagagagaaggaggaggagagagaccaggacagacttgccctggctgaaaccaggattcccttgatggttccaaactgatgttaaattagaggataactccagatatgataacaagctgggggtggcaaagtaggtgggtaatcagggagcatctgagtaggtgacagagaattggataatgaagaagcaggtaaggtgatgggaagtagctggggcaagagggagtagccaggcaataaggcaaagtagctggagaatgggagagtaacttgatgatgaaggccaggcacaaagtgggagttactgcagtggggcaacagaagacagccccagacctggggtagaggctaccctgacctgttccagttgccttcattttgccacttccttaggtcttgctgctgagaagtaaactcagcctaagtctgtaccagttagctggaatctgggctgttgtaaactgttgtggtgaagctccctgggagtgaggctgaggttgtagcagtagcaggtaggtgtggtgagtttatttccttgagggaggggctctctcttctctcagcccctcaaaggatgggtgaggttgcctgccagaggtcctggcacaactcacatctgagcccccaatttccccatcatcaccttcatccttctctcaaccagatttttattggataacttaagcaccaggcattgtgctaaaaatctttctatgcatcaactcattgcatcctctcaacaactctataaaataggaaccgttagtaaccccatcttacaggtggataaactgaggcttaaaaagtctaacaacttgcccacataagaggcgtagccaggactgtctgacttcagaatctgtcctctaagccttatgccacagtcatggttacttctacatggagcatttctccttcaaaagctcacccctacccattcactatttaacagcacttaacaaggtctggtttgggagtgaaagctcaggtagggtgtcctggttgggtaaggagcctcagaaacaattcaaatgctcatggtccccacctacggtgggcacagccacctggctgcccttttccaaacccattgcccgtgaggtctgttggataaagtcacagtttagaatcagtcttccccagggtgcacccaccactggcaatcagacctcatttgcactgagacatttatagtccacagtgaatttccattatctatatagaatgagacaaagaaacagaaggctcctggctttaggaagtttcttcttctctcttctgtctgacagccatcctttccagcatgtcttgggacagatgccatgtcaaggatcatctagatacttggaaaatattgtataattccaggctttataattttttaattaaaaaaattatgtttggatcctgaagagcctaactgtattccttatttaatgaaagcaatgcaatcgcattgtcactggtgacatggtccctcatttaataagctgctggctccaagataagccatccattccaggaggttcttgattggtaaaattgttttgcactaaaaggagcttaaggttaagcactaattaatggaagggggttggattttatatagatagatcggtaggtaggtttggggacatgtcaaatacaccatctttgtctctgcagctgaaaatatatatttaaagcccacacaactccgtagatttcttaaagctccatttttggcaagtatattccagtcttggtgtgctctggttaataagcagcttctgactcagggcactcagtgactgatggttgcattgacccaagtatctctcaggacgcaactgatgtggtcaaaatcccccaggtggtttgagcccaccagtctttctcggtggacatggcttgagaacttcagttgggcactaggacactatcttatctgaggcggccagaaaaaaaattatagactgggtggcgtaaacgatagaaacgtatttccttacagttctggaagccagaaatccaagatcaaggtgccagaatggctggtttctcgtgagggctctcttcctggctttccacctcctcactgtttcctcacctggtggtggtttgggggaaaggagactctctggtgtctcttttaaggacactaatcccatcatgggggccccatcatcatgacctcatctaaaactatctcccaaaagtcccatctccaaattccatcgcactggggatagggcttcgatgtatgaatttgcggggaacacagtgtagtctatagcaggcactttctgtggctgggcaagacagctgtcttctctgatgtccctggggttctctgtggtgctggagaaactgatgggggaattctctggaatttgtgtcctgggtggacacaaaggcctcaaaagctcgaagcccattcccgtggcctggctgcattgaaggaaactttactgctgattggaagagctatggggtcttcagaccctgccagaacacagggcatatcattttgtaggggagagccctagtcttggaaaacttcctggtggaaagcaaaggaaaggaggcagaggaaaggaccaaacctgatttattgggtaaatattaataaatgaatgtacctagtggctgccatgctcttctggcaatgagattggaggaaggggatatgattcagacccataaaactctggagagggcagtgggcttgtttaccaaatccctgatgctacccagagaggtgcccaggaacttgaagcaagtagggatgtagaaggaacctgtattattagggaggtgtcctggttctctattgtcacatagaaaagctattctaaaatttagctgcttaaattatctcacatgggtcaggggttcagatggagcccagaggggaaaatttgtctctgctccacaacgtccagagcctgagctaggatgactgaaacagtcatcctgtagtcccagggcctccccatgtagcctctctacgatggtggccttggcagagtcagacttcttggatgatgtctcagagctccaagagcaaatgtcccaggatccaggaagccgccagtttcttgagaccttggaacagctaccaagccgaccccgacttcagtggaagggaccaagaccccaccttctgatggcaggagtttgatggtctccactggggctgtctttaaactgccatgggaggctacctgctgcggcattttgaagtttatctcttgctcatgtgacagcccagcacgggtattcatgcttacttcagcctgtgggtggggaacggggagtgactgctagtgcgggttccttttttttttggcggggtgggggagggtgtgtgaaatgttctgaaatcgattgtggtggtggttgcaactctgtgcaaccatcaaagagggcagctctcttcaacacaatgaccccatgcctaggcttcttccatcctatggctctgcccgctagatcagagctgtccaatagaaaaagaattcaagccacatatgtaactgtatttatttatttagagccaggttcttgctctgttgcccagactggggtgcagtggcaaaatcatggctcattgcagcctcagactcctggcctcaagctgtcttcccacctcaacctcccaagtagctaggactacaggcacatgccaccacacctggctgatttttaaattttttgtagagacagggtcttgatatgttgcccaggctggtttgaactcctggcctcaagcagtcctaccacctcagcctcccaaggtgttggggttataggcatgagccactgtgcctggctagtaattcttaaatgcactagtagctacatttttaaaaggtaaaaaaataaacagttgaaattaattttaataatatattttatttaatccaatatatccaaaatgtcatttcagcatgcaatcaatataaaacttattaatgagagattttacattctgtttttttcatatcttttacatttatttatttatttatttggagatggagtttcacccttgtcacccaggctggagtgcaatgatgcaatctaggctcactgcaacctccaccttccgagttcaagtgactctcctgcctcagtctcccaagtagctgtgattacagtgccaccatgcccagctaattttgtatttttagtagacatggggtttcaccgtgttggtcaggctggtctcaaacttctgacctcaggtgatcctcccgccttggcctcccatagtgctgggattaaaggcatgcgccaccatgcccggctaattttgtatttttagtagagacagggtttcaccatgttggtcaggctggtctcaaacttctgacctcaggtgatcctcccgcctcagcctcccaaagtgctgggattacaggtgtgagccactgtgcctggcctttttgtatgtttttgaaatctgaaattgatgcaccatatgttgattcagattagccatatttcaagtgtcatggccacacatggctcgtagtcaccacatggggcggtatagccctggatcctcagagttccctcattcaggttggaggtggagattgcaggggagggatctgcaggccagatctggaagtggcaagttcagcccgcattccactgaccagaacccagactgtggtcgcacctttgcaagggagactggaacagcatctagctttgtgcccaggaggataaggaagcaaggtctagcgaacactcagcagagtctctcccagcagccagcaattttctgtgcatctactatgagctagtcagcctggttggcaggctgtatctaggttttgagtaaggtggaagaaattttgctttatatactggtttcccttagctcatagttcatactccttaaagtggcttccagggtcttccatgctaacttgcttcccagtgctcccaggggccccctgcaggtcccaatttgcacactgttactcatgctcttcctcccactgggagtatccgtgttctcctccagtagtgcccatcttccctgattctccccattccctgggtcctcttcagtctcttatgctccccttttatgcccttcaccatatacagacatacaggcagcatgagtggagaaacatgcagttcagaagcagctgggcctggattccagccccagttctatgacacacctgctgtgtgaccctgaggaaagtcactcaacctctctgagtctcatctgtcccctctgtaaaacggaaataaccagagctacctggtgggatgttggcccccacctgtcccagtgctgcacagctgcaggccaaagcccaacttggtatttgagctggttctgacctgggcaggccctagaagaggatgagaccccttcccactgagggaggtagatttgatcttgtgatgagatgtccttgtctatgagttgcctgggagagccaagactcctgtgtccctccaaagtgatggctccacctggggggctaggctctgcctcagggtcaccatccaacttttaaaacctttgtctagaagaatctcagcatggttaccataggaccctgacctgtccgttttcaccctgggatgggacatcttcttcccccccacccttcagccagcctgcatcaatctgctgttgccacttgaggatctggatggtgggccctggcctgctgcagttcttctttttttttttttttttttttgagacgaagtcttgctctgtcgcccagactagagtgcagtggtgcaatcttggctcactgcaacctctgcctcccgggttcaagcgattctcttgcctcggcctcccgagtagctgggattacaggagcctgccaccgtgcccggctaatttttgtatttttagtagagacagggtttcaccatctcggccaggctcgtctcgaactcctcagcttatgatccacccacctcggcctcccaaagtgctgggattacaggcgtgagccaccgtgcctggcctacagttcttcttttgcttctggtctcttactggactcttgtgaggctgacaccagccctgaccaagcccagtctccttggaggagaggcccaagtccagcccacaactgtgtagggccccccagccttgttgcctcccatgcctggcttcttgccctctctctaggggcagggcatgctgggctgtcttcctgaagcacccagaaaagttatgaggaggggacagttaatgccaggtgaccagtgaccctgagccagtcctcattgctatgttcagaagagacaaaggcaatgttagcatagtgaatgttgaactgggctgggtgccgtgaaaatgatataaggcagaaactataaggcggaggatactattatacacccattttatggaagaggaagctgaggtgcagagaggttcagagacttgctcaggtctcacagctccgagtgctcaagttgaattttgactcaatatcacatgaatgcccccgacacaaccctaccacctaaaaactaaaaggaagatatgaaagcaaatgtagagagaatatagctagtagccagaggtaaagtgaagagtcccaaagactcagaaataaaatcactgtctgaccctttgtccagaaaattcctgacgtaatggatgggcctcatcatcccgagaaacccagagtcagagtcaggaataagcaggtccttgaggaaatgaggaatgggatgaagaagaatgttcaggagggagagcatggccacaaggttgactgtggcctgccctagggtggggagtgcaaaagcaagatcttggagctcttgggttccttccctgctctcctgcccactccagattccatcagttatggcctttggaggctgtctgatctctgccctgcttcctggctcacccagccactgcttgtcaccaattcagcttcctgggtgttctgatgttcgaaagagggtgtgtgaatggtggacgagaacatcctggtctatatgaaggagtgggcttcagggtcagtagatacaatggtccccctacttagttccctggtgcttggagaccatcgtggtgctgggtcatgaagcagagagaacatttgtgggctctcccagcccagaactgaagcttctgaaccatggtgactctaggaagcccaccacccaggagtcagcctgcctccctggatgcaagttgcctctggtgcttacaaaccacagcacaaaacacaaaaaatgtggaaatggggacgttcccagaaggcaacttcctggggctcagataaccctggtctgaccgcagagacctgatgcacctcgtacttcccctcctgtctgtgaagcatgaacttggctggtgtcatgcctctgtgactcaaagatccctgctgacaggtttaactccctgcatggctgagcccctgcagagcccaggaccactccactaggccaaagtgaggggtaatggaaatgaaaactttccacgtttccgtgtctgtctccccgtagcctgagcccacaccatctgcctccttttactctggcatggatgatgggaaggaccaggccctttccaggttcctgttctggctcctctgtacagcagctgtgtgatcctgggccagtcgctttgcctatctgcaccccaggtttttcatctgaacagtgacggtcacagtaacacccacctcaagggaattgcgagaattaaatgaacctgtggatgtcatcctagaacagtgactggtatatagtaggtgctcaatagaggttaattcccatcttttctgctggggggcccagatgagatgaaggttttctgtttaatgaaaacgtgcacaaaagcccagcagcgctattcctagatatattcccccaagagaaatgacataagtctacataaacacttgtctacaaatgttcatagccacatttctcacaatcaccccaaagtggaaacaacccaaatgtccatcaactgatgaggggatacatggaatgcagtctagccatacaatggaatatcattctgccataaaaagaaatgaaggactgacacgtgctataccatggatgaactttgaaaacactatgttaagtgaaagaagccagacacaaaaggccacgtgttctagaactccactggtatgaaatgtccagaatagacaaatctatagagacagaaagtagattaggagttacctatggctcggggtgtggtggggaatgaggagtgactgctaatgggtatggggtttctttttggggtgttcagatgttctaaaactgattgtggtgatgattgtacaactttgaatacaattttaaaaaactgaaatgtacatttttaataggagaattgtatggcatgtgaattatgtctcaataaagccgtttaaaaatgaaaagtcagggagaggaagagaaacttactagcacttgctagtgccactggcttaaattgcttcctaaatattcacccatttcattctcacaacaaccttttgggaggtccttttatcaccccatttttgcagttgtggaaacagaagcacagaaaaggtgaagtaacatggccagtcacacagctagttagcagacctggaatttgaactcaagcagtggtggtttagaactgaaccgccaccgtaagctgccccccactgcaaccagaggtcggacttcatgtataacagagggagtcacaggacctcattcacccagaaagaccaccggagtcccccacctctcacagagggatctgccaggacttgggtgcacagggtgtagggcctaggtaccagcagagagccaggctctgagaggcagacaagaagtgggtgtttctgggtgacactgtgggactaacatgtctctgacccagtttgagagtgcctggcccctcctggagctggagctgcagaaatcgatttgcagactgccggtttccacttaattagcatggcctccttctggctgggaaaacaccattaaatgggctgggttggcctggaatcatgccggtggcctcggccctggttctctggggctatctgtctcttgggctctgtccccttagccaggctggaattcagaatggcccgagtttctggtttggagtatgaggcaaattctacccacgtccaggcccaagtgttagatgatcctggggccccggttgagggaactggaaggagaaatagaggcttcactcttcatactctgcctccttgggcccattggtcagtgtcctggcacacagacctctgacttgcacagggcacctaccctgtgccatgtacactgctgcattctttttttttcttttttttttttgagacggagtctcactctgtcgcccaggctggagtgcagtggcgcgatctcggctcactgcgagctccgcctcccaggttcacgccattctcctgcctcagccttccgagtagctgggactacaggtgcccgccaccacggccggctaatttttttgtatttttagtagaaatggggtttcaccgtgttagccaggatggtctcgatctcctgacctttgtgatccgcctgcctcggcctcctaaagcactgggattacaggcgtgagccgccgcgcccggcctgctgcattctttagatgcgtcacctggtacaccttccactcacgtcctgcacaggtgggctccacttcacagatgaggagacagaggtgccgaggggttgtcacttactgaatgttcccatggcagtaggtggcagggccggattcctatctccgggtctcctgcttctggtgtaatcccagcggcccctgcagagcctgcctctgttttgagggcaccactcatcaccttggctttaaaaagttgaaaagtggccaggggcgatgcctcacacctgtaattccagcactttgagaggccgagttgggcggatcatgaggtcaggagttcgagaccagcctggccaacatggtgaaaccctgtctctactaaaaatacaaaaattagccagacatggtggcgtgtgccagtaatcccagctactcaggaggctggggcaggagaattgcttgaaccctggaaggagaggttgcagtaaggtgagatcatgcccctgcactccagcctgggcgacagagtgagactcttgtctcggagaaaaaaaaaattaaaaataaataaataaataataaaaattcgagaggtttgatttctgcttctggtttcagaggaaggaaaatcacttaggcaatgggcccctggggaacagaatagctcctaaatcccgggtgtgctgtcctctgtgggctgagtgtctgtgcagcgggaagaaggggcacctctgggttctaccccagacttgctgcatgaccttcagcaactgacttgatttctctgagtctctttccctcatctgtagaatggggcacagtaacagcctcctttgcaatgtggatgacacagaatgccccggaaggtgcgttgacacatggtcagcgtcccgtagcagctgcctgttatctcgccagcactcttgtggctagcccttcagaaacgaacccaaagaaggcctgcttgctttttctcacaccatggatgtctggggtgtgaggcaaggcacatctttttcccatggaggggatacagcccgccatgcaggagatggcctgggatggagggtgggtctcctgggcctggagctcagcctctgtctggtgatgtcaggaatctgcactgtggagcagaggcaccctgcagtgtgcaaagtactggtgttttcttttaaattgaggtaaaactcacaaaacacaaaattaaccatttaaaagtgtacaatttagtggcatttaagtaccttcacaaagctgtacagtcatcacctctgcttagttccagaacattttcattgtcccaaaaggaaaccctggactcattagcagtcactccccagtttcctcttccccctagcccctggcagccgctaatctactttctgtctctatggatttatctgttctggatatttcatataatatgtgacttttcgtgtctggcttctttcacttggcgtaatgtttttcgggttcatccacgctgtagcatgtgtcagtacattattccttttacatctggatcatgttacattgtgtggatagaccccctgtcccccgccaaccacacacacccaggctggagtcaccctaaggtccacctctgcagtgatggttaaagcgatgtccccaaagggcactgtggtcttggctccttgatctcaccagccattcatgtccaaacatcagcctggtgctgatggggacgaggtggggagtgattctgggggatggggatagttaaagatccaccagggacagatgagcttcctgtgtggtccaactcaggagtcaccagggtccatggttcagatgctgggatctggagcgagaccatctgggctcaaatcctagctctgttgcctattgggtgaacttgggcaaaccattcaatctctctgtgcctcagtttttcttttggttaaatagaataataatacactacctacttaaaagggttgtaccagagctaaatgaagccttgctttagcacagtgcctggcacagaggaatatttccaaaatatgttagttgtccaaaatgtgttagcatttccaaaatgtgttagctgtcagctcttgtgattctttgattcttttttttccccccgagatggagtcttgctctgttgcccaggctggagtgccatggtgtgaacttggctcactgcaacctccgcctcctgggttcaagcaattctcctacctcagcctcccgagtagctgggattacaggcgcccgccaccacgcccagctaatttttgtatttttagtagagacggggtttcatcatgttggccaggctggcctcaaactcccgacctcaggtgatccgcccatcttggcctccctaagtgccaggattacaggtgtgagccaccacacctggccgtgattctttgattctatcagttggtgtttccccctaaaattgcagtcctgtgagtgtgctgaggccgtgcctgggcactatgcaccctcatagcatgggttgccttttcttactgctcctcccctgggctgttttccatctatttcagggctttcttgttactgtgcatcactgtgagctccacagagcaaaggctcactctggtttgctcagcacagtgtacacgccgggcacagtccctctgaacaactgcatgcccacaccactcctgcgtttcacctcaggaccccatggcccacccctgtgagctaagctcatgcctttttactttgagataattatagatttacatgcagttaaaaaaaatacagagagatcccttctgttctacacccagtttacccaaatggtaagttttttttttttttggagacagggtctcactctgtcacccaggctggagtgcagtggcgtgatctcagctcactgcaatctctgtctcctgggttcaagtgattcttctgcctcagcctcctgagtagctgggattacaggcacatgccacctcgcctggctagtttttgtttttagtacagacggggtttcactatgttggtcaggctggtcttgaactcctggcctcaagtgatcctcccgcctcagcctcccaaatggtaacattttgcaaaactaatatatgttatcacaaccagtaaattgacattgatacggttcaccaattggatccagattttgccagttttatatgcattcatttgtgtatggatgtgtgtgtttggctctgtgaaatctttgatggcaggagcagatttgtgtgaccagcactgcagtcaagaggcagaattatgaaatactggttacatgataaaattataatattttggacatatggattaggtaaaatatatcattaaaatatcacctgtttttattttttaaatgttgttaacaaaacatttcaaatcacatatgtggcctatgttatatttctctaggacactgccatcagtccaaaaagttcccctgtgtcccttcccagtcaatcccctacgctcttccaggcagctattgttctgatggtttttttccccactaaaggctatttttttcctttttgtcttttttttgaggtgatatgcacataaaaaattagccattttatttttttttatttatttatttttgagacagtcttgacgtgtcacccaggctgaatgcgggtggcacgatcttggctcactgcaacctccacctcctgggttcaagtgattctcgtgcctcagcctcccgagtagctggaattacaggcgtgcaccaccatgcccagctaatttttgtatttttagtagagatggaatctcaccatgttggtcaaactggtctcgaactcctgacctcaggtgatccacccacctcagcctcccaaagtgttgggattacaggcgtgagccaccgcgcctggcctatttttaactttttggagaactgccaaactgttttccacagtagctacgcaccattttatatcctcaccagcagtgtacaagggttccagtttctccacatgcttatcaacacttgttattgtctgtttttaaagaaattatagtcattttagtgggtgtgaagtatattgttagtttgctttttctggaaagtcatgcaagtggaatcacatagtatggaccctgtgtgagccttcatttgctcaacttatatgcgaagattttttagatgtgtggtttgagggcctggaaagtcatgtcctggcctatggaatatattaaaggggaagataggattccttaaggcaaaagtggcagttcattaaccccctcccctgcaaatccctgccccacccccatcccgctgccacataaagatggacctgtctgcctgccttcactgcagagcaaaaattttatttatttatttttttttttttttaagacacggtctctctctgtcgcccaggctggaacacagtgacgcgatcccagctcactgcaacctccacctcctgggttcaagcaattctccttcctcagcctcctgagtagctgggattacaggtgcccaccaacatgcctgactaatttttgtatttttagtagagatggggtctcaccatgttggccaggctggtcttgaattcctgacctcaagtgattcacctcaagtgatccacccgccttggcctcccaaagtgctgggattacaggtgtgagcaaccacgcccggcctgcagagcaaaaatttattgagcacctgtggtgtgccaggactcatttataagtaaatagaaaaggtccctgtccttgtagggtttataaactatagggggaaactacaagtccacatacacataacctaccatttaaaagtctgactaaatgctgtgaaggagtaagcaaggtgctttgatagggaacagagggacagtgtgtgtataggaaggccagtcaggtgggtccctctgaggaggtgacacttaagagacctgaaggatgagaactgagccagccatgcagaaggatggggaggctgggctagaggagagtgttctaggcagaacaaaatagcacaagcaggggccctggggcagtgaaagcctctggtggttcagtgcaaagttaggaaggtgtgaaacagtgggaagggaagggacagggatgctcctgctggctgatggcccatactgtaggggccacaactttgtcttagctgcaagcaggaccggagacatgaagggccagactctgggccaatttccttgctgcgttctcagctccaagaggcagctcggctgggatattgtggctcattctagtgtcttgcagcctctcaaactggagggctggagggttggggcgtggttagtggcagctgtgacggagacttatcaggaagcaggcatgtaattcctgcagtgattcacacccagtccccagtttactgcagtcctgcagtgattcacacctgggccccagtttaccgcagctgcacctttaaacagggctcggatgcctgcatctccctgacccgtgtgtaccctcatcatcccaggacctcggaggtgtgggtgaggcagcacatagctcagcctggtgccctcctctcactagagagcttgaccctaaagccgcaagctcaagcccacgccctggccaacctcctggagctttgagaacaaggtgtcctgtacacagagtcctggccccagtacctgagcgcacatgaaccccgtatgcaagaagaaaactgaccccagccccatgttacataagaacatctttggaatttggctccttttgaaatgaaatgggaaacctgcactcaaacaagcaggtatggggaattcaataggaggcaaatgccctcagggtcacctctgggccagtatgcattctgaggattggtttattcattcagcaaacattgtggacacctgctttgtgccaagcttcatggagggatacaagaacagatgttcaatcaatgtctgtgggaagaaggagagagaagggggatgaaagggaaggattgagaaggaggagtgtagggaggtagagagtaaggaagagaggaacgaagggagggagggagggagggaaggaaggagggagggaaggaaggaaggagggaggcaaagaaaggggaagggagggagggagggaaggaaggagggagggagggaaagaaaggggaaggaacagagggagggacggagggaagataaatgggcagagataccctcacagagctcatcgtcatgtgactgtgggtgcaggtgtgcccatggtaatgtaactaagtatttacaatctagctcagctctgatcaatggaaaaataatgtaagccacatatgtaattttaaatgttctaatagttccagtaaagcaggcaaggaacaggtgaaattaatttgaataattatttaactcaacattatttcaatatgtatttagtataaaaatattaatgggtatgttacatatctttttcacactaaatcttcaaggtcacccctagcacgtctcaatctggattatgcacatttcaagtgctccccagccctggacaccgtggagggtggcaggcactctgactgaggtgcacagagcctgctgagggcacttaagtcagagtcaaggaagacttcaccgggtggtgccttcagtcatttaatcatttgctcacttactgttcacctaatgtttattgaatgcctcctgcactgggtgtgacggctgggcagagactctgcttggaggaaggagggaagggcattccagactagggaagcagattgcaagctctgagagggcagactggcgtctgtctggttcactgctgtagccctgcacctggtgcagagttggtgcctggcgaacatttgcggagcgggaaaggagggagagaggagttgggcatttctagagcgcaggaggcagagaagactggttagagaggaagctggagacaccattctcaaacttgacagtgcactggaatcactggcagggtttgttaaagcgtagattgttagacacccccctcctgcagggttcctgatccagcagggctggggtagggccaccggatttgcattgccagcaaattcccaggtgctgctgctgctgctggtccagggatcactgagaaccactgggctagaccacgaaccctgtgaaggcagagaggagccaggagaggtttctgagaaggagagaggggagcacttaggtttgtgatttagaaaactgtgggtgtgcggcacggtggcgcatgcccgtagtcccagctactcggtaggctgaagcaggaggatcacttgggtctgggagatctgggctgtagtgcgctatgctgatcgggtgtcggcactaagtttggcattaatatggtgacctcccgggagcggaggaccatcagggtgcctaaggagggatgaagtggcccaggtcggaaacagagcaggtcaaaactcccctgctgatcagaaaactgtgcatggctgctgaggacaggggtttccacctccgtcccacctctcctgccagggcagtggcacccttagctcaggagggtgcgtcaggacccagttccatcctcacacggtggggaagcctgggctgtgctcccagaacaagaaacagacctgggtgatgagtgacaaatgtggacggttctctgcactgtgggtggaaatagaaacccttagtcagctgtggggttcagcaaagaatttccctggttaacggaaacttgactggctgtgggtgagggggaggttgggttctgagacgtctgggaggcctgggctcttcggttctcgtggtgcccagctcagcgtgatgccttcaggtttgagaccacttcctcctgttgagcctcttctctgggggcactcattatgtatgctgcgtaacaaatcaccccaaaaggtgttaagtgaaagtaacaacagatgtctgtgttctcacagtttctgtgagtcaggaacccggggtcgctgggtggtttgggctcagggtctctcaggaggctgtcgtcaatatgtgggccaaggcctgactgggttaggggatctgattctaagatggcgctcacacgctgttggcaggaggcctcactccctcactggtggtcttttcacaggactgctaagtccacactatgacagctggctttcccagaacaggtgatccaaggggcaagacagaagctgaaacatcttttttttgtttttttttttttgagatggagtctcactctgttgcccaggctggcgtgatctcagctcactgcaacctctgcctcctgggttcaaccgattctcctacctcagcctcccaggtagctgggattacaggcatgtgccaccacactcggctaatttttgtatttttagtagagacagggtttcaccatgttggccaggatggtctcaaactcctaacctcaggttatctgcccgcctcggcctcccaaagttctgggattacaggcatgagccaccgtgcctggccagctgaaacatcttttatgacccagactcacaaggcacactccatcctattggtgacacattagccctgttcactgggggagggaactggacaagaaggtgaatcctaggaggctggggtacttgggtggcatcttggagactgaccacaatgcccaaactgccctttggccttatcttgtagtcagtccacagatctccaaagataactgtatctggtgctgctatttgttgtcttggagcttgaagactgggccctacattcctgaggggtgcctgctggagccaggaggtggggtaggggagagccagctagtagctaaacactttactcattccagacactatggtcagcactttataatctaattctcagacaaccttatgagattatagtccccattctacagatggggaaactgaggctcagatagaggagatgacacatctgagatcaaaccactgggaaatggtggggtctgaattctgaaccactacacgtgtgtcttcataccaggtgcaatgcttaggtagactgcatattccccaacagtgtgctttgatggcttctctccagggtggaagtggttggagcaaaggtcagactggccctttcatcccttgggctcagagcctggcactaggcttgctggcagaagaggaaacaggaaggctttgggctgcatgcagatccccaactcttaaaacctggggtcaagtttggctctctcatacattctcatggtggagcaagcatgggtcaagtgtgggggtattggagcctcttaccagctgagtagattggggcaagttaattaaactcactgtgcctcagtatccccaactgtaaaataggagctcattagagcctgcctcacatttgccttgggctgttgtaagcattaaatgagatcatttcctacacatgctagactcagggctgggcaacagcaagtgctcagtaaacatgagctcttcttatcgcaggcttgttagatgctgatatgcatctgctgtctgttcccacatctggctgagctgtgaggatacgagggttgaagaccatggcatttttgtctattgctgggagcatcagcaaatgatccatcctgcaggtccgagagctcaggacattttcagcaaatggctcccaagtcccatacatcactctacctacatcctgtcctggtcctctctgagccaggaacagagggttccagaagccctggaaaacttgcagcttgctcccctccgggcccagccagctactctctagctgttcctgtctgataagagagtggatttttccatttcctgcagcagaaatgctcctgtttcctctctgcccacccagctgccctggtttctgctgctgcacgggcagaagatgggtatctggaagtcacaggagattgtgcagcatgcagggagagtagcaggacagggccccccaggcaggtggggctgcaaggcagtcagcataccttgcaggagccagacttctctgttttgttttgacatgggaaccgagtctgtatcagaaatgacaaaatcaaacacccgcaaacaaaaccccccagcgaagcaaacaggaagcagggtctggataaaaataccatcctttttgcagctgcagcctccaccatgcaggtttcagaaggtcacgctcttgacaggaaatgtggctgctttcagaggggagaggtggctgagttggggccgggggtagagacagtggggacagccagaagcaacagcaggctctcgggggaggttcgtgcacctttcacttcttgacaggtgaaggaactgggcccgatctgtctgttcccttcctggccacgatcccagggttcaccttggacttatatttgtttcttcctctcctaccagggaccaggagacttttattgtgagggtgaaatgagactgtggttttgaacttttttttttttttttttttgagatggagtttcgctcttgttgcccaggctggagtgcaatggtgggatcttaactcactgcaactccgcctcccgggttcgggcgattctcctgcttcagcctcccaagtagctgggattacaggtgcctaccaccatgcccagctaaatttttgtatttttggtagagacaggtttcaccatgttggccaggctggtctcgaactcctgacctcaggtgatctgcccgccttggcctcccaaagtgcttggattacaagcatgagccaccactctcagccattgaacatattttgttagctgaaaagcattaccctgaggatcagcaaagtttttctgcaaagggctagataagaaatattttcggctgtgtggccatatggtctctgtctaactcctcagctgtgctgctggagcctcaaaacagccataggcaatgcataacaagggagcgtgtgttccaattagtttttggacactgatatgccactttcatgtaatgttcatgtattgccaaatattactcttctttgatttttttcaaccattaaaaaaaaaatagaagccattctcagcttgcaagcagtataaaattaagccagatttggtttgtagaccacagtgtgccaacccctgcactctccaaacaaaatggtttgtattattgttgctatttaacttcctactcaatacaggaatcccagctttagcacttccttcatggggtcagccaggttgagactttgtttctgcactagctactttgagcagaaatagagttcttaccacttggctatcattctgcggaaggtttttgttttttagtgaaattgagaagttctgattataaaggtagtacatatggattttaaaatgcttgggaaatactggcaaacacaaaataaaaatccctgataaatcatagctactgtattttttttccaatgaaaagtgtgtggatgtatggaaagcatttttttcctttccagttgagattccattgaatgtaaagttttgactctttgtttttccattctatgttatatatcaagcattttcccatgtcattagaaattcctcaaagataccagctgcagaatattccattatatggatgtttcataatttaccaaatcaacctccaattgtttaggcatttgggttgcttccaggatttctcacttataaacaatatgcatataaacaatgctgctgtgaacatccttgttcgtaaatctttgtctgccctctgatcttttctttagggagaatgtgtgctgaaaattcctaggaaaactgtgcttctgacttatatactaacttttttttttttttgagttggagtctcgctcttgttgcccacgctggagtgcaatggtgcgacctcggcccactgcaacctccacctcccaggttcaagcaattctccacctcagcctcctgagtagctgggattacaggcacccaccaccacgcccggctaattttttttgtatttttagtagagatggggtttcaccatgttggccaggctgatctcgaaatcctgacgtcaggtgatccatccgcctcgggctcccaaagtgctgggattacaggtgtgagtcaccacacccagcctatactaaccatttttgctttactgaatttgactttgctgattatgcagttcataaggtttcctcactgataatgacttcattctcccctcctgcaccgctagccccaggcgaccactgatctgctttctgtttataatttcattttgaagtatctcatttttgatcagcctaaagttgattacctccttatttgctcagaattccattcttcataatagtaatgctgccacctccactttctttgtgtttgtgtttgcctgttttatatttgaacattcctttaattttagtctccgttattttgtttggaatatatctcttgtaagcagcacacagttgtttttttttttttttttttttttttttggcaaccaaatcattgctgctttatgggaaggataaatgattcaatttactcatctggtacatgtttggatgtcggtcatcttgcttcgtgatttgtggcatttatttcttttattatttctttcattttgtgactttaatgaatactgtgttgatttgcatttatcttttccatcgataatatggaagatacaagtagtgacttcaatttcttatgtggttacctttaaaattttcagaaatcttgttttatttccccaggcagacacttgttcatgtcctatgtaatacagggctgaggcagagtagcatctttaggaaagaccaaaattgaaagccaaggcagagacaggggaggtagttttgggacagcagaacaggaccagggaaatcagagggaagcttcagagtggacaggtgtgagctgaaggaacttcccccttcatacacagcttgttgccttttcctaaacattgataggaatggattttattcttggctatatttgagtgagggtcccttgtaattagtcatgcctgaaataccagttatgtatggaatcaaccagactagaatttgagtctcagtgcttactagctaaataatcttgggaaaatcatataagttatctgtcaaatggtctaataatagcacctaagtcatgtggttgttgtggggattgaggcatcccagggatctgggataatacatgtaacatcctggtacagtgccttatacttggaaaatagtcaatgaatgttagatgctattatgatggctgtgaagctattacagtgtttatatgcatgtatctcctacctgcagggctggaaatatttttatctattacttgcctggagatataaagtaaatggactatttttaaaaattcaggattgatagctggaaggagaagtgaggtgagagatgggttttagagagcaagagcgagtcagaaagaggcattcagggcatctggggagaggggaattgggataagagcagataccttggagagctcccggacggccagtgcgtgtttaggcgggccaggctctgcggagcggaagggagatcaggtccctaggtctgcagtgaagctgtaaggagaggtgctgggagaattctggaggtagaatcagtaaagaacaggggcctggtgcagcgggggtctgatgtatttatgaatagaatgaggaagttccaagttcgtgtttctggataagggggacccttgccttcagtctctgagattaagtacagtgaggggtaagagaaggggaaggaagggagaagaagagagagggaagggtccaaggcacacagtctttgcagctttggtggagaaatcttacaggcccatatcatcttcacggtagctgagttaaatgcagttctccctccctttgaggaaatcgaatacacaaatgtcccctcacacattaggaagtgattccccacctcaccccaacctccatgtgtcagaaagactatacatattgaaaaagattaactgcaggcctactttgtacatcagttttctgggtatctttagttttttattcttagaatttaaaaaaatatttttaatttgttcattcagtcaacaaatatttgttgagtgctttctctaggagctgcatgccccacataagaagacagacacgagttgcccgcatagagcttatatcctaaagggtgtgctgtcacttttcctgcatacacccaatgccagatgtaagttacatgtgcagaggcatctgggtagctgatgtgaatctctgtcaaccccttctgtctagcagagacatatgtcctgggcacagaggttctagaagggagcaggtttatagctacgtgtctggggtccccttggccatcttgtcctggtggtgctaagggtgtcagagatgctaggagaggaactggcctctttgttcaagccaaagggtgaagattctctctgacaaggaaaagtctgtggcccagcctgggaatgctcttgtccaaaggaagaagcatagagtagctcaagaacagatgttctggctggttctgaggcttgggtagaggccaggtaagctccattcacttctgcggtcatcagaaattgactgggggcctgaactacatcacaggagcagcacggtagccaaaagatggtcctactcaccctatccctccagaactttagtgtcgtaaagacacagacaaatccatacataactataaaatagtgttaagtctttttggagtttgggaggcacagcagtcatatgagaagggtgcctggcccagcctgggagacctgcaagaggctttgcagaataaatgacattgaagctgggacttggaatctaagtaagaattaaccaggtgaagtgaagacagagaaagacaggcagggctgggtgtggtggctcacgcttgtaatcccagccctttgggaggctgaggcaggaggatcacttgagctgaggagttcgagaccagcctggacaacatggcaaaatgccatctctacaaaaatacaaaaaaaattagctgggcatggtggtgcgcacctgtactcccagctacttaggaggctgaggtgggaggattgcttgagccctggaggttgaggctgcagtgagcttgatcacaccactgtactccagcctgggtgagagagggaccttgtctcaaaaagaaaaaaatactattccattgtatggaattttgtttatctattcattagttgatggaaatttgggtattactttagagatatcgcgactaatgctataaaaacattcatatgcaaagttctgtgtggacatatatgttcattcctcttaaatatatacctaggagtagaattgctgggtcagatggtaatgctgtttaactttttaaggacctgtcagtctgttttccacagtgctgtgccatcttacgttcccaccagcagggcccgagggctctgatttccacgcgtcttcacacggttgtccaacccctcctcttcttgaatgggccaagagtgatactttctatctggggaagagcaaggggctggctcctgggacctgaggcttggtcctggggatgtgactttgagggaagcccgtgtctttctggtccaccagggtgagtcatcacccaggatcccgggggagctgcctggcagaggggcgggctgcaccagccactgcagaaaccaccatgcaacttgactgagtctccaccctcagctccaggcagccgggcttccctgggagcagctatttctggctatttctgctccagggaggagcagtggtgggtggaaaggtttcaattgctcagtggggtgatttttggaagcgcagtgccttgggggcacaggacagctttgacttgggaggagagcagaggggctgctctgagagtgctggccctttggcgttatcagagcagagggctgggcacacagcagtcctgacagcaccttgaagagggggaaataagtcagtgcggactgggctgttcatgcaggaggtgcaacccagtgggcgggatgtggcgacatcaggcaggccaccagggtgcttggaagcaggggcaggctggggtctacctacaatggagatgcagcagggagaccgacagaggtggcgctggacctcaggctcagtgttcacttctgtgcctcagtgacttcatttgcaaatatagtaaccacaaaggctgcagcaatgcctgttggcaactgtcttctctatcacatgatgttctggaacactgacctttattggcaatgttcttgacctttctcttagctttttgccatccctgtgggctctcttcatgataacatctgtgtccatcctgttcttctctccgctgtatatgcttccttccctgggtccttgtttggtaccattttagcaaagtggttaagggttcactcttcggagctggctgggcctgggtgaaaatcccagctctaccattcccagccaggtgtctttgggcaaatcatttcatgtatgcaaatctgagcctcagttttcccatctgtaaactggagcaataatcgcagggagctatttaataacagcaggttacttatcctcgtaactggattatgaggactaattgacttgatggatatgaagggcttaacacaatgcctggcacacagttagtgctgggctgtagaaagagcaagggcacagggcagagagaatgaggagtgggatcctggacagagggacatgttgagtcccctgtatccagcctgcagagggggacagtgttgggtggggctgaaggactgctgtggtcagcctccaggtcaggtggtgttgatgagggaggctcaaggaagggtgtctgctcactcatttttttttaagtttgttgttgttgttgttgttcttgttcttgttttaagagacagcatcctgctctgtcatccaggctggagtgcagtgatacaatcacagctcactgcagcctcgaactcctggccttaagtgatcctacggcctcagcctcccaaagcattgggattacgggtgtgagccactacatctggcctcactcgattttgtacaaaagtcacaatcattgctttttattcctgagtcatactcctgttgtgccccatgtctgtgggactacactgacaaatagtttcatgccctcaggaacaagtagctccatgggtaacaaagtaagtgctgctgtaaaggacaaaagcagaaatgcagggtagtgtggagagaatagatggggaagctcaatggagattagggcaatcagggaaggcctcccagaggaggtgacattttggctaaaacctaaaggatgaagaagagtttgccagcccaagaatgggaagaaagaaggctccgggcataggaaacagtgtgtgcaaaggcctggaggatcagagctcggtttttgttttgttttgttttaggaaatgagaggccagtgtggctgaaccagtgagggattcagggagggatttccaggtaaggcaggtgtggagcaggcagggactagatcatgcaatgccttggaggcagtgggaggatgaggcctcattgctgggcactgggcaggaaaggaaggaagagagataggagggcaggccttgtgagtgaacctgaccctgcaagtcacatggcgaggtggcagcagctcagccccagggcaccccccggggagatgcagcttgcccaaggtccacctccactgggcagacacctctgcctggctgtctccgtttccccagaggaggagcaggagccacgcctatggtcgcatgttgctaaccatctcgaggtcaggaagatgctctgtgagacggagtgggtcagatgccaaagaaaacacaagcttgtcagcggtgatgtctccctgcaaaggcagccgccaccagcttcctgccgagatgggccggctcagcctcacttgctacagctggagatggagaggaccagatggccctgtttggcccagattccagccagattgccagggaggtgtaggcggagcagcggggtcggcgccaggagcagggatacgtgagtgaggagggcgggagccacctctttgccatctcagtagggccctgcctgtgtagggggtggcggggcaccgactgtggccttacagtggtctgtgaaccagcatatgctcagagctccctggagggagactgcctctgtcttttaccaccagctctaaagctcttgagaggtgcaagatgttgatggttgtattcccagcatccagcacagggtggcacacaagcaagagctcactggttgatttttgtttttatttttaaaataaatgctaacagtagccagggccttgtcttccttaaccccacagcaatgccatgagggagcactgttgtgatccccattttgcagatgaggacatggaagcagagaaggggaataacttgcctagagccgcagctaagcaaatgcatgagaataaatgggtcactctgacaaactgatggcagagcctgggacttggggctttgtgggcaagaagctgccctgagtgtgggcaactgagagaaggtgtggacactcctggccgaagggaataagcgtgcctttctcgtctttgtgctccctgagctccaggcaacaccttagacccaagccagcttcctccattgctccaggtgctccagagagcaagagatgagccgggagaggtagggagacaggacccctggcgtggctgagcaggctgcacactgcgtaattccagggcactgtattcacacagactatgatgagaacagtgcaaggtactgttatgcaagcgtatttgcatattgccttggaattatgcaaggcagtagctctgtaggcggaaccacaccatacaggactttgaagaccaggggtctgcaaaccttttctgcaaagggccagatagtaaatatcgtaggccacgtgagccatacagtctctgttgtacctactcaattctgctgttggagggtgaaagcagtcataggtgatatgtaaatgaatgagtgtggatgtgttccaataaaactttatttgcagaaacaggctgcctgccagatttggctcacaggccatagtttgtcagtcccaatgaaggtcatggaaggattttgaacttcatcccaagggcactgttggggctggacgtggttgtgcgtgcgcctggagtctcaactactcagaaggctgaggtgggaggattgcttgagtgcaagagtttgagtccagcctgggcaacatagtgaggccctgtctcttaaaaaaagaaggcggcggacaggcacagcggctcacacctgtaatcccaggattttggggggctgaggcaggcagatcacgaggtcaggagattaagaccatcctggctaacatggtgaaaccccgtctctactaaaaatacaaaaaattagctgagcatggtggcacatgactgtagtcccaggtacttgggaggctgaggcagaagagccgagatcgcaccactgcactacagcctgggcaacagagctaaactctgtctcaaaaaaaaaaaaaaaaaaaaaaagaagaagaagaagactgggcgtggtgactcatgccttaaatcccagcactttgagaggctgagatgggaggattgcttgaggccaagagtttgagaccagcctggtcaacatagtgagacccccatccctatattaaaaaaataataataataaaagaagaagaagaagaaaagagcagaatggagccacgagaaggttttaagcagggagtcagggagccaggtttacattttaaatggccctgaaagagctaatccctcagcagggcaacaccatttcttctgtcccatttgtgcatccttgaactcttctatcttcaagtagaggcttggcctgggattgcagggcgtctgatacatagagagttccagaagcaaaggtcactgctgtccatttcccattaccctcgtccccaaatcagctgtcagcacaggtctcgacgtggcagaaatccagaaatgctgttcctattcctggccttagggcagagtagaatggtccactggccaccagcctgggctttgaaatcagagaggcccggtgccaaatccctgctccttaatttggccacatgtgactaagctacatcttcctggccctctgtctcttcttctgcataagaggaataattataggtgtgaactcataaaataaagtggttctgaattgaccgaggtgcaaataaaaggcttagtaagaaaacattatttttatttatttatatatattttttgagacagagtcttgctccgtcgcccaggctggagtgcaatggtgcagtctcggctcactgcaacctctgcctcctaaattcaagtgattctcctgcctcagcctcctgagtagctaggattacaggcgtgcgccaccacgcccagctgatttttgtatttttagtagagacagggtttcgccatgttggccaggctggtcttgaactcctgaccccaagtgatccacatgccttggcatcccaaagtgctggaattacaggcatgagccaccgtgcctggccagaaaacattattaatataataataattttcttactgaactctagaggcagggagcccggttgtgcactgggcgccgaggactttgctcctgtgagtaggtgcagagccaggccttgggctcctaggtacattggaagtagcactgctgaggcagccttggctcatgagtactaagggcttcctagagatgggaatcatttgtcccacctcttgggctgaaaataactgcccaacatcagggtaattacatgacttggattcctccaccgcatggagaacaccccaataattactgtgcacaaacactgcttttggcagctgatgcttattttctgcctccaggagtatctcctggacaggaagcttattctgctacccaccccatgggatttgaacccctagctaatgtgagcagaaccatccagaaacccatcctagtcagggatatagtggccactgctcctctcccaaaagccatctgtaatgctcagggcacccccactcacccgtgggcaggttgggccttggtgatcagtggctttgccataatctcctacatggtcctgaggctaacaccaggcactgggtctgtaggagatgcctgcgagcagaggactgcctgctacagacatgagtcttctggagtcagcccttgagggtgatctgctttgctcagtgatggagaggctttgtccttggactgaactagagggctgccaattgggtcaaggtcctagaggagttcttgaggactcactgtgtaccaggctttagggatagagccataagtaccaggtcatggttctgcccttgtggggcttagtgtccaatgggcagatacactcaaagcccataattagttatataattgtagttgtgacaaggctgtaaatgagatgtataggagctatgggtatatataacaggagcctggggagtttaagctgagacctaaaggacgaggagtggggcaaaggtgtgtgtgtgtgtgtgtgttagtgttagaggcagatgcatggatgatggtggttggatggatgaatggatgctggtggatggatggatgaatgattgagtctcccaggcaatgggaacagactatgcaaaatctcagaggccacaagaagtgatgtgactctgtaactgacaaaagactattgtggaaagtgtttggagtttaagaaatgagagtggtgaggttagcaggtaggatgattgtgcacagctgagcaagttgtgtactggacagctccagaagatgccagtcttataaaccatgatgtggatggtgccacctagaattgtgcaagctagagacctgcagacagggctcacatcacgcaagaacttgtatgccataggaagagttgtggactttattcccagagcaatggggagccatggaaggattttaacaatttgtgacagagctaattttcatttataatgccccaaagcagcaccgtccaatagaactttccaagaagatgaaaatggtctatttctacactttccaatatggtagccaccaaccacttgaaactgagcacagcatgcctgagaaactaaattttgaatgttaattcgtttaagcagccgtaatagccagatgtagctagtggcaccatgttggtcaggacagcgccaaaggatctgaccgtactggacaaagtcctgtcatgcttaacccatactggctatgcatactgggcaggtctactggagatgccacctcttactgggtggtgacctcaacctccccttcacgcagggcctcggttcacactgaggcctagggtgcaactgggactgtggtttgggagctgggcctcatgaggatggagctgaggggctgtacccccaccccatccactgctcctgagcccttgaggactcctcccttgcctaccagcttctttttcccctggcaccccctggagttgctgactgggtttttttgtcctgcagaagggatagtcttctcttcaccctgcccagctcacttctaatttgtttccccacagcagaaatcaacgaggaaaccacctcagccctgccctatggcatgaaccgtagcgtggagatagtgtccacggtggggattaggggatgtggactttggcttctgtttcacagggagctagacttggctgggggtgggaggaggctcagagggctcagggccagcctatgtatcctgtctgcagtgcctgggcctgcacgcctggcttcatcagcacgatggcacgagggccacccacacaagccagcttgtgtattcaagttcgtccacttgccccacaaacagccaccctctgttcaccactctggcctagaggtccgcttgcccagtaactgcacagtctacctttgggaagctggatccagggaagatcctattgaggccctgcaagcaggctcggagtcatttggacagggacagtagaggtgtggcctggaaggggagccaggggcttgggtggactcgtcccactggccccctggactcctcatccacggggagaggcaaagctggagggcctgagatcaccctgccaaagccagagctggggtcccagttgccaagcctgggaaggggcctgcagggctggtgggtgagctcctctcttctctccctttgcacgtgggttcaggggagaattggggcttgaatggtggtgggcagaggaggagggaggagggtcacagtgataaggggagggggcttatcctaagcaagagggattccaggctgtcaatgctgttcactctggcctccctgcccacccagaatccctgaacacacacacacacacacacacacacacacacacacacacacacacacacacccctagacaaaattctagggattggggatggttaaaacctctgctaccctccttccccagggctcagtagggccaaagaaggggcatttgacacccataggtgagccatcacctgctgtggggacccacagttttagtaaaaatcatcacatctgccagagcaggagttcaccttcaaaccacatgctggccactgtgctgagcccctggcatggctcacctcgatgaccactcacactgctactgtgaggaggatgaacatcatccccattttgcagatgagaaaactgaggcacagagaaggaagtgtcttgaccaaggttgcacagccaatgagaatggtgcccaaatttgaacctccagagtgtatgctttcaatgactagaatgtgcatcctctggacaacaaatataacttgcttagctcagtgcctggcatccgggaagtgctaaataattgttagttcttgttattgttatccataataagataggcagtggcatctacctcttggaaattctgggcgtcagttgtctcatctgtaaaatggggagttgttactacattcttcataggcctgggggagagcgggtcttacccgggcccctgcatgcctgcacacccagtgtgcaacgggaagctcactcctgtaccctcctattgcagtacgctacttcctgaagaataaggtcagccctgatttgtgcaatgaggacggactcacagccctacaccaggtaaggccgggctcgttggggctccagggctccctgcccctcacctggacaggtaccctgtttctcggcactttcctgctcagaaccctcagggaggagggaatgagggagggaggaggagctgcagctggcccatctgaaaggctcttgtctactttggagatacgcgtgtctgttactgccatcccacagagccctgtgtgcgcccgcagacgcgactgcacatgcaggctctaaggacagggagcctttgttcactgcatccctcctgcccatgaaagcaagtgtgtttggagcttgacagtgtacgaagcacattcacacttatcaggacatcccatccaccctggcgacagaggcagttggcgggacttatgtgacctgcctgaggtcacatggtcttgatttatggtcttgagccatgtgctatcatgacatgtcctttccaaggcagagtgatgggtccagccctccctgctggggatggcttctctggctgtcacctttcacgtggatgctgctacagcctcgtaactggtccccagcattcagtctggctctgccataattctctgtccacgcagcagccatggggatgcttaagccaaaaatctcttcctgttactcaaagttctctggtgtcttcccataatctggggataaagaacaaactctgccacagtgcacaaggctgcacgaggctgggctcatgaccaatcttctaagcctcctggctctctgggctccagccacccaacttctcaggtccttgtacccagtgggctcctccccaccacacttcccacagcacttggtgctttcacccattagctgctgtccacagcaagagcctgggagctgtgctgtgatagacataccctttgtcttctgaaggccctcttccttcgtaattagtcattttagccattgatgtcatcacttgatgttgacttctcccctactcagacgctgagctgcctgagggcacagcacatacctcttgcttatgagtgtgtcctagcatctttccccatgctggcatacagtaggtgctcaatatgtgcatgttgaattaatgcatgaacacaccaaagcctccctgtgcccgagtttctaagcagatggacttgagtgagaggccaggcaaccagaaccctgggctggtgagggcctctccacctcggtacaagggcaggggtgggatgcacagagaatggccacgccctgcccgtaagccccaggggcaggtccctgtgtgtcctcttggcttctctctcacagggcctcaggcatctctcaggcagctgcctcagtacccccactccatctgccattggaaactcccagactcccagctccatgaaccctagagggcctgggactccactagggagcagagagcgggtggctgctatagcttgccctgaaatggagacccaaatgccaattcccaaggctgggctgcacccaccagccatgggcatgaggatcaaatgtgtgggctacctcctactgcgtgccagaaaggtgaggatgtcaggactgacagtcaggcttgtggcccggagctgtcacccactagctatgtgactgtggggaagttacttaagctctctgtgcctcagtttcctcatctctaaaagaggaataacaagtacccatctcattgggtggttgtgaggattaaatgaacacatgtaaaactttaagcagcactcgatactggataaatattattattatttattaaaagttattaaaatgtatcatgtgaccacttccctgcaaattacttcagttatatatttcatttttatccttacaacaaacttcagaaatattatcatccccaggccaggcgtggtggctcacgcctgtaatcccggctctttgggaggccaaggcaggtggatcacctgaagtcaggagttcaagaccagcctggccaacatggcaaaaccctgtctttactaaaaatacaaaaattagctggaatttggtggtgagtgtctctaatcccagctactagggaggctgaggtagggagatttgcttgaacccgggagacagaggttgtagtgagctgagatcatgccactaccctccagcctgggtgacagagtgagactctgtctcaaaaaaaaaaaaaagaaatattatcatccctgttttatggctcaggaaactgaggcagcctattcaatagaactttctacaatgatggaaatgttctgtgtttctgcagtgcacagtacaatagccaccagccacacgcggatccacagcactcgaaatgtggctgatgtgactgaggaaatggattttgaagtttatttaattttactggatttaaagaaacagtggctgtcttattataccgtgcaacttggggaggtgaaatctctttgtccaaggtcaagcagtgattgagtgtttaagtcaggatttgaaacaaggcagtcttaactgctctgtgggcaccacagctgcaattctctgagccccaggtcccctgttgagttgccatccctgcttgcaatgaactctcaagtggcaccctttttttagcttggggttcccgccacctcacatagtgcctcaacttcttccttgttggtcacattgctttctcaggaccagtttctcctgtgggttcctgggcccctggggatgcgtggtcagggaggcgggaactcgccaggctccgagtttagctgcatgaagctcctggctgaccagctgaaacccgcacctcaccccaaccaccacacgtgccttgggccccatgttggggcctttcagggagacatccaccctcattagcctgtgagcttccatttattttttcaacaaatacctattgtgtacccactccatgccagctgtcttctgggaacagggccccagaagtaagttaggcagagtccctgctctcagagttcagagtgtgctgtggccacaggcacataaataataatagaggtaatgcagtgtggtcagcccttgcacggagataggcaggggctcagtggcagcttaaaactgggaaccgatgactcgactcaaaggggaactgagaaagacttctaagaggaagggatatctgagctgggtcttgaaggatgagtaggagcttgctagctagaaaagaataaggcagaacattcaaagccgagggaatagcatgtgcaaagccttgagaaaggggctcagcatttcaagtttggagtctggagggttccatgtggcacagttagagagcagggagcctcagggagaggtgcaggtggtgagactgagagggttgagaacagggcctttggagtcagactgcttggatttcaattcatcttactccatgtgaccttgtaccaccaggcttccttgagccagtttccccatctataaaaggggccatttccccgtctgtaaaaagagcaatcctcataggcttgttttgaagattaaatgaggcaatgcatggccaaagcttagcaagctgcttgactcttgtaagtcctcagaaagcattagacattgttattgacaatgtgatgtgacatgctattactgttgctgccggggctgttgctattgttatcactgctattgtcactgtagctccagtgcaacaaaggagatgggggcacattaagaagagcttcccatgcctggcaaaggagtgtggattttcttctcttggcaacagggagccctcagaggtttgtaaacggagagcaacatgattagattaatgaagaagctctctctggtcgagggtgttaggaaggggaatgacggggaggtagggaaagatgatgaaacttcatccagggcagagggtggggacagcgatttaggagatgtgcaattcatacctggtgatagattgaagctgggaagggaggaagtgggaggaggcgggaggaggcgggaggaggcggctgactgccaggtgccatttcccacctcggccgcagcagaggaggaggcccgcccactccaccagctaccacccactccatgtgcgcccctgcacccagcccccaacgcagcccttattcaggccgggtctcccaggtgtagactggtccagcccctggacatctatctcacaagactctgccatctgggcacacagtcccctcgcccttcaaccagaggcttccactccaccccctatgtttcctgcggtctctaggggttggatttctggccctcttgcccctgaccccaggggctcctcagcggcatctcccagtgaaggcctggagatgctcaccttccaccgcagcctcgcttcgttgcctttggcgccctctgccggccgcgccgtgctgctgcgtggttctcccgcccgtctgaagcagcacccactcgcttacagggtcacacctttccctgcctgtccggagagaatgtcctcagacctagccaccgtcccccccgcacccccgcacccccgccccgcaaagaccggctggcgcagaaagaacctgggtctctggcgccatctgtgcaaacggctgctcctttcccacatgtcctggcgctgagccctggcttccctggggataggggtggggctgtggtgccgccccatcccacgcctacacccacgcccacagccacctggggccgtgggcttccacggccgctcctgctccttctgttggcgtctggactcttctctctatccctgtggtcgtttctggaggccaggccaccatcatctcttaactgggtggcttcaacacagctcctcactgtcccctcccaacgtgcacacatgtacgtgggcgtgcacgcgcacacacaccatctgttctccacgtgtaatcagaggagcagttgtttttaaaagcaattctgatcatgctccccttcgtagtgtaactcaatgtctcccattgcactgatgaccaagccccaagcccttatctgggtgggcagggctgagcctgtgagccctgctgtgtcccctgctggctttcgcagaggtcacctctagggaagagtttcatcccgcagtctgtaaagtggctccctgtctttctcctctctcccggcctttcccatcctggtgcctagcttgacgctcctctgtctccttgggatcttttcctccctgtccctggagcctgggggccacctgtgttggagcctgcgttctctctaggaggctgcaggctgctggcccttcccccttactggggctgccccacgtgccatcactgcagcatgtaggcaggaacacaaacatggctgtctcctcgcagggactatcaggacccctagaatgctcacgttgagctggattatttcagggggagtcttggttacctgaaggcttccccaagatctgagctacctggtcagaggttcctaagtcagaggtttcaagctatgatcttgaaaccgctttggaggccactgccaggaaaggggacaccctcccaacacacacacccctgcctcaacccaaccaatcctgtttgaatttactggtcatctaagtgagagttctccatataattttctttggagaaagccttttgggattaaaaaatacgttttaaaacctcattcaaaattttgtcccatttcactgatacttgcaaagcactttatagctgacagagtgttttttacctgtatatttttatcttacatattattaacttcatttttactcacaaggagactgaggcccagagaggttaagtggcttgctcaaggtcaagggcaatgcttacagtgtgaacatcatggagctggattcaaacaggccttccacagtcttcctcatggcctcttgcggggaacctggtgtgtcctgaccagggcccggggcccagtgccctgcctggagctgactctgcctgtgtgtctctcccagtgctgcatcgacaactttgaggaaattgtgaagctgctcctctcccatggtgccaatgtgaacgccaaggacaacgagctgtggacacctctccatgctgcagccacctgcggccacatcaacctggtgaagatcctcgttcagtagtacgtgcccctccctgccccagagcagcctccctccacctcttgtctttttccaacttccttctttctctcctccctccctccttccttctttctctcctcccttcctccttccttctttctctcctcccttcctccttccttctttcttccctccctccctccttccttctttcttccctccctccctccttccttctttcttccctccctccctccttccttctttcttccctccctccctcctttcttctttcttccctccctccctccttccttctttctctcctcccttccccccttccttctttctttcctctcttccttctttcttttctcccttcctcccttcctttcttccctcccttcctccctttctgcctttcttctgtctcccctcccttccttctttcttcccttcctccctcctttccttctttcttcctccctcccttccttccttctttcttccctcccttccttctttcttccctccctctctccctccctttcttttccctacctgcctccctccctctctccctcccttcctttcttctttcttcccttcctccttccctccttttctgcttttcttccttcctctcttttctctttttttctctctctctgtcactctttctcagtctctcttggtgcttgtcactttctttctccccacatcctctcttcatctctctctctgcttctacctctcaccctctcctcccctcagttcccctttactctccccatctctgtgtgcctgttctgctcttttcttcttctatctctgtctctccttcactcttggtctgtctctgtattttccagtctctttttattttctctcttctcctttcattctccctttccccccaattttttatagtgataaaacacatataacataaaataccatcttacccattttaagtgtgcaggttagtggtattaagtacattcatattgttgtgcagccattaccactctccatcttcagaatgactttcatctcgcaaaactgaaactctgtacccatcaaacagtaattcccattccctgcctacccctggctcctggcgaccaccattctactttctgtctctatgaatttgactactgtaagcactttatagaagtggattcagaaaggccgggcacggtagctcacgcctgtaatctcagcactttgggaggctgaggcaagtggatcacctgaggtcgggagttcgagaccagcctgaccaacatggtgaagtcccatctctactaaaaatacaaaattagccgggcatggtggtgcatgcctgtaatcccagctacttgggaggctgaggcaggagaatcgcttgaacccaggaggcggagtttgcgatgagctgagatcatgccattgcactccagcctgggcaacaagagcaaaactgcacctcaaataaataaataaataaatgaaaagtggattcagctgggtgtggtggctcacgcctgtaatcccagctactcaggtggtggaggcaggagaatcgctcgaacccaggagactgaggttgcagtgagccaagattgtaccactgcaatccaccctgggcgacggagtgagacaccatcttaaaaaaacaagaagtggattcatacagtatttgtctttttttgactggcatatttcacttagcataatgtcctcaaggttcatctatgttgtagtatgtgtcagagtttccttcctttttaaggctgaatgtactccattgtatgtctataccacgtttcacttatgcatccattcattgatggacacttgggttgcctccatgttttagctattgtgaatcatgctgtgacgaacatgagtgtacaaatatctcttgaaatcctgcttccaattcctttggttatacacccagaagtggagttgctggattgtatggtaatgctattttaaattttttaaggacctgctatactgttttccacaacatgttacattcccaccaacagtacacaaggattctagtttctccacatcctcaccaacacttgctattttctgctttttcttttttgttagtagccatactagtagatgtgaggtggtctctcactgtggttttgatttgcatttttctcgtgatgagtgacgttgagcatcttttcatgtgcccgttgtccatctgtatgtcttctttggagaaatgtctattcaagtcctttgtccatgtttgaactgggttgggtttttgtcattgaattttaggatttctctatgtattctggagatgaatcccttatcagatagacgtactattttctcccattctataggatgtctttgaaatcactgccaaatccactatcatggaggttttgttctatgttttctcctaagagttttatagttttaggtctttcatttaggtcatgggtccagtttgaattaaatcttatatatggtattgggtaaggatctaacttcattcttttgcatgcggatatccaattttcctacactatctgttggaaagatggttggtcttttctccattgaatggccttggtaccctgtctaaaatcatttaaccgtgtatgtgagggtttgtttctggactctattctattttattggtctatatgtttgtctttatgccagccccacactgtttgatgctagagttttggagttcgttttgaaatcaggaagtgtgaatccgccagctttgttcttctttttcagggttgtgttggctattcaggttccttgagattccctatgaattttagagtaagctattctagtctgcaaaaaacatcattggagattacaggtggctgacacctgtaatcccagcactttgggaggccaaaatgggtggaccacttgaggtcaggagttcgataccagtctggccaacatagtgagaccctgtctctactaaaaatacaaaaattagctgggcgtggtggtgcacgcctgtaatcccagctactcaggaggctgaggcaggagaactgcttgaacctgggaggcggaggttgcagtgagctgagtttgagccactgcacaccagcctgggtgatggagcaagaccttgtttcaaaacaacaacaacaacaacaacaacaacaacaacaatcattgtgattcttaaaagtaatggcaagaaccacaattacttttgcaccaacctaaataataattggtatcacccagagctgggcactgggcacacagggatgcagaagtcctggggagccaggaagaaagccaggggttttaagtaccagagctgagacagagccagaccagggggctgatcatctgagggcaaggagtcagagagagtggcccagggcaggtaaccttttgcactggtcttggcagagcggcaggagcccatcgttggctcccggggggatggatatgacagtactgctgccccagctcagagagctggataaacttgctctggggtgtacgaaagctcagagaagtcacagtggagggctgttaggccaaaggactggatggtggcctgtgcctatgtctctgatgggaacctgagtatggctaattctgctaggagcatcagatggccacagcctgatcagtgatggtgctaagaggacaaggaaagtggtgccagcctgggtcagtgggtcccaaagctgatcggtattacaatcacctggggcatgggtttaaaacagattcccatgccctaccccaaggactctttcaggagggctggagtgaagcccacccaagatgctgcattttattcccatggtccccaggtaattctgccacatggcatccagggccattcttaggaaccactggcccaaagggtaaattcttccaaggagtcccaggtctccattcttctacctctgtactatcagccttttgagtagggacttggaggaggtggaatataactgaggatgtttctgcatatgggcaaaaaatgaaatagaacatggagaagtaaaaagaactaatatgagagacctggttttgagtctggactctactgtatccaagctgtgtgaccttggacaagtgaccgaacctgtctgagtctttttttttttttaaacttgctctagtcttgctctatcacccaggctggagtgcagtggcgtgatcttggctcactgcaacctctgcctcccagtttcaagcaattctcatgcctcagcctcccgaatagctgggattataggctcccacaccacgccccgctaatttttgtatttttagtagagacagggtttctatgtcggctaggctggtctcgaactcctgacctcaggtgatccgcccgcctcgccctcccaaagtgctgggattacaggcttgagccactgtgcccggtcatgtctgagtctttgtttccccttgcgtgagatggggccaacagtattaacctgagctattataagggttaaataaaaggatgcctgcaaaaggggcttagatcaggtttggctctaagcaagtgcctggtaagtggtgctgctgccattaatgtgatttttgttattgtcaccaggaggacttttatatctgtccctaagtccctgcctgctggttcaacagagtgaaaggcttagggaggtcttctgggatagctgtcctgggactttggtctcttcccacctgggaccctgggatcctgaagctgtcgtgctcttgggctgtgtgtcaggcagatccaagcatcatcttgctggggtacaccttggtggggttttgagtgccgggttgtacagtaggattgcaggcgagaggccagagggcagaggcagctagaccaaccctagccacacctacttggccctcaccctgcctctttctctgcagtggggccgacttgcttgctgtcaactcggatgggaacatgccatatgacctctgcgaggatgaacccaccctggatgtcatcgagacctgcatggcataccagggtaagggagggcagcctgctatgaagtgagcacagcacagagttgcagagagcgtcccttaaatcaatgcaggcgaacagattagctacgcatcggcctgcctcgtgcgctgtgctcagtgaataggatgggtccccattcatatccttatctgtgtgattatcaagagcaggacatgagaggaccctggaaaacatgctgcgcagaagggaggtattgatctcattcgtgtcacccacacacgcaggtggccgcagctggccttgtctcatcttcatcagctgtgacaatttgattcaataaatgttcaccataaagatatattcctatgtgggacaataataaagtcaagaatactggagggtgcctgctctgtgccaggcaccacgctggctgccaggggcccagataaacaagatgtgggctgttctcaactcacaaatgaggttcagaaaggaaacagatgcagcaatgagagacctgcgtgccccagcaccccacagatagacctctgaagcgccacctccttggaaatatgtcacatccccagatcctcagctgcagctgcagtcctgccctggccctgcccttgtgtaccccacagagcctcagtaaccgtgattgaatgtcttgttccttgcacccagatcttcctattcatctcctgcagaggttcttaaccatttttgtgccaatctggtgactctatggaccccttctcagaataatgtttttatttttttgagatggagtcttgctgtgtcccccaggctagagtgcaatggcacaatctcggctcactgcaacctctgcctcccaggttcaagtgattctcctgcttcagcctcccaagtagctgggattataggcatgcaccaccatgcccagctaatttttgtatttttagtagagacaggatttcaccatgttggccaggctggtctcgaactcctgacctcaggtgatctgcctgcctcagcctcccaaatttctgggattacaggcgtgaacccccgcgcccagccagaataatgtttttaaatgcagttataaaagtataggattataaaggaagccaattatattaaagcgtaagtaccaaaacatttttcaatgtgttagatagaaacttcgttaattcattaaacaataagataacaggatatgaaaatagctatagtatctgttggtaacaaagttacaggcactgctaacactactgtgggttttgcttacattctaatggtagggaatactcaatttcgtttaaagcttagtcaaaagaaatgtgtgattttatttcctccttttgtagatctctcctgaattcgatcgaacagtgcttggtctaatggatctttttacggagcatgtcatcctctccttaaatactgtttgtagctgtcagtaacacacttttaagacaggaatgggattcgggctatacaatgtctctctgggcccctacctcaattgactcagctctccacttgaaagtaatacattcattcattcagtccttctgcaactaaaattgattgagcgttgtgccaggtgctacagacacaaccatggttaagatgaaggaaactaacagagaccctggtcagatagggtggtcagcagaggccagcttgggagatgatccagtccaggacctaaagaataagacagaggcagccatctgagcagttggaggtgtgtaggtggatggtaaggactttcaggtagaagaacagcatatgcaaagtgaccaatatgaatccattgcctagtgggtgccaggcaggaatgcccttgctctgtgggccaatgcatggtgtctcatcaggcctgaagacaatgatctatgggcatgtctgcatgcccgcttgactggcatatcctagggaacaagagccatgcctccctcatctgccttcccctgccctctggggtcgtaggcctgagggtgctaaataaatcccctctttcccactgcaggcatcacccaagagaaaatcaacgagatgcgggtggctcctgagcagcagatgattgcggacatccactgcatgatcgcagcgggccaggacctggactggatagatgcccagggtgccacactggtgaggagatgggccagtaccaaaaccaagaccagctaggtccgaagtgggccagcacctggtggggaccaaccctgtacccttggggcctgtctgtgaccttggacctccgcaagaatccttttgggccaggattgcccctggatagggagggtcagcagagcagggctcagcctctttgagaacctggcctctctctgggctgggcttggtggctcacacctgtagtcccagctacctgggaggctgaggtgggaggatcacttgagcctgggagtttgagtttgagttgtgattgcaccaatgcactctagcctgggtgacagaaagactttgtctttaataaacaaacaaacaaaaaagaatccagccactctcaagtggggcttggagttaggagcctgggtcggagacctggctcccacctgttcaccaactgctctgtctccaagatattccttcaccccaggcttcatgtgtccatcttgagctccttatttccctctcctctaatgatgtcctccattaaggactggtgtcaccattcacccactcactcgtgctttcttgctttgcactgtccattcccctgccttagtatcacctctcctaccctagcaccccactgccttgcctcatcagctcccctgatattactgcaacagcctctcctttgggttccctgacttcagagtctgcccaccactcccagtcatccattcatccattggtccatccaaccatccatccatccatccatccatccatccatccgtccgtccgtccgtccatccatccatccatccatccatccatccatccatcattccatccatccatccagccatccagtcaacacacagttatgagcacctcctctgtgcacatactttactagaccctggagacagagaacaatgggaccttcttctctctcaaatccgcctggttaactccactcatccttgcagctcaagtgtcactgacttaggaaaacctccctggccactcctcataggctctcagagcacactgcagcctaatattggggaggtctgcttctgcaacctgtaagtcaaaattcagagcatggctatggcagcctaccccactgactggggggtgggtgccctgtcccaggcttaggttccacgctggtcgtaagcactcagcagtctcgggatctcgagctcactagatagggctcagcagtaccagatatcctcactgcccctcaggcctgacctggcagcccaggtgtgataagtgggcttctcccacctgcttcctgagctctcacatctgttttatgcccatttctattacttgggtgcctgcttggatcacctgctcagcctagcactcaagaatggggtcaggtaggaagtctgactatttctgtctgaagtcaaggccaggctgcactagggcattacccagcctcattgcagctccaatggggctgtcattgggtcctctagacacagggatcttctctacctgggctggggctggcctcagggtggccccacccccatgggctgggcatatactaggtctcaggtcttcccagtaaactggagatcatagtgtcttcctcacagtgttgctgggagcattaaatgagattctgtgtgaaagtgcttagcacagtctgcaaattctcaatagatgttagcaatgaccattatttttactaacaatgccactattccactcataccttttcatttccagccaagtagtgaggtttgtaatgtcggactggccagcaggtgtcattctctacaactgacaagcatcagacatttataaatcagataattatactaattttcacatcatacccttgctttttcaagttggaaaaaaaaaaagcttcaagcaaccttctcccaggatgaggtggcatctgaccatcagggctgtgttcagaaggatcacttcctgaggccatgccttctttgtcccactgactctccagcccaagacctcaggcccccgaggttctctggcttcctcccagctagtcttctgctagccgccttggactctcacttctatctctcatcttggctgggcagttgatgtctttttgccttatttccttctctctccttcattcattctcatggtcatcatttaggactctctaagaatgtgaatcccttactgagtgttcattatgggctaagctatttatgtattttgggggcaaattgaacaatcatgacaactgaggtctgccaggcagtggccatgactgaaggccttgaatgggatcacagtccctcattggatgtattatctattgctgcataacaaactaccccacaatgtagcatcttaaaacaataataaatatttattgtctcacatggtttctttgggtcagagagttaggaacagcttaactgggtggctctggcttggtggctctcatgatattgcaaccaagatgttgcaatattgttgagactactggggctgcagtctcatctgaaggcttgactggtactggaagatccacttccaagtcagttcacacacatggctggcaagttagtgctggctgttggcaggaagcctcagtttctcacctctttaggacctctccttgaggcttcttgaggatcctcacaacatagtggctgccttcttctagaataattgatccaagacaacataaagtagaagcagaaatgccttttatgccctagcctcagaaatcacaaacaggatattcacaatatcctacttgttagaagtgagtcactcagtctggcccacattcaaggtgagaacagtcaggctccatcttttaaaggaagatgtgtcaaagaatttgtagacatatttaaaaatcaccatattgaacctcagagaccccttcttcagggctcaatgcacagtaggggctcagtaaatgctatcgctttaaccacatggatgctaagaccaaccacaggggagaagaattcagctctctacctttccttttaagtccatatttcagacttaataatcctctgcaatgtgactggtatttccatttcattctattccattctactggccccaaggatgctgtgggagttgggtgaaggtgagagctagcctaccgtcaatgtggggctgatcccctgaggaatgctcacttctttcctctcctccagctgcacatagctggagccaatggatacctgcgggcagctgagctcctcctggaccatggagtgcgtgtggatgtgaaggactgggatggctgggagcccctgcatgcagctgccttctggggacaggtagttctcacccacagggctgtgggggaggccggcacagggctaacctgctgacaccaagttttttgggctggcagttgttttcaaagaacataagactttaaggcttaaggtgttgaatatagctcatatgtgggatatgaaaaggcctagggagtttgcaaaaaacattggacaaagcaagttgtgttttttttttttttttttttttttttttgagatggagtcttgatctgtcacccaggctggagtgcagtggtgcaatctcatctcactgcaacctccatctcctgggttcaaacaattctcctgcctcagcctcctgagtagctgggattacaggcatgtgccaccatgcccagctaattttttgtatttttagtagagacagggtttcaccatgttggtcaggctggtctcaaactcctgatctcaggtgatctgcctgccttggcctcccaaagtgctgggatgccaccatgcctggctgacaagttgtgttctaataggatggtaatcaaatttgccaaataagaaaattaccagcatttttgcttctagcagtttctccatttgtttccagatacaaaactctgattgtcacttacacctagtccctccttagatacctgccagctctagagttacagccaactctttcttctccttcttcttggtgtggcccaggcatgtggaggaggtgctaagctcattgcatctgtctggattccccccatggctctagtttgcaggccttccctggaaatcaactttgtcccaccattctttgggtcacatcctaagaggccttgggcactctctccacctcctaggctttctgagctctgggcagggggacacatgagcttcttcctgtgtttcagatgcagatggcagagctattggtgtcccatggagctagtctcagtgcaaggacatccatggatgagatgccaataggtaagtccagcacaatagctggtgtgcacaaataggcagttatcaatgttttgatgggtagagggagaaatagataaatatatggttgtatagattgatggattggtgtctagatagatagatggattaattaatggatggtagatgaatggacggatggacagattaatggatagatggataaatggatgaatggatggttgaggtggtagatgggtagatattatgaggtctggttgaatggatgggtgggtgggtggatggatggatggatggatggatggatggatggatagacagaaaaataagtggatgagtgggtaaaggatgaatctatgaatacatggctcagtcagcaataggtagatagatggatgaaggggttaggtagaatagatgggagtatgtagctttattagcatctttgcataatttattgcttgggctatgtggggtacctgcttggggactcttcttggaaactatcaaagagcaacatgaatccctcggtcatagctgggaagcttaggaattgtgactgtgcccagaacctgggtttcccattcttataatcctcttataaacacactcactcaactttggctggcattgttttcttgcctccctgcatgccctgaaagatgcttggagttttcagtgggttggggtggcagctcctctggtctggagcaccctcttgcgccacaggtcctggccccgtcccccacaacagactcctctgccccttcagacctgtgcgaggaggaagagttcaaggtcctgctgctggagctaaaacacaagcatgatgtgatcatgaagtcacagctgaggcacaagtcatccttgagccggaggacctccagcgcaggcagccgtgggtgagtccggggcagggcagccaggagtccctgtgtgtgctcctgcctgtggtgcctgggtgcagcctctaggacccactttgtcctctcaggaaggtggtgcggcgagccagcctgtcggacaggaccaacctgtataggaaggagtatgagggagaggccatcctgtggcagcggagtgcagctgaggatcagcggacctccacctacaacggggacatcagggagaccaggacagaccaagagaataaggaccctgtgagtggcctcacgccctgccctagtgtcagccactgcaatgggaggagaacagggcccagcctggccttgcctcttcaactgagagccttcagagggaagtagccaggcactgcccttaaactagcatatccagtctgatgatgatggctactgtagttaaaccagcagattcagtctgatggtggtggctgctgtagttaaggaggtgatcggggagtgtgttagaggctgagctgggtgctttggcacacaggtaggtctcctaattgacagggggtgagtgtccgctatgcgcctagctgtgctccagcacacctagcagtggacttccaaggagagagcttcagtagggcagtcacccaggagctgagggtgctacaacttctttttcaggaaatataacaagatattgagaattgtgtttatcagaacatgttttttgaaaaatggagtaggatcctagtaggacctctgagaagcctgctcctgtagcagccaatggtcctttaagctttaagctgctttcatttctgatggctgctttaagaaattatcacaaactggatggcttaacatggtggaaatttattctctctcagttctgaaggccagaagtctaaaatccaggtaacaccagcattggttccctctgggggctctcaaggggattctgttccacgcctctgcgagcttctggtggctcaggcgttctttggctcttgctagcaatgattctagtctctgcttctatctccacatgacctttttcttcgtgtgtgtgtgtctgttttctttttttatttttattttattggttttttttgagacagggtcttgctctgtcactcaggctggagtgcagtggcatgattatagatcactgaagactccaactcatgggcttaagcgatcctcccacctcagcctcccaagtagctgggactataggcgggggccatcacgactggctaattttcaaatttcttgtagagatgaggtcttgctgtgttgcccaggctggcctcaaacttagcctcaagcaatcctcccaccttggcttcccaaagtactgagattacaggttcgagccactgtacctagcctgttttttcctcttatgaggacaccagtcattggattggagcccatgccaatccagtatgacctaatcttaatttaatttattacacctgcaaatacctatttctagataaagtcacattcagagattccaggtagacatgaatttttgagggacactacttaacccagaaccaacacactcactcagcatggctgctttcttgctgagtggagtgaacaagtttggggctggagtggaattgctgaggatgagggagaagttaactgtaccagaagtggtctgccattttcgttcttccactacaccacgaacagatgaaaacatgcctagagagtttagccttggtgggatgaaattgattagctaccgagcatgcccacgtgtctcagagggaccctgcttcccagcacgaacagtggggtcacctactgcctgtctcaccaggaggtgtgaaggtgcctgcccaaggggaggccacatcaaagccaccagctggtgatggagagggcacgtagggaagatttgttctgcctggccccttagtctgaggattggtgagaaaagagatgtagatcagtatcaaatcacatttcagatgtctcccagctgtgctttatttatttttcctttgtgattgtggtgtaacttaagtatggtaaagcagacaaatctttttttatttttttatttttttatgatatggagcctcgctctgttacccaggctggagtgcagtggtgtgatttcagctcactgcaacctgtgctcccgggttcaagcgattctcttgcctcagcctcctgagtagttgggattactagtgcccgccacgacgcctggtggatttttgtatttttagtagagatggggtttcaccatgttggccaggctggtgttgaagttctgacctcaagcaatccttacccacttggacctcccaaagtgctgggcttacaggtgtgagccaccatgcctggccaagtagacaaatcttaaatgagattttcaacaaccttttacaaatgtacacactcagatgaattcatagagcattttcatcatccatgttctctctccgtcctttcccccactccaaatgtagtcactatttaactttgagttctaaagattaattttgtatatgcatatgaatgaccctgcagtttctttcgtgtctggctttttttacatctgtgagagtcacccacgttgtggcatatagcagtagtttttttttgttttttttttttgagacaggagttcactctgttgcctgggctggagtgcagtggtgtgatcctagctcactgcagccttgacctcttgggatcaagcgatcctcccacctcagcctcttgggtagctgggactataggcatgcaccaccatgcctggctaattaaaaaaaatttttggctgggtgccgtggctcatgcctgtaatcccagcactttgggaggccgaggtgggtggatcacaaggtcaagagatcgagaccatcctagccacatggtgaaaccccatctctactaaaaatacaaaaattagctgggcatggtggcacgcgtctgtagtcccagctactcaggaggctgaggcaggaaaatcacttgaacccgggaggtggaggttgcagtaagccaagatcgagccactgcactccagcctggggacagagcgagactccgtctcaaaacaaaacaaaacaaaacaaaacaaaattttttagagatggaatcttgctatgttgcccaggctggtctcaaactcctgggctcaaatgatcctcttgcctcagtctcccaaagtgctgggattataggcacgagccactgtacctggcctcattcttgttttttttttctttttctttttttttttttgagatggagtcttgctctgtcccccaggctggagtgcattggcgcgatctcggctcactgcaacctccatctcccgggttcatgccgttctcctgcctcagcctccctagtagctgggactataggtgcccaccatcacgcccagctaattttttgtattttcagtagagacggggtttcaccgtgttagccaggatggtctcgatctcctgacctcgtgatccacccgcctcagtctcccaaagtgctgggattacaggcgtgagccaccacgcctggccgcctcattcttttttattgctttctagaattcgattgtttgaatattaaaatttacatatccatgctcctttttttttttttttaaattgagacagagtctcgctttgtcacccaagctagagtgcagtggcgtgctcttggctcactacaacctctgcctcccaggatcaagcgattctcctgcctcagcctcctgagtagctgggattacaggtgcgtgccaccacgcccggctaatttttctatttttagtagagatggggtttcgccatattggccaggctggtcttgaattcctgacctcaaacgatccaccctcctcggcctcccaaagtgttggtattacaggggtcagccactgctcctggcctccattctccttttggtggacatttgggtttcttgtttctggctcctgtgaataaagctcctataaacatttttgtacatgtcttttggtggacataagcactattttgtgttgggaaaacacccaggaaagcagctggagtcacgggtaggcatatgtttagctttagtggatactaccaagcagttttccaaggtgccttgtacctgtctgctttcccatggcagagtgtttcttgccaacccttggtatagtcagtcttttttttttttttttttttgatacagagttccgctcttgttgcctagcctggagtgcaatggcgccatctcggctcactgcaatctccgcctcccgggttcaagtgattctcctgtctcagcctcctgagtagctgagattacaggcacctgccaccatgcccagctaatttttgtgttttagtagagatggggtttcaccatgttaaggtgggaattctcaaagcatggtccctgtaccagcaacatcagcatcacctgggaacttgttagaaatgcagactttggctgggcacagtggatcacaaatcctgtaatcccaaaactgagggaggctgaggtgggaggatcttctgagcctaggagttactggacaacatggcaagaccgtatctctaccccccaccaaaaaaaaaaaaaaaaaaaacaattaggtgggtgtgatggtgtgtacctgtagtcttaggtcttgtgaggctgaggcaggaggattgcttgagtcgaggaattcaatgctgcagtgagctatgatagcaccactgaactccagcctgggtgacagagtgaggcgtggtctctaaaaaaaaaataaaaataaataaatgtagattctcaggacccactccagatgtggcgatactgctgcacacaagaatttcagaaccacttatttgaggaataatttgttcagcctgacccccaaatcacatttcttccaaggctgtgccctgttagccttcagggatgactttggttcactgttttttgtttttgtttttttcctctgagacaaggtctcactctgttgcccaggctagactggagtgcagtggcgcaaacttcgttcactatagcctctgcctcccagattcaagcaattctcccacctcagcctcctgattagctgggactacaggcacccgccaccatgcccagctaatttttgtgttttttggtagagatggggtttccccatgttggccaggctggtctcgaactcctgaccttaagtgatccacctgccttcgcttcccagagtgctgggattacagacatgagccactgtgccccttgttttttaatctgatgtttaagtagcagtacagacaaactaaatcagaatctcaggagttgggacctcagcattgtatatgtttgtcattggtgtttttttttaattttttttagatggaatcttgctctgttgccaggctggagtgcagtggctcaatcttggctcactgcaacctccgcctcccaggttcaagtgattttcctgccttagcctcctgagtagctggaactacaggcgcacgccaccatgcccagctaatttttgtatttttagtagagacggggtttcaccatgctggccaggatggtctcaatcccttgaccttgtgatccacccgcctcgacctcccaaagtgctgggattacgggcgtgagccaccatgcctggccatgtcgttgttttttaaagctaaagagagactgtttttgaagtgattgcagcagtaagtagaatgcatcgaccacagaattggcaagatcttggaggtcaaggagaaaggagttcgtttcctagggaggaagacagaggctgcaaggactgagggttgggggtgggatgagcaggtggtgtaattggacagttgaccaggaatgtgtgtctggtggtcagcccatttccagaacggtcttcaggagagtttttctgcattgcagtgcttgtttaccctcagggtgagtcaaagtccaggatcctgtggggaggggagcagcttaactaaaatttggttaaatcatttaccgctgggcgcagtggctcacgcctgtaatcccagcactttgagaggcccaggcaggcggatcatctgaggtcaggagtttgagaccagcctggccaacatggcgaaaccctgtctctactaaaaatagccaggcgtggtggcaggtgcctgtaatgccagctacttgggaggctgaggcaggagaatcacttgaacctgggaggcagaggttggagtgagccaagattgcaccactgcactccagcctgggcaacagagtgagactctatctcaaaaaaaaaaaaaaatcatttagcaagcatttaatttcggttgataaattgacagtttaatcatttcagaggaaaagaatgagaatttgggggactgtgtttgggttgtcctaggaaaaggaggggtcgtctgagcgttctggaaatcctatggggaagggtgattctgtgcagtcagccattccccagaacacaaaatgtgggggttttgtttaaccttcctgttgtccagtatctcagttcaacattgccaagatgatggtgcctaccacaaagggtgttctagggtcaattgtgttcttatttgtatagaactcagcccataatttgtacctcattaagcattaggcagataagtacatttagaagttccctgcatcatgagaaaacctctttcgtctaacccacatccttcaggctggagttaattcctcttccttcaatgctctgatttctgacactggagatggatataggtgggttttgttttcttttgttgagacagggtctcattctgacagggtcactcaggttagactgcaatggtacaaacatggctcactgcagcctcaccctcctgggctcaagtgatcctcctgcccagcctcccatgtagctgagccacaggcacgcaccaccatgcccagctaatttttaaatatttgggtagtgatgaggtctcactatgttgcccaggctggtctccaactcttaggctgaagccatcctcccacctcagcctaccaaagtgctgggattacaggcatgagccactgcacccagcagggatttttttctttttaaactaatagattttttttttccgagcagttttagaactctagaaaaatgagtggaaagtacagatatttcccatatacacccccctccaccctggtttcccctgttattaacaactagcattagtgtggtacatatgttatcactgatgagccaatattgatacattattatgaactaaagcccatagtttacatcgggtttgctctttgtgtcgtaactcctgtgggttttgacaaatgcataatgtcatgtgtccgtcatgatagtgtcacacagaatgctctcgccacttggtttaggtggttatattagacagttgagattgtgaacaactggtgaaagagaccagggctgtcccactaaacagccctggtattctacttacgcttcctccccaaactctagcaatcactgatcttctactgttttcataagtcttgcttttccaaaatgttatatacgtggaattatataatatgtgatgctttcagattggtgttctatatggtttttttttgagacggagtctcactttattgcccaggctggagtgcagttgtgcaatcttggctcactgcaacctctgcctcctggttcaaacaattatcctgcctcagcctcctgagtagctaggattagaggcctgcgtcactgcgcctgtctaatttttgtgtttttcttttagtagacacaaggtttcaccatgttggccaggccggtctcgaactcctgacctcaagtgatccatccaccatagcctcccaaagtgctgggattataagcgtgagccaccacgctcggcctgtacatgtttttttttaactgtctagatgatgccaatgtgcatccaagatgggatcagtgtctcagatctttgccactctaagcatcagcaggaaattcttagaagtgccaaattgcaggccccaacccagacctattgaatcagaatatggattttaacaatatccctaggcaactcacatacacatcaaagtttgagaagcactgactaggaccaccaagaaacggtctctccatgacatggcatcagtctgcctgcatagttcagaaggagccattaaaaaaaaaaaaaaggttggactcggtggctcatgcctgtaatcccagtgctttgggaggctgaggtgggagaatcatttgagaccaggagttcaagaccagcctgtgcaacatagtgaggccctgactctaaaaggagaaagcgaagaaatacacactcataaatggaaacttactatggaaagtgttctttgccttatcacatattaccatatatatatataacatatatatgttatatatgttatatatgtatgttatatataaatacatatatatgttatatgtacatatatgttatatatgtacgttttatatatatttatatatgtatgttatatataaatatatgttagaaaactagattataaactagattatatatatatatcttggacatctttccatgccagcttgtggagaattccttcattctttttgccagctacagagcatgccaatagaagtactggccacagtgtcctgcttgcccaatgatgactttcaggctttgcactaatgagagagaaaatctgtgaaatgggcttgctggtgcaaagtatacaatcttttctaaaaatttttatcattattattgtttttattttttactgaagagctggggagagaagaaaggaaaaaaagaaaaaaatttcagtgaaggatgatgcaaaactgtccatcaaagagactgtagcaatttacattctcacttatttccccatacccctgccaacactgagtaataacacactttaaacgtatttgtcagtgtgatatccaaaagtgatattttgttgttttaatttttatagtattaacgattagtggggatgaatattattccaatgccatgtatatctatatattttgctgtgggctacatattagtatcccctgcctactatttttattgggtagataggcttttaaaaattgacttttggctgggtgcggtggctcatgcctgcaatctcagcactttgggaagctgaggagtgtggatcacttgaggccaggagttcaagatcagcctggccagcatggtgaaaccccatctctacaaaaatacaaaaatttgctgggtgtggtggtacgtgcctgtaatcccagctactcgggaggctgaggcaggagaattgcttgaacccgggaggcagaggttgcggtgagcagagattgcgccactgcactccagcctgagagacagagcaagactccgtctcaaaaaaaaaaaaaaaaggacttttaagagctctttatacttttagaaaattagtctcttttctgtaatatatgttgaaaatattttcctagtttcttcatgtgtcttttgaccttgttccctgttcatggtgatttttgctgtgctttaaatgttgttgcatgtatctattttttagtttatagtttttaggaagcagctacttttcaaactcttgttatccaaggattattaggtgtacaggatccctgggtaagaatctttgtgagatatgcttcatatacagaggaaggattacaagtgactgaaaaacccaactcaaatggacttacacacaaggaatttattggcttgtgcaactgaaaagtctgagcctggaaggatcctggacttcaaatgggtcatcaggatgcagtctctcttagcctttcttcatgccaactttacttgcaagcagacccttcaacatagtatctccccagccctcagcttacgtcattcttactacccacagttcctacagaaacttctctttcccagttgttctagcaaaagtcccagggttgcttcactgaagcaatttcagttaagaactcatccctgggccaatccctgtagtgaaatatgttgactagctaggccttgggtcatgatccaggccctggagcaaggccaggggtcggtcaactgtacggaaattcatagattgggggttccccaaaggaaaaccctggccccgatacccagggagagaaaacagatagaggaaaagtccaaacaataatgccctcagcagagagacaggtggatagtaggttcagatcttccagccagctggtaatgttgtccttctcactcgcagaaccccaggctggagaagcccgtgctactctccgaatttcctaccaagatcccacgaggtgaactggacatgcctgttgagaatggcctccgggctccggtcagtgcctaccagtatgcgctggccaacggggatgtctggaaggtgcatgaggtgcctgactacagcatggcctatggcaaccctggcgtggccgacgccaccccgccctggagcagctacaaggaacagagccctcagacgcttctggagctgaagcggcagcgggctgcagccaagctgctcagccaccccttccttagcacacacctgggcagcagcatggccaggacgggcgagagtagcagtgaaggcaaggcccccttgatcggaggcagaacttcaccgtacagcagcaatgggacctcggtatattacacggtcaccagcggagatcccccactcttaaagttcaaggcccccatagaggagatggaggagaaggtgcatggctgttgccgtatctcctagtctccgtgtgatggaggagggagatgcctggggaggggctcctggaatccaggccagcccaacagccctggctggggaggtgtcagggcagctggggagaggtgggctctgcttttcagaggaactcagaccccagccctcagctggctgcccatagcatcccatgtcccacgtcccgtggttctgcttcctgctgcatcgtctgccatctgacacaaggcctgtcgtggcctcctggttcactctgctgtctgatcttgggagggtgggcttgagatcccagctctattcttggtataaaggcttctccggatcagtacatgcatgtcacattaacacacacacacacacacatatacacacacacacaagctcgatcagtgtgtgtaggaatgacatacctgggctcaggggaagcaagggggcttagaatttgtggggtattcccaaaaggatggaagttaagactcagagtctcattaccactgccaatgtggttttagcaggggaggggacctgctaagctgagacccatagtcctgctcagagttatcccaaagtctgagccaccagccacacctgacaggggtgagaagtcctcgctgtgttcagagggagccaggaatctacatgggtagatgagatagacacagacctgctccccgcagccttgttgagagccacacttctgcccatgccaggagccagctgtgtgaccatccaggggtggagggggaaaaccaggcaatttcgttcctggaatcaaccaaatcatgttttcctcttggatggaagtgtcaaaggcagaagggtgtgggagggggacaaggtcagtatttaccaaagtgtatctgattttaaaaattcctttagtctgtaaaactcctagagggagggaggtaactgaattcacttctttttgtggatcgtatcaaggtcactgggttttactggctggtgctgggaaaatgaagctaagtgaggagcttccattggaatgcttttccagggagagaggccagttaatttaaaaaaaacagtcgctagttaacagcgacagagcccagcaccctggggtctttgtgaatatccagactgtttcagcccagcccatctcagccaaccctccttagactgagctgtcagagcaagcaattaggggccagcctgcctccacctcccacccccttccacctccatcagtcatgtgtgcagagtcagtgctcgggatcccgggcccagcttttgcctttttggggatgcttggtgagacagatttgccagtcagcccttttgagttcccgcctcacccaggggctcccagcctgcacttgcaggagtggtgatgccccaagtctgcgaatccagggtgcacgtggtcaatatcccctcctgcattcaggagagccatggtagggctagagttgggtcttgcccagccctgcagtttcatagtcccagccttcctggtgctggggagggaggactgtgaatggctgttctcccctcactgctgagtctcccaggaccccctttggagatgcccatggcatgggcactgcccacaggctcagccagaacctcttggtgtacccgataagctgcaggttatcccttgctctgtgcgccttttatttgtccttaaactacctccttagagctctgaaggggtctcctagttccagattttaatttggggaacagatctgggttctttttaaccctcttctttctcagtctatgagaaacttgccctgaggggcacctgggctaggggcttgggactggaagaccatccccgccttgtgccacaactttggtcatgggatctgctctttgtcattcttagccccctactgtggcccccatagccccataacccagagagggagctggacttcagggagcctgagtgatgctttcccaggagcagggcagctggctggaccagaaagtagagggcccatgggagtgactgcacccttggtggctgctggaaggggagaggttctcagcatcaggccacctccaccccaatgccaggatagatgtattctagagtaggggtggaggcggcccaggaggctgaagacaggtgcacagatgcttcccacgaccttgccatttggggtgggctcttcaacatctcaggctgtggctggaacaggacaggatgatctaaaacacacgtaccattggctgtaaaacagtatgagcccagactgacgctgaaatccctcatgagccaaccttagctacaaggtagggagttctgagggaagccgcgtgctcctcaggagagagctgtttaggttttccgatctttttgctcaggggccaaacactgaaggcacgtactgcccaacccactgagcgcctgaggccattccctccttttccgcatgcctcctgcctcctgggctattcctctccacccagaaggctgggaatcccagctgattccctgacaggagccgacttcacacacaggtgactctcaggcattggctcatgttttcagccagggataaaccatcccttcttggggctttaagtccctggggagctttccctgtaggtctcctgggtgttgagagacaagttggagaccaacctccaatgaatgagccgcggtcattcattaattcactcacgtaatttactgagtagctgcaacatgccagcctctacgttaggttctgcggataaaggaggaataagacagagtcaggagaactgttccttgtggtttccgtcccttggggaccacaggcatcagcagtcccattcaagtcacctgaggcaaagtgtctgcatcttcgtccagcgaccctttgcttttcggctcctagaatccttagagtctgaattcctttagctgggaacagctgtcatggtcacccctggataacatttgccaccaagtatagatgctggatcttgggttccaggcagacatcatccaggtccatctggaactttcagtgatagctgccttcagccagcatctttgggggactctataatagcagcttgagatcagtgtctagaagactgttctgcaatttgctgccaaatgcatctcaggtttttaaagtcattgtttcttgctcatggtggctcatttattacatagtcccctcaccccactaatggataatgggaggaaaagttgctgcttccttcagcatcaaagcctttccttgggaatctgcctccctccatggcaggggtggattcgggagctgggagtaaccaggcaaagtcaaccagatgcctagctcctgctgagacccaggtcctatggcagctcctcattagattaaaggagaccacttccaaagcaggtgctgcatggctcaccatcatatgccccaaacaactgaaagttggcggttatcaccagactgtgagtttctggcaagtagcttggggaagctgaataaactctaggcccagggctactaaagacttcaggatagaattctccatcaaatatacagcataagtaaaactgctctgcactgtttaatccatttccaaggggcttagaaaagctaacaagggtgtgtcccctgtcctgccccaccggtttgctggctttgtaataacataagaccattgtggttgttggtgtcagataccttcccatcctgagctctctcacctacctgctctctctcctagagcaggatactggggtacttttaagaagggtgctccttttaagatgcccagaaaagctgtatttaactcttgctatttgtaacttggggatggtctcccctgccccagggcacataagagcaaaggctccaatggtcagtggatgactctgcaaaagtgaccccctgtgccagaagctatagccctctccccaacaggtctctcttgttggccagagggcctgcttcccatgggcattgcaagtgccaccgtgcggggcctggctctgcacacccaggaaaagtctgcagacccccagccctccgcaataattcaccagaccagaagccactggtgtacagagaacacttaaaaaaatgtattttatgtgaaaaaaaattaaaactctgtatactgtatcagcagctttgtgtaaaaatggcaatcaagagagtctaatatatttaaaacttttttaaaaaaaatcttcgcagatctttgatatcgtactgaggtaacttccacgtagccccttgccacgcggcaccggtgggccttgggtccaaaactgtggctcagccacatcccaaagggggcacatgtccctggagttgcttccagctgccaaggcctgtgacagaattcgctgttaagagtttttaattaaaattattaaattccttttaataaca

SEQ ID NO: 431 - DNA, 26749 bp, Homo sapiens
aaagcagccaatgggagagccgaggcggggaggtgcggccaatggcgcgggcctgtttgattcaaaggttgcctataaagcgggactgcacgccggtttttgtccgagggctgtcgagtccgagcgccgccatggctctgctgtccgagggcctggacgaggtgcccgccgcctgcctgtcgccgtgcgggccgcccaacccgaccgagctgttcagcgagtcacggcgcctggctctggaggagctggtggcgggcggccccgaagccttcgcggccttcctgcgacgcgagcgcctggctcgtttcctgaaccccgatgaggtgcacgccattctgcgcgcggcggagaggccgggagaggagggcgcggcggcggcggcggcggccgaggactcgttcggctcctcgcacgactgctcttcgggcacctacttccccgagcagtcggacctggagccaccgctgttggagcttggctggcccgccttctaccagggcgcctaccgcggcgccacgcgtgtcgagacgcacttccagccccgcggcgctggcgaaggtggcccctacggctgcaaggacgctctgcgccagcagctccgctcggcgcgagaggtgagcggccctccagggccctgggtcgcacgggagacccccttcaagaatgggaaattgaggcctgctgggagtacgggccggggccactacctcctctgcgccctaccggaagcgcgcgcgggctaggtggtcccagggtctccgactcacaccccactctgcgtgtctcccccggatcccccgggccgctcctcgtggcaggggatagtgggaaagcctcggttcccaaggatgcgaattgtgcccgggttccatctcctaacgttcatatccctgaaggagggaccagaagtactctgagttccaaatttcagttaaaatcaaacttggaaaattgcctatttccctgtctgtcagccaacgctagatcccactttcaggagcttcttaggagactcattaccaaagaacttacgcagggaaagttccagaaagatggtctccagagacaactacggggcattaggaagcaattattattgctaattactttcatgcatcttttgctgtaaaaagcagataaacacgagagtggcaaagtgagagccctgccgctttttctttcttgtcttttttttttttttttttttttgagacagattctcttttgcccaggctggagtgaagtggtgggatctcagttcactgcaacctccgtcccccgggttcaagtgactctcctgcctcagcctcccaagtagctgggattaccggtgcccgccaccacgcccggctaatttttgtatttttagtagagacggggtttctccatgttggccaagctggtctcgaactcctgacctcaggtgatccacccgcctcggcctcccaaagtgctaggattacaggcgtgagccaccgcacccggccccctgccgctttttctactgccagagactggaggggaaactggggcaaggggtttgttttccataggctgggtctgtgccagattgcagtggtctcctaaaatgcagatacatttgcattagatcggcttctgtattcatagtgggttttggtcctactgtctgactcttagtatggcatggtcatgggtgcaatggaggtcttgtctgcttgccagcctcgataaagctgcagcagggtgctggggatcaaggaggaagaaggcagcctgcaggtgggtgtggcacatagagtgtcgtggcagacaccttggtctggagccatggtcaggttgcttgctgactggcagtgcccagctccctggctatctgcctgtgccagggacatggcagataaagccccagccatgttaagacttgttagggctggtacctgagtgtgtctgagtgtgggtgaagataccagtgcattgtcaggttgacatgtccaagccccgactctcaccaatgttcttaatgttctttccctgactggtggggtttcagtggtagtggatacagtgacctagtgccttgcctttgagggagtggttgtgggctgcagctaggctcttaccagccctgaggtgctttgggtggactgagggttttttgatgcagcagacattttccttgcgggttcagtgaaaagattaaaaagatggaaaaggcagacttgtgtaggtatgcatccccaaagctcatgtccagtagaacttgagcacttggaacctgaaaaatgtaaagaactggtctgtatagtgagagctgtggattgttctagtcttttgcccagccccaaattttagtgatagcaaaagggcactggaactagaggccagagggaaactattaaactcacgtgctggcgtgaggaggggatggagccaggagctcagactctccctcatctcacgggcattttgtaatactgacatttccagatagaacctgctgccctagtctagctacccacagttccctccgagatgctgtatttggaacctgggcagttttaactgagaaaggtggtacattacctttaaatccaatgagtattggctgggcacagtggctcaagcctgtaatcccagcactttgggaggctgaggcaggcagatcacgaggtcaggagttcgagaccagcctggccaacatcgtgaaaccccgtctctactaaaaatacaaaaattagctggacgtggtggtgcgtgcctgtaatcccagctacttgggaggctgaggcaggagaattgcttgaacctgggaggtggaggttgtagtgagctgagatcacaccactggactccagctctgggcgacagagcaagactccctctcggaaaaaaaaaaaaaaaaaaatccaatgagtattttcagtgtgtccgatagatgccaaattatttgcttactcattgcctgctgtgtatcagacactaccatggctggggccacaggggaaggcatcatccttgccaacacttgagagtggacagtgtgctgatgggaaacagtgaggagtttgctgcaggtactgcggaaagggctaaagaaagaaagtctccggagtggcagtgacctcagagctgggtggggcttgccagacctagggtatgggggctggcccacaagtgtttaaggacctggaatgtttgggggcagccaaattccccacagcgggttagtggtaggagaggaagctggggtaagggatgctgaaatgagttgggtttgagacagtgctgaatttgaggtcccaaagacaatctcttttgtttaaaaaaaaaaaaaaaagccaggccatggtatcatgtgcctgtagtcccagctactcaggaggctgaggcaggaggatcatttgagcccaggagtttgaggctgtagtacactatgactacgctgtgaatggctactgcactccagcctgggcaacacggggagaccctgtctctttaaaaaaaaaaaaaaaaaaagtaatgctttctgtttgccaggcactgttctaggtgatcccaaggaaggtgcgattatcatcttcattttacagctgatagaactgaggcatagagaagttaagtggccccgaagtcatgcagctagagaatgaaggagcctgtactcaaattgaggcacagaatgtctgaaccactgttaaccaccacactccctgtggagggttcaggagcctgtgctcaggtggggagaggtgacagcagatctggtggctagctaagagctactactatttatgggcatgcattgtggacaagggagtggctgtgtcaccttgaccacatcctttgaaatctagtacctgtgacagcgaggaccatgaaggtgtaggtctcaggctgctttcaggatgaaatgagaagctgttctgcatccgtgttctgatagcaaaggtacctaatggtgatatgattgagcactttgaatgggtcagtttctgtgctaaacccttgacctgaattacctcatttaaccctcccaacactgggaggaggctacaattaagaaaagaccaggcacagagaagttaagtaacttgcctgagatcacacagttagcatgggacagagctgggctcaagcccaagtctgtctagttccagctctgaagctcaagtgttttttttttgttgtttgttattattttttttaagacagagtcttgctctgtcacccacgctggagtgcagtggcatgatcttagctcactgcaacctccacctcctggattcaagtgactctcctgactcagcctcccgagtagctgggattacaggagcacaccaccatgcccagctaattttttctttttttttttggagacagagttgctcttttggcccaggctggagtgcagtggcacagtctcagctctcagtaacctctgcctcccaggttcaagcgattctcctacctcagcctcccaagtagctgggattacaggcaccctccactaatttttgtatttttagtagagatggggtttcgccatgttggccaggctggtcttgatctcctgacctcgcgatctgcctgcctcagcctcccaaaatgctgggattacaggcgtgagccactgcgcccggccaatttttgtgtttttagtagagatgggtttcgccatgttgcccaggctggtgttgaactcctgggctcaagtgattcacctgccttggcctcccaaagtgctgggattacaggcgtgagccgctgtgcccggccactgaagcccacactcctaatccctgctgcatacagcctccctgccatgaggaaggattggagctttggtagttttcaacaggctgaaggtttgtaacagttgaagattgggactttttaatttccatgttgcgtattctataaacaggaaaatgacaatgactagacctgtccttttcaggaagaaaacgaggtggtcagtttttagagtaggaggcattaaggctggcagagaacctcctcaacccatcaagtggggaaggtggttcatgatgccaggagaacataggtctctgagtttaggttttgtaaactagagtgtgttttcctctccctgggaaagatagagccagatagatgtttctggtacctggagcagagggatctgtgagaatcttttggtgggtgaatgaaggaactttgaatgccacatgaagggtcccacttaaccccagaggttggggccaggctgcagtagagcacggtcgaacctcagtgttcgctccatgcagctttatctgccttcactgaggtggtctgaggaccaccctgcatcttcaggaatgtctctggaaggagccaggatacgaggctccttgaccagagtataggcacaggaagccagggttacttggtaaatggtagggcctaatcctggctttgcagcctgaagcgctggttctgggataggttttatccagcagctctctgaccacacagaatcactcagtgtgtctgatacataaaagatgctcagtaaatactgtaggggcctattatgtgcacctttgctcattcagctacatgctttgaggagaaataaagggcagggggaagggagcggtagataggaagaaaagtagttcaggtgattctgtctgcctttccactcagcaagtatttgtccctgggtggctgtgcctggggtttgtgaatctgccagccccttccttgactcttgtttctatatacctttcaaagtgtgggcattctgccacactgaatgaggtacagtgtttaaaaacaaatggtttggccatgcgcggtggctcatgcctgtaatcccagtgttttgggaggtcaaggctggaggattccttgaggccaggagtttgagaccagcctgggcaacatagcgagatcccatctctacaaaaagttaaaaaattagccgggtgtggtggcatgtgcctgtagttccagctactcagcaggctgaggcaggaggattacttgagcccaggagttggaggctgtagtaagctatgatcatgccagtgcactccagcttgggtgacagggcaagaccctgtttctaaaaaataaataaaaacacaattacgtatagcatggcttgaatacaagctggctgcttaccaggtgctcaggcgagcttcaccaaaattggaggaaatactgttttgaaccttttgagaacccatatgtttgtttcctaagcaagtttttggataatcttgaattatacaggatattttccctacatacttgctgtagatccacccctccaccactgtatctgttgatgacgcattcagctttttgcctctgttgctgtgtgaactgggatttggctgggctgtggccgcctgcctggaagggctacatagcctcattttggcaatgtgcttatgaattggctgtccggctattcctggtttgttgaatgagagttcagaggcaaagctggtaccaccacgaggttccaattcctcagagtcacgtttcttaccagtgcctattctcttttgttccaaagaggccacttttgctatgacctcaccctcgggcatcctcttgataacctgagcgttagtagtggggatcattgcgttcccagagagccctgccaggaggagtagcagcttaggaatctgttgggggcccctggcatttacttggatgtatctgaatgaaggctttcctgttcttgcacaactttcctctgcattacagtagagcctgtgtggtgtgatcagtttctgttccaaatgctcatgtcagccccaagcagggcttctcaccctcagcactgttgaccttttgggttggataattctttgtcctgaggggctgtcttgtacattgtaggacgttgagtagcatccatggcccccattcactcgatgccaatagcatccctcacaccaggtagtcatgatattcagtgtctccagagtgggaaatagtgagttactgatgaatgggcacagagtttctgtttggggctatgaaaaagttttagaaacagatggtagtgatggttgtgaatgtaattattgccactgaattgtacacttaaaaattattaagatggcaaacttatctattttaccacaataaaaaaatgtctccagacattgctaaatgccctgtgggggcaaaatcgccctccagttgtgaaccactggcctagaagttctcactagtgcatcattatgggacattacccactggactgaagtgttgctactatttatcccttccttttgatttcatgtgtcaggttaaggattttagaatttagccatttctctttaaaaatattgtggtaaaaaatacgtagcaaaatttaccattttaaccatttgtaagtgtacagttcagtggcattaaatacattcacactgttgtgcagctgtcactagccgaatctccagagctgtttcagcttcccaaagtgaacctctgtacccattaaacactagctcttcataccctcctttcctggccccggcaaccaccattctactttctgtctgccatttctttctttctttttttttttttgagagtctcgctctgtcgccaggctggagtgcagtggcaccatctcagctcactgcaacttctgcctcccgggttcaagcgattcccctgcctcagcctcccaagtagctgggactacaggtgcccgctaccacgcccggctaatttttttgtattttagtagaaacagggtttcaccatgtcggccagcatggtctcaagctcctgacgtcgtgatctgccctcctcggcctcccaaagtgctgagattacaggcgtgagctaccatgcctggcctctgtctgccatttctttattcttttcccttagcgtctagcagacagtaatgaagctgcagaattcttctctgacttctttatggatagaaggtatgttacttcaggaaaaaagcaagcaaaacccaaaaatgtagtggatatattggcttaaaaaaatcttgaacccggtctctactaaaaatacaaaattagctggttgtggtggtacatgcctgtaatcctggctacttgggaggccgaggcaggagaatagcttgaacctgggaggtggaggttgtgatgagccaagatcgtgccattgcactccggcctgggcaacaagagtgaaactccgtctcaaaaaaaaaaaaaaaaaaaaattcttgatgcaaatgatataacctctggaagggaatttggcaatatctagcaaaatttcagttatatttacccattgatctaccacttccacttctctgtatcttgatatattggcaaaaatatgaatagttgtagacaataggccatgcgttgcaacactaattataatagcaaaacacaggaaagagttcaggtgttcgtcagtagaggatgagttcatcattgtgaatgaaccgattcgtctctgcagtggaacatcctgtagctctaagaaggaatgaggactagctctgatatgcggtatctagaatggtactgaccagtgtagtagccatatgaggctattaaaatttatatggattaaaattaaataaagattcagttctgtcatcttggaaggttctattgggccacgctagtctagaacaatgtgtagtattccatgctaccttttacctatagggggatataagcacatatacatagttatatacataatacacatgtttatataaaacaaatatgtttatatacacctgtgtatacttgtttatattgaaaaaatggaagaatatacaaaaaactattggaaatattatctcaatggggaggagggacaaggatggaaactaagtatctttgaaagtaccttgttttgtaaattggattttggaactaggcaaatgttttacatacttataaaataaaaacaattcaaaatgataagccctcctccccctaccccctaacttcttggtgcttttccctcccctttgaaaagcccacctgcttgtgtacttcatgctggaatagtacagagtactgaatagtggtcagtccctccagagatcagtgaaaactttgctcctgccaccctctggtggccctgccagcactttcatctaatacttaaattgttttatttggttgcttgtttgtttgtttgagacaagttctcattctgttgcccaggctagagtgcagtggtgcaatcatgactcactgcagcctcgacctcccaggctcaagtaatcctcctgcctcagactcccgagtaactgggacttaaaggcacatgccaccacgcccagataattaaaaaaattttttctggagacaggatgtcaactgtgttgcccagagtggtctcaaactcctggcctcaagtgatcctcccaccttagcctcctaaagtattgggattacagatgtgagccaccgtgccgggcctaaattgttaatttgataatagcctctgaaacagagggagaacagtgcacacaagcaagtttaggtttcgctgtgggaatttacattcttttttgtttttaaaccccaaagatgtcaagatagttacttaaaggtttttgacaaaatcccaaggagattatttctgttctattaaaacatgtaatacatggagagaaaatatatcttttgcttttttagcaagagggtcctgagagagttaggagaggaagtgaagggtcaatggaggccatgtggtcagctgggagaatgcagcagccaggatgttattgaccacagcacaggctgacattgagtgggtgcagatctttggtggaattccaagcatgttgcacacctgacctcactttatgactctgggagggaagggagggaaactgaggtgcagtgagaaggggtgatcggtacgaacttcctccttcacacagaggaagaagagctagaatgagaactggaatgactggccctgaggggcctgttggggctgcacatgtgcctggtcagagcctagacctgcccattgagtgtgtatgaatcactgacttcgcagagctggaagggttccttgtttcaaggacaccgagactcagatggaatggcttgtccagggatagtgacggaatcgggactaagaatatgagtagctgccatttaagggctttccatatgccaggaactgccagcaaacactatgagataggtactgtcaatcatccgtggtgagcttgagcccatgcacttcatgggctacgccactgatcctttagtgtttgttctaagcttccagtcatgtgaaaaactgcccattaaacttggttggaatgatataaaatactgagtatagtactttttttagatggctccggagtcacagagacctgggttgaaattccagcccttgtacttgtttaagtttgtcaccttgaacaagctacctaacctctccaagctttggctttctcatctataaattggggatgacaggtaatggggttttgaaatttctagatagcacttttgagcttttgtgcaagaaggcaagcagaaaagagttcagttctatgtggcaagtaacataaacagggtctgtgaccttcccagagaccaagaaggccatcatgacgtctgctgttcaactacataggttcccaagtcccttggtacaaatcaggaggggacaggtagaaggactgagagaggtaggcttgtgatttgttacctgagatgatgatgtgagagtggacacacatgcagctgctccagatatggctggagaagtgcaggaacagtggggtcctggtcagcaggccggccattatgcccctgaccagctggatgcgtcctcctcacgtctcctgttgtaactgacttgcactgagttgcaaattgcaaatgggtgttgaccctggaagggactcttgaaagtcaccactctcacgactttctagtccttagagagtgggtgggctccatgcagcacagactgggagagtgccatgactgtgggcacttgatgtgcaagggctgcctgccttccagacatgccattgtccttcgcacattattgcctccaggagtgggagcagtggccaaatacacatcaggtgtatttctggacccacaggctgcagcaagagcaccggatacctaggagttgcatcctggcttggaaagcaggactcggccggttagtggatgagtccaggtcattgctcagctcagtgaagagagtgtcccttcagtctagccccaggtctacttcagctatgcagggattggttgcatgagggctgggacacaggaatgggggatggggatggggatttgaaggaagacttccctactgattgcttctacagtaggactatggacttttcctctgtaaaagacaagtacttttggctgggcatggtggctcatgcctgtaatctctgcactttgggaggccaaggtgggtggatcacttaagctcagaagttggagaccatcctgggcaacatggtgggattctgtgtctacaaaaattagccaggtgtggtggcgtgtgcctgtagtcccagctacttggaaggctgaggtgggaggattgcttgtgcttcagaggcggaggttgcagtgagccgagatcacaccactgcactccagcctgggcgacagggtgaaactgcatctccagaaacaaaaaaatagacgaatatttttaagagtcctgctttagtaagaaaggagtggatgctgggtgtaggggaagtcaggggaagaaaaaaacctccatcaaccctacgcaccctgatggtgttaaggactagtgttcaaatccaacgcacaggaaagggtgaggctttaaaaccaaacaatggaacaaatagcaaattaggtatttactcaccatataacaaaggtgttgcacaattgttttgttaagtggtgaatcaaaattcagcttggccgtgccttgtgctgtgggcccccaggcccatgcccctgcctccagcaggtctctaatccagcagctgggctgggtttttctgatctctgttccagtagcactgagggaacgtgtcctttggcccgtcacactctgttacccctggcttgtctcctgtctcattagactgcgttcttgaggacagggattgacactagatcctcagtgctcaacacctgcctgcctcgattgggtccacaatgaagatttgaaagaagagtgggaaatcagagaggcaagcaggtgtgtgcattttcctctttagctttctcctgtgagctctactctcatttgtacacctgcatattccaaacctctttttgaaggttttactgccacctcaaaatccgtttcgaagctcacccctcactcttgcttcttgtcttgtgtttcctgtttccttgtatctgaatatccctctccctgtcatcctcagcccatgtcgcccactgctcggctctcccatgatctccttccctcttctgcaaccctcattgcttctgccgtgctactgatttgtcttcatctggtctctagtcctcctaaacatttattgaagttgcttaacctaaagaatatccacgtgactgctgtgttgcaggtcctgtgttggaggaggtgggcccagatctctgacctataccaatctcttctggcatcagtttcttccatcctgttggattcttcacttcgaactcattactcttatacaggcaatgtggggaagattgaaactgattccttggttggcattcagggccttctgtgatcttgctcattcatccgtcttttccagtcatgtcccgtggctccctttcatgcatgctgtacgttccagccagactggtacataccccgtcatgccctacctcttcctctgttatcatgtggcttcctgcgggaatgccttctcctcccttcacttctcccatgcccttgtccaaattttgtccttgtgcttcagctcaaatgccatctcctccaggaagccttccctgctcttatctggtaagcatttgagtacctatagtgcccatagtccaccactggaggagacaccttgtttttgttttgttttgttttgttttgttttttgagatggagtcttgctctgttgcccaggctggagtgcagtggtgcgatctcggttcactgcaaccttcacctcccagggtcaagtgattcttgtacctcagccttcctagtagctgggatgacaggtgcatgccaccatgttcatctaattttttgtatttttagtagagatggggttttaccgtgttggccgggctgctctcaaactcctgacctcaggtaatccacccacctcggcctcccaaagcactgggattacaggcatgagccatcatgcccggcccccttagtttaattgcttaggctgtatatatcattttgcctctctgcatcctgtgtcctctccttgaggtaagttgggtctatgtcaaattcctcatagccatctttctgcctagtgcagtgtgcagcccacagcgtgctctgaggaggtgctggctgcataatagcacctgtttcctgccttgccctccctgtgctaagccctttccatgctttgtttcacttaatcctcacagcagccctttgacccagatgctattaattttgtcttcctgaggaggaaactgaggctcagagagattaagccacttgcccagggtcacacagctggtaggtggtagagctgggttctatgcccagaacttttgcctttaattcctgttgtatgacccgaatgagtgggatgaatagaactgtcaaaataggatgtgtaaagccagtggaggatgtaaacttcagaggatgccacaaattcagaaagaacgcttctcattttttaaatcactgtgttcagtgggtttcagccatgccctttaccaagaatagcccacagcttagaccatcattaaaaggggtggggtgggaaaggcagcaggagagtaactggtcttctcaaccccctcacagcaatgacttcccaggaactggtgtttcagggtctcacatcctagtagaccaggccctggagtgttggagaaagacagccaaattgcctttttgcctcttcattccttctttaatcccccaaatccttaaggagtcatgactgtcatatactgtcctaagtcctctgggaccacagaaatgactcaatcccattcaagagcctttgctgcaggagaaggagtgaaacccataaatgaataatcctaactttcagaaaaagagttaatgtgattctgagagacaggcttttactgtggaaatggggaggaaggagaaacccttatatctccagactacagaagagcccccaagcctcggcttccttagttaacacccccaacttctgactcagtttgtcaggacctgtttctaagcctggaggtttggacacccccactgccctgccaggagtttgctgaggaccttggttttaagcctgcaaaaggtgtgattagaggcattgtggcaggagcagcctgtctttaaaagagcgaggaaagctaggcggtgtctccctgtgttgaactgtctggacggctccagctctggactggtaaagtgaataaacgagcagatactaagggatcctttgtaccttgcactttatgtaacatagtcatttagttctcgatacaaccctattttgcagctaaggaaacagacatttgaaacagctgtaatttgcccaggaatgcatggctaaaaggtagctcttaattgtagtctgatgctaggtgtggaaaatcacttgggaggcatgaatggagccatgttgttggggagaagaaaggcctgttctgagcttaagggcagaatccttaggaaatatttccctgttctttgctgtgggcttgcactatggacggataccaaagaactgcagagagaaccttttactgaggagaggccagtgcagtggaagtcatttggttagaacctgcccaacagacagctgatcaggcctggctggtagaaagaacagaatgttaacaaatatggtatgcagtgttagggaggcagaagaagggagaatccatgggcctgcttcgattgctttcgagtcatgagttggtggtgaatgggacaggccttaaaaaagtcagagattatgattcaaaaccagacaataatttaaaaaatagatttcgagaatgctaccctccagaagggccctcagagagaatctgaggttttatttacttgtttaacggacagcaaactgaagcctggtggggaaagcaacaagccaaagatgacagtgtgttacccacagaaccagacagcttgctgatctgaataagcctgtaagacaggagtttagtggaggaatagaaggtgaatggagcaggttcataagagagcaaggcagtggattgatctgtatttttgagaaacctcccagcatggagttgggagtgttagctaggccaagtcaagatttctaggacacggggcccaagtgtctttggagatgcaaaagagtccatggtgaggggggcaccaacactgcagaagggggagggaaggataactgttggatagggatcatttcccagttctgagtggagtccagagtccagagagcgtgctgtaaggtggtgtcctataagcttatcatgtgctcttccctgtttcacctgtaggtgattgcagtggtcatggacgtgttcacagacatcgacatcttcagagacctgcaagaaatatgcaggaaacagggagttgctgtgtatatccttctggaccaggctctcctctctcaatttctggatatgtgcatggatctgaaagttcatcctgaacaggaaaaggtttgtggtacactatatccagtttcaccatagtcaacaaatatgaccaagcatccattatctacaagctggctggtggcggtatccctgtttacaaggaagggactgaggctgtgagcaaagtcatttgcctggtcttacagaaaacaaacagtacctgtgacctggcaattctcctaggtgtctacccaagagaaatgaaaatatgggcccccacaaaaatttatgtgtgagttttatagaagcattattcataaagccaaagagtggaaacaatccaatgccaatcaactgataagtggataaatgatatgttgtctattcatacaatagcatactattcacctataaaaaggaatgaagtgctgatacatgctacagcatggatgaacctgcaaacgtgctaagtgaaggaaaccggtcacaaaagaccacatatgatatgattccattaagtcagaatagggaaatctatagagacattgattagtggttgcctagggctggggagttgggggaaggacgggattattgctaaagggtactttattttagcactttctttttaaactgatgagaatgtcctaaaattgactaacggtgatgatggttgcatatatctgtggatatactaaaaactacagaatttgtgttaattgtatgatctgtgaattagatctcagttaagctctttaaaagaaatgttaggattcaagaccttggcctctcccctgtactgtcctgcctcttaatagagcctggaccagctcccttgttgaaggcctgaaggccaccctggaagttgctgcttttgacagtagctccaggaggctgcccttttaatcacagcaaccagtattttttgagcccccactctgtctttggcactgctccatgctttttttttttttttcctgagatagagtctcactctgttgcccaggctggagtacagtggcccaatctaggctcactgcaacatccctctcccaggttcaagagattatcctgcctcagcctcccagttagctgggattacaggtgcgtaccaccacacctggctaatttttgtatttttagtacagatggggttttgccatgttgtccaggctggtcttgaactcctacctcagatgatctgcctgcctcggcctcccaaagtgctgggattacaggcatgaggccccatgcccagcctgctctgtgcttttaacaaatgttatgtaactgaatcctcaaagcagcccctatcaggtaagtggcacctgtgttttagaccaggaaatagtgacacagagaatccaagtgtccaccacttcaaagtagtgggcctagggtctgcctccttgtatgtctgcctccaaccccagtgtctgtaatcactattacatgctgctgctgttcatttctcattattgtaaaattagattttatgtctatttctctgattctgaaaatgacctaagtgtttcagtggaagcctatacaacatagctagcttggtcactttcatggaaagaagaaagaaaaattgtcatatttattacagaatttgtttttttgttgttgttgtgtttttttgagatggaattttgctcttgttgcccaggctggagtgcagtggcacgatctcagctcactgcaacttctgcctcccgggttcaagcgattcttctgcctcagcctcctgagtagctgggattacaggtgcccaccaccacacccgactaattttttgtatttttaatagagacagggtttcaccatgttggtcaggctggtctcaaactcctgacctcaactgatccacccgcctcggcctcccaaattgctgggattacaggcataagccaccatatccggcccagaatttgttttttaaaaattaagcaacccatggcttctcagccttttggctaagatcaagtgtaaaaattaagcatcttaacctgtgagcttcagaactttatttgttcatcacctgtatgagtatctattatgcactgggtactagatataaagcagtcagcaaaacgaatttagtctttggtactataagttactgcctaagagactctaacttaccaccttattattaccaagcaatttggtttacagaattcagattctcccacagagttcttgttggttgcctcatgataaagacaggattggggtttctagaccaattgagatgagacagccatgtaacccaacaggtggttagaaaatgagtccaggtggacccaaggaagatacactttggcatggaaaagagcattatcagctagccaggtaaagaaatggaaggtatcagtgtttaatttcaaggtactctttctataattaaggctatgcattagcagagaaatcacagaattgttctggccacaactttggtcaagtgattttctctatttatctactagacagaaatctatgagcaggcaccggttcagttgcctactgttggttgttgccttcataggtgtccagatcctctgcaggggggtttaagaaggcctatttctggccgggcgcggtggcttacgcctgtaatcccagcactttgggaggccgaggcgggtggatcacgaggtcaggagatcgagaccaccctggctaacacggtgaaaccgcgtctctactaaaaatataaaaaattagccaggcctggtggcacacgcctgtagtcccagctacttgggaggctgaggaaggagaatcgcttgaacccgggaggcagaggttgcagtgagccgagatcgcgccactgcactccagcctgggcaacagagagagactctgtctcaaaaaaaaaaaaaaaggcctatttctctggcctccccagtttttgtagttttacctccttcctggggaagcactgtcttccctggttgcttgtgtctcctgttcctctctgtgctagtgaatttgtgccccttgctgtatgggggctgatgtccccatgctctgcctctgtagctggttcagaatgttgggttgtgctgtctgtaggaacttggtcacacattgatgtgcaggcgctcacaagtgctttggccacgatcacagaggcatatgcaacattcagatgtgtgtcaaagggaaagatacagaaaaccacacctaatctgcccataatggtattcttatgcttattatatgttgatcctttaagacttggctcaggggtcatcacctcctccaggaagctctcctcccaccaagtccaggtgtacctctatgacattccctagtcgtttttctttttttaatttttattttgaaataatttaagatttataaagaagttacaaaaataatataagaaattcctgaatactcttcacccaagttctccacatgttaacatcttacaaacctcagtacaaataacaaaatcaggaaataaacttgatatcaatactatctaatttacagacttatacatttcccggtcgttccactaatgcccttttttatggtccaggatccaatccagtccaggatcacaccttacatttagttgtcaagtctccttcatgtgatttaatctggaacagtttctccatctttctttgtcttttagggtcttgacctgcccccaccccccccccaccaccccaccccccgtttttttttttaagagataaggtctcgctatgttgcctaggctggtcttgaactcctggactcaattgatcctcttgcatcaaccagcctcccaagtagctggaacgacagacatttggcactgcgcccggctggatcttgacacctttaaagaatactagctagctgggtgcagtggctcacgcctgtaatcccagcactttgggaggttgaggtgggcagatcacctgaggtcaggagtttgagaccagcttggccaatatggcgaaaccccgtctctactaaaaatacaaaacaattaaccaggcatgatggcaggtgcctgtagtcttagctactcgggaggctgaggcaggagaattgcttgaacctgggagatggaggttgcagtgagccgagattgtgctactgcactccagagtgagactccacctcaaaaaaaaaaaaaaaaaaaaaaacaattttttgtagaatttgggtttgtctgatgttttatcaaagttaaattcagattacgcatttggtaagaagaccacagaagtagcattatgtcttgccatagttttgtgttttatttttagcttattttgaatattgatagattaacagaagttgcaaagattgtacagaaaagtttcatgtacccttcacccagtttccccaaatgttacatcttatgtaacttatggtacaatgtcaaaacctggaaattgacattgtatacagctttgtgccatgttatcgtcatgcatgcatatccagacagaagtttccatcaccacaaagatctccctcctcctgctcctttatatagtcacatcactcccctcactttaacccctagcaaccactaatttgttctctatttctataattttgtcgtttacagtctattttgtaaatggaattatacagtatgtgacctttcaagatttgctttttttctctcatcacagtgcttttgaaatccatccaagatgtgcacgtatcaacagtttgttccttttcattgctgagtattgtatggtatcttataccattcagccactgaaggacatttggatatttccagtttttgtctgttatgaataaagttgctgtgaacatgtgtagaggttttgtgtggatataggttttcatttctctggatgctgttatgtgttactgtagtttctaaatcaattagttttctctctcttattctagtccttgaaggtaaggagcatgccttacatctctgttgtctcacggcttggcacatagtaggggctctctatgtttatggaatcaatgagtcaaacaaaaatcttacacgtttaatttaaatgtgtaagatttctaacgatatagagccactggtctgctccagagaatgcagattgttgtagtattttgtatgccattgtttatacatttatgtgtgtcattttacaggaataattatgcatacatgtgcagtatattgccccagcataccactaccagtgtacgtttttggtaattatgtatttgtaggagatgtgacattgcttgttaagccacatgtgatatgagtgtttctgcctcagcaggcctgtactagagaaggcctgtcctgtgttcctattctccatacccattatggtgttgagggtgagtgaggatggactgttactctaatgtgatgccattaaacaaacaagttggaggaagatcagcttaccttctttcagactttgctaaaatgttctttattactagcatgttttctttgatgattttatcccacacattttgcttcagaatcatttcttggattctgttgtttagtatcccaaaaaggttgagtgttcttttagaacacatacacgcatgaactaagggtctcaaaagtaaatataagaaaagaacagatgagaagatggaccaaatgtagaagtaacatcacttgaggcttgagaactgtctggctagtgtaccatgtatactgtcactaaatggtgaccctaagccacgcatatgccaataattatatctgggaattgtaaactaaggctttttgtcctaaccatttgctcagcagatgagtattgctgaattgttcatttatatttctcccactccctgccaacagttaatgacagttcggactatcacaggaaatatctactatgcaaggtcaggaactaagattattgggaaggttcacgaaaagttcacgttgattgatggcatccgcgtggcaacaggctcctacaggtaagtctctaacccgtccaaggcttattaatctaaactcttcagaagaagcatgtcatgtaaaggtaaaagccttttcctctcaatgggagcctgtatggccatgcattctgatatgcgtgcatctgtgtatagcagctggttatcaaagcctcctgttagaggcagtttgggtgggggtcacttcccctgtcctgtagtccatagattaaaatgcagaagttgaacttgtattgagacaacacagtcagcaagtcctagatttcaagccttggcccaggtctgcaggggacgaactgggggttaacagcaacacacagtctggaatcctggttccttagggatctggacccagcttgccctgctcacttgaaggtaggggcagttgcaggcatctccattagtgttgaaggcagagccagagctgtcagctttagactcaaatcctccacgttgcttcaagccttgtaatttagagctttagtctagaaaatactgattatgtttctgacccacctttgaagtgtcacattggcaatggcatcttaaggtagagagcaggaaggttgaagagagggtggggataatgagcggtttacatgaatctctagaatttgtgccatttgtacatatgtggctccaatggttgtatgttctgccgcctctgcggtagattgtctgatggtttgcatgaggtgtgtctgtagaattttaaaaagaaaaccccatttttgaagaaacacacaaccctgagtgataattacgtgtcagccctgggtaaaggtagaaatgtgaaggcttgtggaaaatgaggcagtaagatcaagaaaatcttgacacctttctttttcaacagtaccctcattgctcagaacaaaatttgaactttcttcaccaaagaggctgtgggaaaaaacaaattgaactctttttcttggaatttccttttgtaagaagtttattaaaaaaatttgtttttaacctaagtaggatttatctatattaaccaaacttagctacaaatggacttttgctgttctaaaatataaaaactaccctctccaaatgaaattgatgacgatgatagcttccatttgttgaggaggttttataatcttggtgttggataggtgctttatttacattatctcattgaaggctttcttttttttttttttcgtgatggagtcttgctctgttgctcaggctggagtgcagtggcgccatcttagctcatttcaacttctgcctctcagattcaagcgattcctgtgcctcagcctcccgagtagctgggactacaggcatgccaccatgactggctaatttttgtatttttagtagagatggtgtttcgccacgttggccaggatggtctcagactcctgacctcaggtgatccgctggcctcggcctaccaaagtgctggggttacaggtgtgagccactgcgcccggcccagcctcattgaaggctttcaaaagaatcttccttctcaggctttgaaggcagttttcagggggactttgcattagccatatcttggttacaggagacagagttgactgtgttctatgatctctgtttgaaacctacttctggtacaaataccaccattagtggggtgatggcaagtgtcagctaactctcaaacgtactgactcgaagaacccggaaggaagcatagaaaggtacagttggttttcagttcatcttgacgtaggagccacacgctgatcagaacactatatcctggttctgatgttttcgagttgacttttgttcttaggcaggctctccctttgaagtcaacgatcctggctttgtttattttttgtttttgagacaaagagtcttgcccaggccggaatgcagtggacgatctcggctcactgccaagttccgcctcctgcgtttacgtcattctcctgcctcagcctcccgagtagctgggactacaggcgcccgccaccacgcccagctaacttttttttgtatttttagtagagatggggtttcactatgttagccgggatggtctcaatctcctgaccttgtgatccggccaccttggcctcccaaagtgctgggatgataggcatgagccaccgtgcccagccagatcctggctttcttatatggcctttagtagctgtctcccaaagggtgaaactctttcactcagaattactatcaatcccttctgtcagaatccatttgataaagaaaaaagaaatctctgaaaacttacttggctctggtgggatcacatgcccaccctgaatgaatccctgcatccaagggaataggatactctggccagtgtggaccacatgcctgcccctattgtggttggagagagtatgataatgaaagctttctggggtacaggtgggtgtgagttctgctagcagaggagggaggcggggaagggacaccgtacaggcaagggcacatggccactaatcagctctaaaatgttttgagccatggtgttttgtgaaaatggcagcacagccccatgactgtgggtcctccactgttagtgaggaagactacttcagcagccacaaggacaagcttgagggcaggaaggccactgatgttgccactcaaacagtagcaaggagcagggcattagcaattcatagggcctagggtctgatctggagtccagcagtagctcccctctgtgataatccctttatctggtttccttacctttaagatgggggtgctggcctaaatagttttcttacctttaaaatggggatgctggcctaaatatttagaagccctattttttatttttaattaattttttgagatggagtctcgcccagtcatggaatctcgcccagtcatggaatgtgcagtggtgtgacctcagcttaccgcaacctctgcctccggggttcaaacaatcctcccacctcagcctcccgagtagctaggattacagtcatgcaccaccacgcctggctaattttttatgtgtttttactggagacagggtttcaccatgttggccaggttggtcttgaactcctgacctcaaaggatctgcccacttcatcctctcaaagtgctgggattacagtcatgagccaccgcgcctggccccctttccagtttttaaaaactctgaggcaaggaccaggtgaggtggctcacacctgtaatcctagcactttggaaggatgaggtgggaggactgcctgagccgaggagttcaagaccagcctgagcaacatagcaagaccccgtctcaaaacaaacaaacaaacaaaaaaaccctctgaggctgagcatttagtgtgtttgttaaacagttggcctttttacttttatggtaacacacataaatgttatatatgtgttaaggctagttaaatacatgcaaatggtaggtatgatatcaccaaatttgtgacccttatgtggtaagatacctgtactatattattcagatggacagtgagtaaaacaaaattgctcatccttaccagctgctgtttgtttctttttaatctttaagttttacatggacggatggcaaattaaacagcagtaacttggtaattctgtctggccaagtggttgaacactttgatctggagttccgaatcctgtatgcccagtccaagcccatcagccccaaactcctgtctcacttccagagcagcaacaagtttgatcacctcaccaaccgaaaaccacagtccaaggagctcaccctgggcaacctgctgcggatgcggctggctaggctgtcaagtactcccaggaaggcggacctggacccagagatgcccgcagagggcaaggcagagcgcaagccccatgactgtgagtcctctactgttagtgaggaagactacttcagcagccacagggacgagctccagagcagaaaggccattgacgctgccactcaaacagagccaggagaggagatgccagggctgagtgtgagtgaggtgggaacacaaaccagcatcaccacagcatgtgctggtacccagactgcagtcatcaccaggatagcaagctctcaaaccacgatttggtccagatcgaccactactcagactgacatggatgagaacattctctttcctcgaggaactcaatctacagaagggtcaccagtctcaaaaatgtctgtatcgagatcttccagtttgaagtcttcctcctctgtgtcttcccaaggctctgtggcaagctccactggttctcccgcttccatcagaaccactgacttccacaatcctggctatcccaagtacctgggcaccccccacctggaactgtacttgagtgactcacttagaaacttgaacaaagagcggcaattccacttcgctggtatcaggtcccggctcaaccacatgctggctatgctgtcaaggagaacactctttactgaaaaccaccttggccttcattctggcaatttcagcagagttaatttgcttgctgttagagatgtagcactttatccttcctatcagtaactgctccgtgttcagactcctggtttcttccaggcttacagtggacatcatcagcttcctgctttaaaaaatatcttatgtccctaattgcctttcttttacctgactttgtcacctttgttgtctttgaattctttaggctgcatattattttacatgctttgttttgtcatgtatataccaggtattggttttatggtttaaacactatggatacaggggtttgttttgcacaattttaatagtcatgcactacataatgatgttttggtcaatgacagaccacgtatatgttggcagtctcataagattataatactgtatttttactataccttttctgtgtttagatacaaataccattatgttacagttgcctacagtattcagtgcagtaacatgatgtacaggtttgtagcctgttttgcatttttcttaggttgtatgctcttctgttttaaaggtttgaatcaccagcatttttgtgatcaaaatcctatttagaaaaaataaaactactttctgtttatctctttagaa

SEQ ID NO: 432 - DNA, 228228 bp, Homo sapiens
agtgcaatggcgagatctcggctcactgcaacctccgccccccaagttcaaacggttccccttttgaagagagcaattcagagggccattaactatataagcacaagaaaagtccaaagatcctggagctacctagggaacagagctccaaagaaagcctcctgcgtggaagcttccctgaggaagagctgataacaccttaaacctcctctggattcaagttaaaggtgagagggaaattttccagtggaatcctgcccagcagttaattacaaatggcaaattttaaatcatctctgctttggtgttctgtgttagaatggaaatggagatggacaaactgtttacttctttcatttactttgtagcgctggggtgaggggactctaggctgttttgtttcaaggaattgtttaaactttttattaaattttattttaatcaagacggagtctcggtctgtcacacaggctggagtgcagtggcgctagctcggctcactgcaacctccgccttctgggttcaagcgattctcctgcctcccgggttcaagtgattctcctgcctcagcctcccgagtagctgggattacaggcgctcaacaccatgcccagctaatttttgtatttttagtagaggtagggtttcgccattttggccaggctggtctggaactcctggcctcaaatgagcctactgccttgggctcccaaagtggtgagattacaagcgtgaaccactgcatccagctcagattttcaaagtgagggtaaattctaggaaataaaacagaagattatagaggtgaataatttaagaattttaattaatgcatagaaaataatagtgcatagtgctggtgtcttagaatatgtttactattctttgaatatttatttctgaaattcgtcccttcatttgacagagctgtatgtggattactacaaatgtccaccagagggagactcaagactgagttttccccttggggttccttcaggtttaattagtacttgggccaaaatctctaccacatgttgttatagggaggcaatccaagacggcgaagagatttatggttctggaatgagataaaaggataaataaagggatggttctatccttaaacatccctgctttttctctggggcttgggtcactttctcttactgatcctctgaggtttgcaaaactgagttatttgtctgcttttgaaagcaaagcccttaggattcctggcactatccacgctgaaaaaaaccgtaggaatactcccacccactagcaaagaaatgtgtcattcaactcacaggaggcatttactaaattcaggagatccctccagggattataatgttctgccagagccaaaggcaatctagtcccaagccataccatggaatttggtagaggatggttttagtcttccctgaagtcttcatttgttagttcattcaacaaagaggaagactttattaagaggcaggtattgtttcactttttaaaagatatctctaattataggaaaaatctaataatgaaatgaatttatcattaacatgcaaaagctgttctaaaacagatttctgaatagaacatgttgttggtatagtttacatttgagattttaggaaacacttttatatcacctattatgtgcaaaggggaaaagctttttgacaaacagatattaacatagaagtacaactatgaggcactgctgtgattttccttttcagagttttgttttttaataaatcagacatagatggttgcacaattactttctattcatgatcacctaatttcccacattaagccctgaaaccaaatcttgaaaatgaaaataaaattagactgcaacctgccacccactagggaacaaacacctctacatgccttggctacaaatttaacaataaaaaaagactttaaatcccactttaatatctaggacttgggggtctggggtcaggtaaaagcagggtaatagcaaaggagtgatttttcccttacttctaggttaagcaggctggttgtacggggaagcagtgactggtaaagagttaaagctcacagagttaactcactggttaagagttaaagctggttaagagtaccagctcacagatttgcagtgagaaagaacccaagctcttagcatccttttccttgggctctaaatcagttgtgggaaacagtgaaaggtaacatacaggacaggatttttttagcgagatcaccttcagccatggtttctgatgcaaaatgttctcccgccagcacccaagaccatagatgctgtggcggtggtggcagcaaacactgggcatgcttggacgggcagccacagggttgccacggtctcggcagggtctagtagacagaggtcttgtgatatctgctgggagtcatgggaacaagtgggaatttatctttggttccagagaacataaaatgacccatttcttccagttgcgcaataaaagagaaacttaagaaggaaaaatgaaccagtataaaatgtaaacttagctgtgtctgttttggtcctagaggagcaaaggtgattggattgactgcagagactatgacacctcgccatttcctcttgtccataaacagacacagaattgcaagaacttttacggccaaaggttaatcatagaaagggattggtttccatctccaagaaacaaatccgtaccagaaatctgatgacatgttcctggatggaccataaaaaccattttcctaaataacatcagctgactctctggattctatctttgggactatcctcaaattcattagggaaatcattatattgaatcagtttaattttaccagggtatcacaccatttgcaaagctatgtcatacaatcacatagtcagtatggatgaaaatactattaattagagataagcatttgtccaagaacttgctgtaataggatcttgtggggatttatcaaatcttgtgaggatttatcgtagtcctttgccaatcagaaacacaaaatagatttagatgtaaaaatggagttctccatcttacaggaataggtccttgtgactttttctttctaagaaaaaaaatgagctcatttcattattctcaccctcctctcctgtttaaagaaatctgatctggtaggaaataacaagcaatgagccttaaattttagtattatctttttaagagtttcttaaaattgccttttgaaagtagttcaggcttaggcccaaaaataattatacttaggtcataaaaacagaatttctaatatgcaaaattcttttagaaaatcttttaaaacataataaccatgtaaaccttactctccatttctttatgaagaatggaaattaaacatgataaaataatctaattttggccaggcacaatggtgtttgcctgtaatcccagtgctttgggaggctaatgtgggaggatcacttgagcccaggagttcaagacagcctgggcaacacagcaagaccctgtctctacaaaatatttaaaaattagcctggcatgctggtgcatgcctgtaatcccagctactcaggaggctgaggcaggaggactgcttgagcctaggagttcaaggttacagtgagctatgatagtgccactgcactcatgcctgggcaacagtatggccctatctcttaaaaaaaaaaaatcgaatttcttcacaatcaacttttgaatgacttcttaaatgacaaaataggctgggtgcaacggctcatgccttaatcccaacactttgggaagctgaggcaggagaattgcttgaggataggagtttgagagcagcctgggcaacagaggaagaccccatctctacaaaaaatacagaaattagccaggtttggtggtgcatgcctgtagtcccagctacttgggaggctgaggtgggaggatcacttgagcccaggaggtcaaggctacagtgagtcatgatcttgcactccagcctgggtgacagaacgagaccttgtatcaaaaaaaattaaaataaaataagtgacaaaatatatttatcttatagcttaatatatttgtgtttcctaatggaaaagttgtaagataaagtcccacaggaatgaattctagaacggctctataattataatttatgtaaactacacacttgtatattatagctttacaaatcatgttacactctagtaaaactaatctaataaagtaatttcctcagtgtgcccccagacaaagctcagagaaacatgtggcttagccaaaggtaggtatgtggtagatcccagcccagaatgcaagtgtcctaatccagtgctcttttttggccatcatgatgttcctactctctgctagattagctcttgccatctcaccatgttcctgaagccctcctctaagtgttgagcctctggacctccctagtctgggttctctgacataacccctcacatcccacctggcctcccttagcccatccttccttgatcattcttccttgccctctgctaataaggccacgctaacatatatctgacttgttttctccatcaaaaatctacatccccttcccttaaccgtagaactagatattctctgcctaccaaggttacagttatcttgcctaataaattcatctgtctatgccacgcttgtccaacccatggccagtgaaccacatgaggcccaggatggctttgaatgtggcccaacacaaatttgtgaactttctcaacacactaagagtttttttgcaattttttttttttttttttttttttagctatcactatcattagtgtattttatgtgtggcccaagacaattcttcttcttcccatgtggaccagggaagccaaaagattagacacccctggtccccacactaaggaaagagggctagagaagctctttcccctcctaggtgacatatgcatggcttctggaggaagaaaagatattacaacagtagcgctcttcagaccagcattgaagtaccccatggaggccctttatcagattattgatacattgaaaactaccagatctctgtcttcagtcttgataccttactgaagttccagatctctatatccaattgcctgttggaattagtgtgacggtcagttttagttacctatggttagtggtcatactggccctgagcatagacttaaagggcctccatggggtacaactcagatgtcttttttccaggaataatcacatcaatctcaacaacccactgcctacccagaatgacctctatctttgagaataagtattttagcacaagaagattctggcctttgattggaacaagatcaatgcaacaacaggcttagcagcttacaaacaaaatgggaagtaataataacttgtttatagagaacacctgccacaggccagacactggagacactatttatttttatttatttatttattttgaaacagagtctcgctctgtcacctaggctggagtgcagtggcaccatctccgctcactgcaacctctgcctcctctggggttcaagtgattctcctgcctcagcctcccaagtagctgggattacaggggcacaccaccacacctggctaatttttgtattttagtagagacagggtttcaccatgttggtcaggctggtctcaaactcgtgacctcaggtgatctgctcaccttggcctcccaaagtgctaggattacaggcgtgagctaccacaatattattaattaatttgttaattaatttaacatatattcaagggtaacctactacctgctaggcacattttaaagtctagagataagagagagtatgctatttggggggaattctaactttattattcaatacaatcagaacatagagttccagagaagagtggaaaaagataaggctcaagaggtaaagccaagaaggcaaaaaatcaagaagacctagtgtcacacgaaggatttttgacatttatgttttataaataaagaaaggaaaggagagagggaaggagaaaaataaactttttatctgaggaatgtgaaccccctctaattatcaggcctagaggcattgaaatgtggcagcatgtgaaacagtcacccactccccacttgagctaaataattgcctcttaaagccccttgctatgtgggttctagacactgacactaagtcaccataaaatgccatacctggacaccataactcacaccctatagttcaacaatgtatagccaatcactaaccaatgttatttctgtaaaccaatgagaattcctgccgaacaactttgtatcagcccactccttgtctctttttgcctaaaaaacctgcttgtaacaaagaccaagtggagcactccccaaggcaacttggaagtgtgtcacaggcagctgtcctcaatcttagcctcacaggcagctgtcttcaaccttggcccaaacaaactctctatatgaattgttcctcagtttctttctttgcattgatagatggaaagaaggaagtcactgaacagttttaattaggaaaaaaatttgcactgtaggaaaattcctctaatagcagtgcagaattgcagcagtaatctaggagagaaaaaggccagaacaaaggtggtgacagtaggaaaagagggaattagaaatgtccaaaagacagcaaaggtagaatcaatggctctagtaactatctgaagagactgagctgagaatggggagggagaaggtgaaagtgactgccatgtttttggtttgggcggccaggtaaaggaggtgccattaactgagataagaaggagaaggagcatgtgtaaggaagaagacaatggtttgatttttgtcctttgaatttaagatgctggtgaaatatcttaactatattagagttttccagagaaacagaacctataggatatatagacatatataagaggagatttattttgggaattggttcatgcaattatgaaggctgaaaagtcccgtgatatgccatctgcaagtgagagaaccaggaaagctggttgtgtaattcagtatgagtctgaagacctaaaaacctggaagcgttgaggggagaactactggcctaagtcccaaaggcctgataaccaggaattctaatgtccgagggcaggagaagatagatgtccctgctcaaaagaaagtgaatttgcccttcttccaccttcttgatctatcctcagtggattggatgatgcccacccacactggtgagggtggatctttattcagtctactgattcagatattaatctcttctggaaacacacacagagatacacccagaaatagtgttttcacaactatctgggtatcccatcaagttgacacataaaactaaccattatactaactgtccaacaggcaattggatatagagatctagaacgtcagtaaggtatcaagactgaatacagagatctggtagttttcagtgtatcaacagtcttcaccaaaaacatctagaattattcctattttacagattaaaagcccatactgcatatctattgatgccatatgcccagaaccctttccttcttgatttagtaacagcctccatctttaaaaaatgaaaaccattaaaaaaccacttctcccagaccgtaggtaagtggtttgggtggagccagtgtcatgtcctatgcctcccaaggccagtgacccaagctgaccattatagtaccttacacttctggccacagtctcaaggtgacctgatcaaaagaatgagaatcttgagtagatttttgtaaactataactggtgtgaaggtctccttcctctcatagcaaaactgttcacatgtctgcaccaaactactaatatacaacacagacaggcagaagtgcagtgggagggaatcaaactgaggtccatgagaagcagagaggaagcccagttgcagtaaaaccttggttcccatgtgttctactatgcccctgcccttctagttacatcaaccgtgaatccatcccaggggccaagctagttcaacttgagtctttgtcccaagtaataaaagatgcagaaattgagacttgaatagtttaaatgacttgaccaagataatactcagacaagtaataggcagaccttcaaatcaaacccagggcattctggccactgcatggtattgccaagtacagggttctaaagtgatgcccactttctggctagaggagaatctccagactatgtggttgagtgaacaactacaacaaaaaaaatagtcaagacccgggttcaaatttggacaagctcaattactgcaacattaagcaaatcaattactctttttgaggcccacttataaaatgaaataatatcgctcctgctcactctataggtgtttggttaattaaggatgttaatacatgtgagagcattttgaaaacagtaaagaacctgccccaaggtaagtaatgctaatctctatcagcaatagaaatgtgtattgaatctattctctctcttgttgctaaaacctacaatcttaggggtgggaaacagaaatcaagaatgttatctcatccatgttaatttccatctgaataaacagtcacttctgtgttattgttgttactgaacatttattgaaagccagacagggtctgggtgccctggaaaatacaaaatctagagaagtgtctgggaaaggcaggaaacccagagcaatgcttggcatggtacttgggaacaagaaaccaaatgtgtggttcccaagtccccttcagaattaacatagcactgtgtccacattactgagcctgttctgcactgcctatttccactccccactctcatggggcatttttggagactggtaagataattcagtatgcaggtcttgggggacagagtatgatgttatgtaattaggcttgactctgtttattgcagacatcacttcattttgaaaacagaaatctgtcttttcctttggagcattttttataacatcataaggatgtcagtgtttctctttgctgcacaggtatactgtgcttagacgataggaaatttttggcctgaaaatgtacatgtaaatcatatttcatcaaaatcaaattacatccaaaatacaattgaggcgttcactatttctggggtccctgtggaaaatcatacaagaggcaatactgcatataggaaagaatggagggtgggagccagaaaatcaaactgaagccccagttcaatctcttcctacctgtgtgacttttggtaagtcttttagcctctgcccaacagttttcacatctgtaaaatgaagatgccatgaggttggtttttttttttaacctactttatggattttgtgaggacccagtgaaatgttttagagaaggataaagaaaggctaaatccatatcctctaggatttcaaaccctcttcataaaaatccacttacaagaattggaaacaacacaggggggaaagcaaagggtatgaaaatgaagccattttaagcaacaagcgtattgccacacatagccagactccatacattatatttcttgaatgaataaaaagaaggtatagctgattctgccaccatttactattctgtgccttgggaaatctcaaacagccttacacttgggtggcactcacttattcttacaataaagatcaccagcaacctaataaaaaataactcattcttagagtgccacagttgcacaaatcacttgcatgccttaagtgattcatttgagaagtcttttctgtcacaagatatgtttctcagaatgtgattctcaagacaccagagtcagaattacctagattcatgtagcaaatgtagaattctagatcaagcccacatttgacaaattagaatctctggggatgtgtctggataatttgcattttcacacacacacacacacacacacacacacacacacacagatacacactaacccactcctacactgtaattccaaagtttgacagcaattttcaggtttccaagaataagaaaaactatgacatctttggaagaacctggctcagtaaaagttcctttaatctcctcggcctttttttttttttttttgtctttgctaaatgtaataaacacttctagtaagtcctggaaattaatcatgccataaaaagttaattaaaactaacttaaacctataaaaagaatcagtccctgaaatttacacatgtacactgtacatttattatgtaatttacacatgtacactgtgaagcataatataattttttttgtgaatagctttttcatctaacaatatatcttggataactttccatgttgctacttatggatctatatttttctttctttttttatttttttattatactttaagttctaaggtacatgtgcacaacgtgcaggtttcttacatatgtatacatgtgccatgttggtgtgctacacccattaactcgtcatttacattaggtatatctcctaatgctatccctcccccaggcccccacctcacaacaggccccggtgtgtaatgttccccttcctgtgtccaagtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtattccatggtatatatgtgccacattttcttaatccagtctatcattgatggacatttaggttcatctactgtagttaggtttgctactgttagtagtgctgcaataaacatacgtgtgcatgtgtctttatagcagcatgatttatattcctttgggtatatacccagtaatgggatggctgggtcaaacggtatttctagttctagatccctgaggaatcgccacactgtcttccacaatcgttgaactagtttacactcccaccaacagtgtaaaagtgttcctatttctccacatcctctccagcacctgttgtttcctgactttttaatgattgccattctaactggtgtgagatggtatttcactgtggttttgatttgcatttctctgatggccagtgatgatgagcattttttcatgtgtctgttggctgcataaatgtcttcttttgagaagtgtctgttcatagccttcacccactttttgatggggttgtttgtttttttcttgtaaatttgtttgagttctttgtagattctggatattagccctttgtcagatgagtagattgcaaaaattttctcccattctgtaggttgtctgttcactctgatggtagtttcttttgctgtgcagaagctcttgagtttaattagatcccatttgtcaattttggcttttgtttccattgtttttggtgttttagacatgaagtccttgcccatgcctatgtcctgaatggtattgcctaggttttcttctagggtttttatggttttaggtctaacatttaagtctttaatcaatcttgaattaatttttgtataaggtgtaaggaagggatccagtttcagctttctacatatggctagccagttttcccaacacgatttattaaatagggaatcctttccctatttcttgtttttgtcaggtttgtcaaagatcagatagttgtagatgtgtggtattatttctgagggctctgttctgttccattggtctatatctctgttttggtaccagtaccatgctgttttggttactgtagccttgtagtatagtttgaagtcaggtggcgtgatgcctccagctttgttcttttggcttaagattgacttggcaatgtgggctcctttttggttccatatgaactttaaagtagttttttccaattctgtgaagaaagtcattggtagcttgatggggatggcattgaatctataaattaccttgggcagtatggccattttcacgatattgattcttcctatccatgagcatggaatgttcttccatttgtttgtatcctcttttattttgttgagcagtggtttgtagttctccttgaagaggtccttcacatcccttgtaagttggattcctaggtattttattctctttgaagcaattgtgaatgggacttcactcatgatttggctctctgtttatctattattggtgtgtaagaatgcttgtgatttttgcacattgattttgtatcctgagactttgctgaagttatcagcttaaggagattttgggctgagacaatggggttttctaaatatacaatcatgtcatctgcaaacagagacaatctgacttcctcttttcctaattgaataccctttatttctttctcctgcgcctgattgccctggccagaacttccaacactatgttgaataggagtggtgagagagggcatccctgtcttgtgccagttttcaaagggaatgcttccagtttttgcccattcagtatgatattggcagtaggtttgtcataaatagctcttattttgagatatgtcccatcaatacctaattttttgagagtttttagcatgaagggctgttgaattttgtcaaaggcctcttctgcatctattgagataatcaagtggtttttgttgttggttctgtttatatgctggattacatttattgatttgcgtatgttaaaccagccttgcatcccagggttgaagcccacttgatcatggtggataagctttttgatgtgctgctgggttcagtttgccagtattttattgaggatttttgcatcgatgttcatcagggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcatctatgaatctgtctggtcctggacttttttggttggtaagctattaattattgcctcaatttcagagcctgttattggtctattcagagattcaacttcttcctgatttagtcttgggagggtgtatgtgtcgaggaatttatcgatttcttctagattttctagtttatttgcgtagaggtgtttatagtattctttgatggtagtttgtatttctgtgggatcggtggtgatatcccctttatcattttttattgtgtctatttgattcttctgtcttttcttattagtcttgctagcagtctatcaattttgttgatcttttcaaaaaaccagctcctggattcattgattttttgaagggctttttgtgtctctatctccttcagttctgctctgatcttagttatttcttgccttctgctagcttttgaatgtgtttgctcttgcttctctagttcttttaattgtgatgttagggtgtcaattttagatcttttctgctttctcttgtgggcatttagtgctataaatttccctctacacactgctttaaatgtgtcccagagattctggtatgttgtgtctttgttctcattggtttcaaagaacatctttatttctgccttcattttgttatgtacccagtagtcattcaggagcaggttgttcagtttccatgtagttgagtggttttgagtgagtttcttaatcctgagttctagtttgattgcactgtggtctgagatacagtttgttataatttctgctcttttacttttgctgaggagtgctttacttccaactatgtggtcaattttggaataggtgcggtgtggtgctgagaagaatgtatattctgttgatttggggtggagaattgtgtagatgtctattagatcttcttggtgcagagctgaattcaattcctggatatccttgttaactttttgtctcattgatctgtctaatgttgacagtggggtgttaaagtctcccattattattgcatgggagtctatgtctatttgtaagtctctaagaacttgctttatgaatctgggtgttcctgtattggatgcatatatatttaggatagttagcgcttcttgttgaattgatatctttaccattatgtaatggtcttctttgtctcttttgatctttgttggtttaaagtctgttttatcagagactaggatagcaacccctgcctttttgtttgcttggtatatattcctgcatccctttattttgagcctatgtgtgtctctgcacgtgagatgggtttcctgaatacagcacactgatggttcttgactctttatccaatttgccagtctatgtcttttaattggaggatttagcccatttacatttaaggttaatattgttatgtgtgaatttgatcctgtcattatgatgttagctggttattttgcttgttagttgatgcataatgtaaatgttatgtattatgtgcctaatcatctgctggttcagttttttaatatttggattatttagtatctggttttgtttaacggaacaggactgtggtcagaacaatggcatggtcaaccgggatgccctccttctgcaagatagggaagggcgggtgctacatgactgtgggaaccaggtgtctggcaattgggatggtaactgtcaagaaatgcaagtgtctgaggctttaccctactggcaagctaacttgttttatggatgctgttagaagatgcaagattcctggatcagggaaaaggattttattacctaagccacaggaagcagcatgaacttcatgcttgcatcagtttcccttgcccatcaggtcacacaggggcaaagtagagattcccaggttggtgctgtatacactatgggtttctatcacagttgagtaatctcaagcttaggaaacccaaatcttataatgggctgcaagcaaacctgcttaacctttgctccagagagagacatactgaacaaaagcaaagctctactctggaggaagacactatctcttttttccaagacttttcactataaaacatccttggaaaggttgtctggaacaaagggctgtcagtgcctctgttcactagctgtgcaagagatgtatgtagaagtagaattaccttcaacagtgacttagcaggttctgaaaaaaaaacctggagtcacgaaatatcagcccattttatcattcatctgcaccaaaagaaaatgttggtgaaattaaaatttaaaaacccaactctctactccctccctttcaaaaaaatttaagcaaagcatgcagcctggtacacagtaggcatccaacaagtgctgatacccattctcaggctccccacacatatcctctcacataattttggtgctcatttattcttttctttgacatatgctcttattttcattgttttcatctttataaaaaatattgatgttgcaattatgattcgcaaaggaatatgtcctagatgaccatatttataacttccccaaaggtccaaagaacttttttggatgttttgtactggagttggtcttgagtttctgcacatgtgatacactaggtggtgctaattgactgagctgagcagggacactctttgcagcgacgttaaagactaaacctcactgaatagatgtttttacagacgtcaatcaaaggaggaaatctcaattattaataactgcacttcttgaagatataaagagaaaatgctattaataacgatcatggtcttttccttcccaaattatttataattacctgctttgccaaggacagaattcagctctaattctgcagacattgtcaggtaattgttacgttcaagaaaagctctagcctgagtgaaatctcctaaactagaaagttgcctttcctggaggagcaacaatatggagaaatgctttgtagagcaaggcagaattttctttccagacccaggcaagctcaggcaagaacctaagactacagccaggtgtaggggaaaaaaattcctcagctggtctagatcaacaaaccactaaatcactaaactaaagggctcctttactaatttgtcttacatggtcagaaacataatttcaagaaaaagaaagtctttatttgaatttattgttcagactaaaagcgaattaaccagcaggtaatccagggccaatatgaaacataaaggaagatttatatgaatcatacttcctctgcattgtattacaggagaaatatagttctaatttgtaaacgttcaaagcatttctgacccttaaataactccgatttataaaagtaaacacacaagccagcttttactgtctttgtcttttatgagtgccgatgcattaggcagcattcttgcaatgccacaccaatgtgcccctaccaagtaaggtcaaaataataactgttccaattctttttgttgttttttttatagagatggaggtctcaccatgttgcccaggctggtctccagctcctgggctcaagtaatcctctcacctcagcctcccaaagtgctgggattataggcatgagccatcacacccagcaactgttccgattctcaatgacacctctgtctagtggaaatcccacaccaggtctttagttctccattatataagtcatgaaactgtctttatgaatggctgcacctggaagtttgatgcctgaaggtttttttatgtaaactggattatatttaagtaaagatatccaccccatagctgcaaaggactgtcatcagtgaaaggagaagttaaaaaaaaatagaaaaaaatatatatataggtagatataaattattggtaatattttagttctcgaatgagtagcatccattatattctaaaagcataaataagcaaataaaataagaaggccattcatgaaacaatgacaataatattttatgaagcaaggactataattaatccaattctatgtacttaaataaataaacagaataagtcaaaggtagcataacattccacatccatgtgacccaatgcctaaacatctgcctgtaactactcaactcagtcctgggaaataacgtgggcaaaaataattcagaatcaggatgtctggttctcccacattggtgggaacttgagtgaggaacagtcacgctgataatcttttttttttttttttttttttgatacagagtctcgctctgttgccaggctggagtgcagtggtgcaatctcggctcactgcaacctctgcttcccaggttcaagtgatcttcctgcctcaacctcctgagtagctgggactacaggcacgtgccaccacgcccatctgtatttttagtagagacgggatttcaccatgttggccaggatggtctcgatctcttgacctcgtgatctgcccgccttggcctcccaaagtgctaggattacaggcatgagccactgcgcccggctgcatgctgataatcttacaaggcttcaggtcagagtaaggggacaggtgcctccttcctgaggaatgaaaatgtgcaaggatcagaagaaacatcagaagtcatgtcctggtgttatgggatctttggggtgtcaattttctggccagaaacctctgtggccacagcacctttgcccaagctcttgtcctgaatccaggaagaatgaagtatgcagacaagtgaagggtgaacaagacaaaaatgagctttactgagtgttacaacagctcagaggagacctgcagtgggtagctcctctctgtaggcaggtcatctatggagttttcagttctcagcagagaggtggccctggagaggatagctcctctctgcaactggtcatcctgatgtctgcagctctgcagctctcccccagagaggaggccctggagatgacggctcctctctgccagcaagtcgtctctgcagctctcagcagagaggataactcctctctgcaactggtcatcccatcatctgcagctatcagcagagagaatagctcctctctacagctggtcgtcccatcctctctttctctcccctctttgttcctctggccatcctctgccctgctctggctgagcccagggcttttatggacctcagaggggaggaagtgtgtgcctattggtccatgggcagccatgggtggtccagaagaggcaccacgagtccccactcccatccacaggactggcagcccagatccaagccttcaggcccttcccagcctgaaggtggggccttaatgcgggctgcccccttccacccaggactctgcctctcgctgccattcaaggcccagggctcggccccaaccccactcagatatcccagcagacactgggaaaggagaagggagggtttttcctggggcccccaaggtacaggctgcagggatgccagggtcctcctgcgcctaggagagcgggagctccagccccatcaactcggaaatgggctgggctcctgcttgtcccggctcctgctccatgaaacaggaggcccaggtctgcagcctcgggtctggctgctgcagctgcacccaggagggcagatcctgcctgtttccggcccccacccaagatcactgggaggctccgatccatagctgcagtttgggtggctatagccccacccaggagggcaggtcttctgcctgctccatagagcaggaggcctgggtctgcagccacaattcgggcaggggcagcggcaccgagggagctcccaccccaactcagaaagggcgtggctcccacccgctccatggagtgtgcagccccagctgctcctccctgctgcagccgacgtgatggcagcagccactgccatcactggaagaatgccaagttcaaagtctggagcttctacagcagcaccttaagcaagagagttatacaaaggtcagtgatcccagtatgaggtcaggagagtaaagaacagatataaggcatcctccctgcaagagaccctctacagccagaccctaggagtataatggcaaaaacttgggactaaaggtaagctatagagagacatggctcagaagatgagaaaaagcattctctagctttgctcaaggttcacaagcaaacattttctgtatcaatccttgatgttaaaggccttcttaaaacaaaagagcatactttagttctttcagtaagtacagtgtgataatacaatctaatacctttgattcattattgggagcattcatctatttattcagccaacatttacctattctgttcttgggactgtgttatgcatcagtgtcagtgtaaggaaaatagaatggagccacagaagttaaacaacattggaccttatttgttgttatcctccaaatgggctctgaatgtgactttaatatctctgataagagcctttcctagggacattttcctagtaacaattttaagtgtttaagataatgtacattaaagtgtctggccagacatgtggtaacatgtggctctagcttgtgatcccagcacttggggaggccaaggcaggaggactgcttgagaccaggagtttgagaccagcctggacaacaagtgagatcctgactctaacaacaaaagcaacaacaacaaatgtctactgatttggcagtcctggttaatttaggatctattacatttcctgtactgtacttgtcccaaatgtaaaagcctaaaaactcctaccttcattacactgacttcttgccagcagggcacccgaccccccttcccaagactctagaatgctacagatgctaataataatgccttgaagtccaaaacaaacacattagcaaggtcctggaagtgtgcaatgaaagctactagggactttccatcctgtcaagcaaattcatcatagcccagtcagttatcaggttaagcataattctttgatgagcttgttaaaggaaaataagtaaattggaggctattcaaagtcaggggctgtgttctcaacttctttgtaattccccacagtaaactagtataatgcttggttgacagttattcctcaattaacaattagcttttgttgatttatcccttttatttttcaagcatagaataagggataatgggagttatatgaacaacaggatattcttgacacactttcctagaacatcaaattcactcaaagatttggagacataagacattttttttttaaagtacaatgcaagaatctaaatgaatttttaaaatatgaaacaaagacaatccacacttatggctgggtatctgaagacataccttcaggccccaggtgatgattgtcactttttctctttagtggaaaaatctgcagcagactgcttgatgcctggtcacacacacacacacacacacacacacacagaatttgcctccccctccacccaaaaagcatatatttaaacctacaaattctacttttaggaacttaccataataaataagaatgcaaacacaaacgatagcagctgttcacctataattacttttatagtaaaaaatgttgaacattgtaaatgtcgctcatttagagaatggtaaaacaaattatgggaatgccatctaatgaaattctatttaaaataatggtgcagatctacatttattaacattaaaagatgtccacaatatgctaaatgagcaaatttaaaaataaataagatctcaatttgttttaaaataatgtttaaaagatatgtgtatgtgtaaccatgtatacacatattcagaaaaaagtctgtaaggctatgtaacaaaacaataactctttctgagggctagacctacaggtgattttttcttttttgtacttttctataaacataatttcttacatgaacataaggtaattttaaaaatgaagctattaaagaaatttatataatacaaaaagtataaagaaagaaaaaaaattattcccaaatcttgccttctaaaaataatcattttttaatagctaaaaataactgattcattttatttatttatttatttttttaatggtaaccacaaaatacactttttttttctggttttagttctttttttttttcttttttttgttttctttttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccacaacagtccccacagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgattgccattctaactggtgtgagatggtatttcgttgtggttttgatttgcatttctctgatggccagtgatgatgagcattttttcatgtgttttttggctgcataaatgtcttcttttgagaagtgtctgttcatgtccttcgcccactttttaatggggttgtttgtttttttcttgtaaatttgtttgagttcattgtagattctggatattagccctttgtcagatgcgtaggttgcgaaaattttctcccatgttgtaggttgcctgttcactctgatggcagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccaaaaaataatcatttttttattaggtgaacattattctgaaaagatggcaatcatctcaagtatctctatatacataaatatacctagatatgtgaattagctagataaatgatagctatataggcaaataaattaaagtttaataaactagaatcacatgaatgctacattgtcataaaaagcactaaatataagtattattgactttaaaagaaaaaaaactgaaatgcattaaaataattgtttgggttcagctaaacatttttatcaccatagaatattttgttttctaaaatatctctctaagattcagaaaaaattatagaacaaaaagtttcaattattaaataatgatatgtttaatatagacattatcaattgactctttcctaaacaagttaagaaaattagcaagctttcacttcttcccacatactcattttggttagtttttatttttatatttcaggctttataacatttacatttgcttctatagccataattcctacaactgttaagtcttagataatatctaaatgaagccaataatctccacctattcttttgtaatgtcttttccattccatagctctatatttttaatttattctttttttttttttttttttttttttgagacggagtctcactctgtcacccaggctggagtgcaatggcgtgatctcggctcactgcaacctccgcctcctgggttcaagtgattctcccactttggcctcccaagtagctgggattacaggcgcccaccatcatgccaggctaatttttgtatttttgtagagacggggtttcaccatgttggccaggctggtcttgaactcctgacctcaggtaacccgcctgccttggcctcccaaagtgctgggattacaggcatgagccaccatgcccagccaatttattctttggttatcggtattttatcaaatcgtcttttttctccaataagctttcatatgtgccatattcactgagttattgaatgtttaggaataactttctgttaccgttatgtacgaattacaatttggctggttattataccgtttggttatattttcttcccttaattgaatttggctatacagaatatatataagtaatatatatgcatatatatgcatgtaatacatttctatatcatgtgttttattacattttctgtgctgttttctactttagtgataccaaatatctttctgacataccagccttttcacttctatattatcccttgtctaattattttaatgtattttttgcactgattctcttaagtctttcttccacatcagtaattctgttttaagccgtgtctaatctgttcattaccatataaattagttctataatggtgttggtcttctgtttttttttcagctctgtgaattctctttcatttcactctgctatttgagagcttgttatacctgtcatgttcttactaaatccttctatatacaaaacactcaagaatgttttttcattttgattatatttttttctagagaagtttctttctagtctttcactgtcatattcctttttctccttcaaagcccgacttcttaaagatctccacttgctcaattctgactcactcctaaaccatttcaatttgtttctgacccccctattccagcaaaaactgctctcagcgggtcaccaatgacttccttattgttaaatacaatgaacttcagtctcacttgtacccttggcagcatttgttgtggctaatcactccttccgctaaacactcttcccttggcttccattacaacacaccctctggttttccttctacctctctaattacttctcagcatcttttgtggagttttcttcctctgcttttcccttaaattttctgttctataaggattatgctagaatcttgactcattctataaactctcagtgtttgaatctatctactcttctggcttaaattacatctatacacagcttctaatttatagctccattacctagtgtctccccagtgtatctatttattggacactttggtcaagtcctaaactgaactcataatcttctattcccaacctgctcctcctcttcagttttctgcttctctaaaaagaaactacccggttgttcaagtcagatacttgggggttatctttaactccttgtttttcttctcatagttaaccatcaggcctaatgattttaactcctaataaaattatcttagctactctctatcaccactgccattgcctatctcaagtaactatcttctatttccagttttactgcaatagtctcaaactaattttctaaagtggttctactgaaattcaaatctgatcatgccatacccagtaccccttaaaatctttcaataactggccattgcctatgagatagcctccaaacaccttaacctggcataaatgacccttctcggttacagtctcttgatacttctccaatttcattttctgtttcacatatatgttccggtcaagataaactacttacagttcactaaaaataatcaggttctctttcagctttgcatgttattccatctactttaatcactctcactcctcccattggcctggctaagtcctaaccatctttccactcttaatttagaagttccttcttctaggaaactttcttggattcccagtttcaagttaagtatccccctcctaagtactctcacaggaccttgaacttctttaacacattctgccataacaaagttgcctttttacttctctagaaactagactgtaagtatcaagaggtgggtatggtgtgtatcttgttcacgattgcatccccaacctctaaaaaagaatgatttttgaatgattgaatcaataggagaatgtagctttacagagaaagagaagcaaactaacatataaactaaaaatgcctcttccttagagaatgaaggaaaggatgaaagagtatatgccttgcttttgttagttcttgacagaaaatgttaggcttaatcaaatggcatagcctcaatacttggccattttttacctacaaaaatgacaatttaatacagctcaacttaatacattttgatggtttgacctacattcacaaactatcaaacctggagaaacccagtatcctgataccaaagatgaaaggctagagccagaccactaatctttaaccccattctcttttaatcagcaaattttgagaaatgaatgaagtataaatattgatgcataagacaggactgaaacatttgaagttgaaccacttttagacaagacatgcactgaactgggtggcctaaattctgagacaaatgtttctgatttccctgggcgtagccagagattaagccgatatttttctttaaaagactatcattcatcttcgactagttcatgggaaaggaagcctctttagaagaaggtacagcgactggttaacatacaatgtattcattaaaacctcatatgccaactggtgcttaataactactttaaaaaatattcatggtgacagaaatggaaagatttagtgccttcatatgaataaaaatgttcagattctttattaaagtttgctttaataaagtggcttcttttttaggattgttattcccctaccatgtatactaatacattcaagaaaggtagagagaacttaaggtatgttctatttcatattcacctccaataaaaccactaaattggatgaaaactagaattgtcacttattctctagcaaccaaataaattttataaagctagacattggtcctaaattttctttatatcatcttttattgttaacatggttaatctcttctcaaatagggaggctatgtatattaccaaaaaaaattggagcaatgaaaaaaaactagtgaaatcaagcaatagccaaactggatcatttatgctccaaatgttcttttcatccgccagtgttttttctccagacataatcttccacataagtacagccttatgctaaactgacataattccaatgttactagttggttttgtcaatttagtagagtaaaatccagtaatttgggattaatgaaacaactaattgaactgttacttttcactggctgtgttaattcaatgtgatacaacactgtcatatgatcaggtcaaacctagaaagaattcatttgctctaaaaagtgggcaattcacccataagcacagagtattattatagaaactttttcccctatgatctaatactagacaatttgagccactgtgttaaattaacatcaaaatatacattcagaccagaatggtagcttacaaagatgaactcttttctctcttgttcacttttgtttgcctagtgcctacattgtaagcattcaaataatatttgttgaatgagttaattaatgaaaattattatcatcagttgcctatcctatccagacaaaacattttgtctatagaaaatatgaccaataaataacattctatgtgtcaggatctcccaacataaagacttctaggtaattacaaaactgaaaagcactgttagccccagtactgatttgggttccagtcagtggcttccaaacttagcatgcatcacgctagttaagaactagttaaaatacagattgttgagccccaggcctagagtttctgttcaacagggacctgataatcctcatttctaacaagttcctaagtgaagctgatgcttctggtccagagaccacattttgagaaccgtgaattaagaaaatcagagcacttactaagaatagtctttattttgctgatgatatattttccacaaaaatcatgtctacaagtagtagatttcttttttttttttttttttttttttgagacagagttttactcttgttgcccaagccagagtgcaatggtgccatcttggctcactgcaacctccacctcccgagttcaagcaattctcctgcctcagcctcctgagtagctgggattacaggcacgcgccaccacgcccggctaattttttgtatttttagtagaaacggggtttcaccatgttagccaggctggtctcgaactcctgacctcaggtgatctgcccaccttggcctcccaaagtactgggattacaggcattcttgtacaagtaacacaaccttatcagttctctggagtttactttgtattaacctcaatgacatccaacagtatcttattagttcaagtagaacctgtcaatttgatggaaagaagcaactctgcaagcacatcattcttcttgacactacaatattacccaaaaattcctagtttaaatttgctttaataggcattatttcttatactaagtttagatgcctttcctactataagactatctagataacatttgttagagaaagcattaacaaactttgttgctcttcatcaaactgaggtatgtatgccaggccaggcatattaatagtaaatacctccaaatgataataacaacctatatttgacaaaatgttggcacactggcaaaaactacatttatagtcatactgtttctagcttcatctttggagtctagccattgagacacacctatctttgttaaagattttacagatactcataaaggctaaaaaatactcatcttttagcaaaagcacaacctcttgcagattttggaagcatgaatctattaatgcttttttaataaaagaagtattaaagagaggtaggatctatagctgctctagtgggaaacttaaaaagtaattaaagaacaatcaatcagtagatttactaacccacacctttctctgaaaagtatcactttattttgaagccttatatatctcaatagaaaagtgaaatagagaattgaacatttagtctgtcagttattcaacaggacctcaatgtaggggtgtgtgtgtgtgtgtgtgttggcgatgggggacatgcctgcaggaatgacatcattctgcttttctcctcaaaatattacctggaagaacatagctttacattaaccatgccaacacccgctcataagagtcctccctcctacccagggaaaagtgctaagcaagaaatgatttgctttaaatactgccaaggttgagtatctaaggactggttcaagttgcacatccagcaaggaagcaggcttgaggcaagtacaagcatctgaggaaaacacaggaaggctttttgacaaccccgttggggattttttcaaaaagacttgcaagatgccaagttaatcttgaggcttcttgcctcacttccttttatgtccttccctgaacagttcttgtataaacttgtcctcgggatgtctttccgcctcctataaactcccacctctgggtagccttggcacctctgccttaccccaaggccttgaattacttgcctatttccacatctccatgctttaaaaaaacttcccttcaaggtaggaatgcaagatacaccacattctcctttctgagtcagatggagatggtggtcatttccaggccaagtcgactttcactcaggctatatcccctttttcacagaacttcctcccctctggaaatgaggataaactaccttgacaattaattacctggagaaggccaagtgagagactcaatcttttgaagaaccagttcccagatcattttgatttggagcaaaaccctgaaccgaatccacagcgagaaaagccagcatgtcatgctgcaagttgcacttctccaagtgctgctagctaccaatatgtcttagtctgctcaggctgctataacaaaataccacagactggatggcttacgcaacacatacttgtttctctttttttgcaatatggataagttgagaattttccagtctgcaagttctgcttctggaattgcttaacaattccttctttaattcatctctgtcttctcatagtttactatcagtagtcaggaggaaccaagccactttttccacactttgcttagaaatctcctcagctaagtatccaatttcattgcttacatgttctaccttccacaaaacactagcacataaacacaattaattgaaatttttgccacactataacaaggattacctttcctctagtttccaatatcatgttcctcacttctcctgagacctcaccagaatggcctttaatgtccacatttctatcaacagtttatgattatttatgtattctctaagaaaacaaaaactttatctccagctttcctattttctttctgagcccttaccagaatcgcccttatgtgcacctcaaaactcttccagtctctacctgttgcccaattccaaagctgcttcctcatgtttaagtatttgttgcaggggcattctctccttgactccatctgaccacttcctctcccaatttccttgttccccaactgacagtaattctcttagttttccataatcactctctttatcctttcatctcccattatttgtggaacacactctagtctaactcttgtaccctgattccactgaaaccaatcttttcattggtaaagatctccttcttgccaaattcaagaaacaatttttaattttcatcttactcatcctctcagcagcatgagacatagttgattacttcattttattgaatcacttatttttgggttattgttggcttccacaacatatatttccctgttttatttcttatctcaccagctacctccttctcagtcttattcactgggtctttctattcttactgaaatggaaaaggtgaaatacccaagagctgagtcctcagatttctcttctttatttgctttcctccctaggtgatctcatctagagtcatggctttaaataacatctagtcaaaatcacatctcacagaagtctttcttcctcatcagtttcttaccctgttttgtttttcttcatggcaattatcagggatctagaactagaaataccgtttgacccagccatcccattactgggtatatacccaaaggattataaatcatgctgctataaagacacatgcacacgtatgtttattgcagcactattcacaatagcaaagacttggaaccaacccaaatgtccaacagtgatagactggattaagaaaatgtggcacatatacaccatggaatactatgcagccataaaaaatgatgagttcatgtctttgtagggacatggatgaagctggaaaccatcattctcagcaaactatcgcaaggacaaaaaaccaaacaccgcatgttctcactcataggtggaattgaacaatgagaacacatgaacacaggaaggggaacatcacacaccgaggcctgttgtggggtggggggaggcgggagggatagcattaggagatatacctaatgttaaatgacgagttaatgggtgcagcacaccaacatggcacatgtatatatatgtaaccaacctgcacgttgtgcacatgtaccctaaaacttaaagtataataaaaaaaaagaaattatatatgtatatatttaaacttatttattgtcttccccatgagaacaggaatcttgtttgttttgttctctggcatatcctcagaaactagaacagtacctggcacataacaggctcttaaaaatatttaataaatggatgctatgaagaggctttcatagtttttttttttaattcttacctcctaaaagataagaacaattgtttcagtccctatccaactccagttgtgcaccagatcttgtcccctttcttctacttaaggactttgctcctgaaatcatccactttctctttttgcatcatcagtcttctctttactcatcatactttctttatgctacaatatgtcccattatacttatcatgttttcctatattatttatatctttattgatttattttctcttgttcccttataatgtaagcaatatcaggacaagtacattattttattcactggtgtatccccagcactagaatagtagtagcaagcattcaatagatgttctataataaatcaaatggatttaaatactggtttgcttatatgtctctcccactagaagctatgttcttttaaaataaggaccacgttttattccatttaaatcccctttgcctagcacaatgcctagtaagtgttcaatctatttatgaataagtgtataaatgagtatacaacttaacagcaagcatgaggatgttcagtagccctcaggaaagatggctaacaaaaagttgagactgtcattgtaatgaaaaaataaaaagtctattgaaataatctgggctccagagacggcaggagactcagaccaactaatcttgggattcccttagctagagcaatggtttcaggtatggacctccaacagagtcacaccttttaggacaaagacaagtgtgttcttgtctcctggaacacaagctgagaggatgtctggagtccctgccaccatctgactaccacgtaaaatctgagactaaagaaaacactacagaagatagaaccaggaaatagagaaaccaaattctgaaggtactgcttgagctctgaatttagtactgccttaatttagtctactccctagactttttaattatgtaagtcaataacattgttttttgcttaaactggtttgaactgaggatttcgtcacctgctacagaaaaaaaatatttgactgattctagatctttaaaaattagattcctgggtcccaatgtcagatattctgaatgattatgtctaggccttgaaatctgttttttaacaagatccccaacagtatctattatgttctcggttgcaagcagcagaaataaaagtctagcagagccaaagtaaaaataatttaaaagacattagaaaagataaaaaaaaaaaaaggacattaggcagcttacaaaatcaaggaggtattaaggaggtatggaaaggaaggcttggagctacacagtcaagaacaaagcccaaaagtcatgctgccaaactcatcttgtgaagtagtcatgggtgctaccaaaaagcaccaaacattatggcttgtacaactgcccctaggagcttaatcttggggcaaccaccacttcctctagcattactgccactgctaccctgctatataacctagttatccaatataacctatataatctagtgattcaattcccatgtgctaaaggttagaacaacctgaaagaaaattattatcctcacatgtactgggaatttgacataatatatggcatacttaccgaaaagttggtaaggaaaattttttggaatcttatagtagaattaaacatgaaaccctttttctataacctgttgtgtctttagcatgagggtaaaagattttcctctcctctcacagggacatttgtcctcagcaatgctattcaaattaaccgaaaagctggtaaggaaaattttttggaatcttacagtagaattaaacatcaaaccctttttctataacctgttgtgtctttagcataagggtaaaagattttcctctcctttcacagggacatttgtcctcagcaatgctattcaaattattccagccaaataacgtcccatttctgatgatccattgccttgcattgctatttgtctatatttcctcacagtcttaacagaattctgaaaaaaagtgagtttgacctcctcattaagctccctactatggcatgtgacaggcatgctccctgtttcctccaacatgcaacccgttacccactatcagctttaagccagaaacatggtgaaaattctcaggtgatgggtcagatcaagaatgaagactttttgggcccttttgccacaacaaaatctgtttctcagtgtggcacctggacagccaacaaagtcccaggagaggaaccattttctcacatatccttttatgcacagtgacccacgtgctgattagtaacctgcaagcacttccttgatcactcacaatacttttggttataaccactgcctctaccctatacctcatttgattattgcatagtaccactgatggatgctgttgcaatccccctttcccctttgacagtttatttcagtggctcccacacacagctaaggctctgagtcactgtctgtctgtttttccattgcataagctcagaggagggctttgcaagtgtttgatgctggggcttttaccctcaccttggttgtatccctttggaacattgctagaagatatccctcctgagcactgaacctgtgccagccttttgtctcttttctgatctttgctctctgagtcctgggacttcctccaatagtctcttttgttatgtttgggttatattacttcatgtataattatatttgcatagttcttttccggtagtagcaagagcaaggggaggtctcctttatccaaaaacctgtgtctccttagagacctacaggaggctcgggatactctacaatgagcacatttcatatcttactttagtcaaactgcaagatatattagatttatcgaaccatagagacagaggtatctaggaggtttcttagttattttcccctgtaagaaaacagaaattcagaaagggaagttattttctcagagataaacagctattgacaaacaaatctgggactagaacccaaattcaggatactttcttctttactaatctgaattttcttctagagtttttcctttttcgaccatgtgtaacctttctgtaagagactgtctttgcatatagttacttaatgggtgatttaatgacagggaaagaagaatggaaatatccaagaaggctttatacaataatgtggtagacaaagacatccatatcctattccatagaacctgtttttttcttttttctttttctttgcttctaacacaccaagcacatatagaacctgttaatatattcccctacagagcaaaagaaattttgcagatctaattaagaatccttgaggtgggagattatcctggactatatgaaggggcccatgtaataacaaaggtcctttcaagtgaaagagacaggcaagagagtcagaatcagagaagaagatgtgacagtagaaacaatattagagtgatgggatgtgaggactcaaatcttccatcgttggctttaaagatgaaaggtgaacacaagccaaaaattgtggggcagccactataaactgaaaaggcaaggaaatgtattctccatgcctttctagaaggaatgtaatcctgacaatatttattttaacccagtgaactccctttggacttctgactccagaactgtaagataataaatttgtattgttttaagccaataagtttgtggtaatttgtcacagcagtagtaggaaatatggttttagaagtaaatctaatataaaaccacaataataatggttatgtcgcattttatatgtgacaggcattatgctacacccatagtgtccattacctcattaaatccttggaataattctaaggccagataataacattattcctctgttatggttgaggaaaatgagaattttctcacttgcccagccactcattagtaactattagagtgaagagtttgtcagattttcaagtgtatattcttaaccatcatgctatattttctccttaaaaatattatttgatctattttgtacaaaaagaatatccaagagccccatagttgacttttgcttcaggaaatgatgaagtaaccaacaccaggttaacccaagcacaacctaaagaaaacatgaaatgactgttttcagttattgggcagacagcacaatactgtgatcagcaagaaaagggaaacaaatgaggagagccctataatcatcctggatttctgtctgaagacaattctttttactgtgatttggagagtaggatatcaagctgagcatagcagtctttctgaattaagacagaatcagaattcaggaaaactgaagaacaaagtacgaaaaagaagtcttgtgtacaaggtctgtgtacagaaagacttccgaaaatatgcacaggaattctcttatttctgaataccaagtcacacttgcctaaagttaaatttcatgaggtatggaaaaagtgaccagagaacagtaagctgaaaatgtctgatcacaaaagggctgggaaatgtttgtgttctaaccatcagaatggggagttcttattaaatacctaggcattcagtagacatccagaaaggtgacacattaatgacaaaactaaactaggcttaaactaaggctattctaaaatcactctaacaaagcttataaagaattctcaaaaatgatccatatatatgcaaataatttaaatggctgctgaacaaagcccaacactctttaaggaatataaaaaaatatggtaaggaactggacatggtggctcacacctgtaatcccagcactttgggtggccaaggcaggcagattgcttgagtcctggagttccaaaccagcctgggcaacatggcaaaaccctgtctctacaaaaagtacaaaaattagccaggtgtggtggtgtgcacttgtagtcctagctacttgagaagctgaggtgggaggatcgcttgagcctaggaggtaaaggttgcagtgggccgagattgcaccaattcactccagcctgggggaaagagcaagaccccatctcaaaagaaaaaaaaatcagtatgctacaatgtaaagatcaaaacgtccaacattagtcaaaaattactagacatgccaagaaggaagaaaatgtgacccacttcagaagaaaaattgatcaactgaaacagacctgtaaatgacagaaatgatagaattaagacaaggaatttcaaatagctattatatatatatgaaagtatttaaagaaaagcaggaacctaacaagaagataaaatcaataaattaaaataaatgaaaactcctaaagaagaaaaagatagactccaaatgaaaaattctctaagtgggatgaagagcagaaaagaccctgtggaagaaaacatcaataaactttaagtacagtaacagagactatccaaactgaagtacaaaaaaaaaagacagacaaaaaaaaaaaagcctcagtcatctgtgacaatattgaatgggctaacctaagtgtaactgaattattaggataagggtttaaggatgtaggaaaatgtgatgaaatcatgaccaaaactttgtaaaattttatgaaaactctaagcatacagactcaggaagctcaacgaacaccaaagagaataaacatagaaaactattccaaggtatatcagaatcaaatagctacaaagtaagtgactaatagaaaatcttaaaagctaccaggggaaaaaagacatagtacatacagatgaataaagataataatggaagcagatgtcttgatagaaactatgcaaactagaatataacaaatggcatttttaaactttaaaacggtgaaagaaaactgttaaccatgtcttctatttacagcaaaaaatgtccttcaaaaatgaagacaaagtaaagagttcataagacagacaaaagctgagacaatacccagaagacttatactacaagaaacactaaagaaagtttctcacactgaaggaaaataatatctgatggaaacttgaatctacacaaaggaataaagattgtcaaaaagggtaaataaatgattaaatataaaggatactttctctttttttagtttctttttttaatagagatgtggtctcacttatattgcccaggctggtctcaaactcctgggctcaagcaatcttcctgcctcagtctcccaaagtgctgggattacaggcgtatgccactgtaccctgtactttattaacttcttcaaaagataattgaactaaagcaaaaaaaaaataactccatatttggggcatgtgatatatgtaaaagtaaaatgtatgacaactgcacaaaggacaataggaaagaaatataattatacttttataaagatcttacattatatgtgaggtaatataatgtgaagttagactgccacaatgtagaaatgcataggaaacactaaagtaaccactaaaaaataaaacagaatgcagcaaaatagggataaagcagaattcttaaaaatatgcacttagtttaaaataaggcagaaaaagaagaaaaatggtacacagaacctggaacacacagaacaaatagaaaacaaatagcagtatggagggacacagagcttcagagaccggtgggacaccagcaagaatactaacatatgcgtaatgagaaaagaggaaaagggcagaaagaatatctgaaaaaataatggctgaaaacttcccaattttgatgaaagacacatatccaagaggctcaatgggattcttgagtgtgaatccacatccaagcagctcaataaactccaagtaggataaactataagattcacagagacacattgcaatcaaatcgttgaaagccaaagacacagcaagaatcttgaaagcagcaagagagaagtaatctgtcataaacaaaggatcctcaataaaggtcaacagctagtttctcattagaaacgatggagaccagaaggcattgagaggacttatttatagtgatgaaaaaaaatgtcaaccaagaattctaaatatgacaaaactacttttcataaatgaaggcgaaattaagacattccctgataaacaaaagtttagagagttcatcacttagacattccctacaagaaatactaaagggattctttcaagccaaaacagaagtcatgctagatagtaacccaaagtcatatgaaaaaataaagaaataaagaactccagtgaaagtaactatataaatataaaaggcaatattattttatttttggtttataacttctttttaattttctttataatttaaaagccaagtacatgaacaatcattataattctgtgttaatgggtacacaataattttgtgacaataacaatataaaaaaggtggagctgtaaagaggcaaagttttcatatcaaattgaagctaggttggtatcaattcaaacgaggttatgaacataagatttttaattataatcctcatggtaaccacaatgaaaataactaaaaatatatacaaaaaaggaaataaggagagagtcaaaatgatacactagaaaaaaaaatcaacacaagacaaagtagtattgaaggaaattaggaatattaaaaaatggcatatagaaaacaaatagaaaaatgtcagaagtagtcctttcttatcaagtaatcactttaaatatcaatggattaaactcaccattgaaagacagagactggcagaacagattaaaaacaataattcaactatatgctgctacaggaatctcactttagattcaagacagtttttgtcctaaactagaagcaaatagttgttattcattaagatggggaatactgtatgtgggtatgtgaggcctgagaaggattagatttgagatatctatcagacattccagtgaagatactgaagaggttggatatatgagtctgaagttcaggggaaaagtccaacctggagataaagacttagagtcaccatcatatatttgctattttaagctctgggaataaatgaaatctaaagagagagtgtgtataggtaaaagaaaaggtccaaaacctgatttctgggtcatttcaatattaacagtttgggaacaagggtagaaatcagttcaggaaacacaaatagtggctcatgaggtaggaaaattaggaaagccaaatgatgaaagtgttttaaggaaaacatatcaattctactaaaggctgctctgtcattttctctcaggtctggtgtgggacattctctcgcctcataattgatgttttctcctcagatggttgtttgttattcaacctaggggcttgtatataagaaacagtcataatgggttactcatggttctaattgtgtgtgtgtgtgtgtgtgtgtgtgtgtgtgtgtgtgtgtgtgtgtgtaattatagcccgatagagatagaatgggaaaatcatagactatggaaccagtcctagctctaccatttccagctctaccatttccatacagctatatgaacttgggaaaatttcttaactacttaacttctctcagctccagttctctcagccccttgggaaaatttcttacctcctctcagttccttgtgtgtacaataagacgaataatattgcacctatctcatagtctactgtcagaattaaatgactttctatatgtaatgatactataagatctgaagaaagattaattactagtcccttcctgacatatgagaagatacccatgactttatgttccctcagctgctgaattgaatatcagctgctgagcggccttccttcctctggattataatggttttattttttacaattattctaaatgctaatatttagaaggtaattattagacttgttctatgagaactccttttggaaaagtaaatattttttaaacaaggttgctttgacacaaaataggtgggaagggaggggaagagatgagaaaaagaaaaatataaatgggtccacttggagcaatgaagatcaaagtaactctttgaatgtaaaaagaatgtagattctaaatcaaagtccccttgccaacagtatcacagcttttatctccttttcttaactcctgttcatccaacctctttccatatcttttatccctactagcatttcttccctataacatgaaaaatgttacaattgctcttcccattccaaaagcatgaataaagcatgaggaccttcacatggaatttacttgctgtatatgtggtgatttttttgtttggattaagttgtatttctaatggagagggggtggaagtataaccgagtacccccatttttctaagtgaaagagagtaagttactttttaaaaattattttctcttcttttttctccatttccccttcttccccacttcctacttagccctctggaagtgcaattataactttctacctccttttcaccagatgctccctacagaacaagttcatctaactatgtacttagaagctccagaaaggaactctcccccacctggagactgcctcacaaaataacagtcgatttacacccacaatgtgtccaccacaaaattcgctcccaccaggagactgccttgagagataacaatcaatttacagcccaaagtacccctgctacgaaactctctcccacctggagagttttcaaccactcttacaacctatttctgcccatgaaaacaccagctgcctggcagataaggcactgaagtgagtatgtggaccactcccccaccaccctgctcatttctgccccttcataagctcccctttaaaagcactcactttctgctccaaaagcgaagccacacccttaaggcaggaagcctgtacttcttcccctaagctagtttcagaataaaaaatcactttctttatactagatctcgctcttgttaatcagactctgaaagcagagattgactgaacctgcatttcagttacagaaaggaaacgtaattgtaggcagagaggctcatgagatgaaaccgtctgacagccagaaccctcctagaaaactaaggtgattaaatctttaaggcagtcttctcaatctctttagaactgttttttttcaatatacctccttgcttacacaatttgaattaccaataaaaataaattgagaagaaaatgcattaaaatgctttatgatacactgtcagatcacaggaaggtcttaagtatgtcacaaaagataaataagcttcaaaaaactataaatattctatatccctgttgagtacagcttgaaaactcaagcttagtagtgcttaccagcttacagactcctgcatatcctgactgctgacctttaagcctatagtttctgttttgatcttaagatgatatagctgttcattagactcagggaactcccacagccctgaacaggggtcactaacgtaatctctcctttctctgccttatctccattataaatccaagatacctttggagatgaataggtatcaagttatctgacttaccttagccatacaagcatcctaggaatttttcctgatgatacaataagagtaaacgggctccaaaaatgcaatgagcatatgcaaagctttgctccacctttcttattttttccacccaacatttatcattacccccaaaatgccaaatgagggacaaaagagagataccaacagaggaaataaacttgaagagacattagaagaatgattcattgagataacagagaaaaaagcatatactccaggcagtttaagaaagttacctaatagggcataggttcaagatacccaacgtgagccaagaaaaccccctatgttgccaaatgtcaaatagcatcattattatcagtctcattgataaattatcgggtttttatgtattgtctgggaatttacattctaacacccctgagatgtaaaaagagagaaataaatataggcatgaggaaacgcaaggcaaatagctactcagaagataaaaacacttgtataatgcaggtgtcatgaagcaatcacactgcactacagaccagggagcgtgaatctacctcagaccgaccactcaatccaaaattactcaatgatattggtagtgtgtgatcatctgtatgagctaaagcattgttatgccaaggcacacctgtccacaaaatgacacctctatatttcacagatccaaaaagccactgtggaaccagagagaatgggaatttgtggtctgaattatctaacctgtgccagacttgttattccacttaactatgatgtaaactgttcagatgtatttagtttgccttattctttaaaattaaaaatggaaagtgtttatcgaaatgaagatccagaagtacctactgagcctatttcctctcagctgttttcaactgtaaaacacaaatatgtctaacattctttaaaattaaaaatgcaaagtgtttatctaaatgaagttccagaagtacctactaagcctatttcctctcagctgttttcaactgtaaaacacaaatatgtctaacccacgaagcctataatcattagcagctgggttgctgtgtgttgtagtcatgaaaatgctcctctcagacctcctgttggagacagcttaattgatcctgtccctctggatgcagcactgcatctacccgaaggccatacttcctagccaatgatagagcacagcagatactaaggcaggcccattctggcaatatacaggactcctgagtaacttctattttaggactcaccatcgacctggccaaactttcttagcactacatggcagtctgagacccatcctacccaatcctgctactttccttcttctttgctacactgtggttctgaagtttctctccacctcctcctgctccctccttcagtaatctctttcatatctaatcctagcttgagatttatttggaatgggtccaaatcaaaacaggtggtacacagagtggtgtgagaaaacaggcaggaagatggggatttgggattggctcactcacccaacattagattaagtgggggccatcttgtgtggtaggtagggtacagatagtccctggcccaaggtaggggcccaactgctcaagatttcacccacaatgacctgagaaaatgtcccggtggaagggaacaatcattcagttccaatcattcaggcatttgaaaaaacaacaggtgtgctggctcacacctgtaatcccagcactttgggaggccgaggcgggtggatcatctgaggtcaggagttctagaccagcctgatcaacacggtgaaaccctgtctgtactaaaaatacaaaattgctgggtggggtggtgcatgcagagctccaaagacgtctgaatgatccaccaaggtaggtctactatggtaaggtcagggccctacttgggaaaaactaggatccagaaaaatgagatgagaacatctagatggatgcctcctcaagatactggttatgaagatccccccgaaccttcagagcttgcaaaggtggcctacccatccctcgtaagtggaagcacctccctttgtgctagaaaatggtagagtcctgtcccctctagaaggaagtaaatgccccctcagaagctgccctttcctccccttggttacccagctgagcacctgatgggcctgataagaaagagactctataccaaagaagagcttacaagagtgagctagcatgcaccagcaggagccaggagcctaggattagattttaagtgtgcttgataaaaagggccagaatgtaagactggattgggtaagcagaaattcattaacttgaatttaatttagcttgaaggcacttacttgggacacaggatttaaagcctggcaaggatcccagagtatgaggaaaattcactgcttagaatggctctgagaacactgaaaaaagtgatgaccaacacggcaaagtgtaaatacctgagttgccctcacaaatgctagaggaaagaataaagaggctaagggaagcgggcaaggccaaaattagggtgaggcaagagcagtgtctaaggggcataattcaaggagccgctcactctcatggtcttgaaatattagggtctttgcctcatcctagtactggacctggaaatgggtatgctagagtgtatctattatgtaaggcagtaagattcccctagaggattgtgttcacaagaaagcctaccaaggccaccagaaatgtgctgagagggaaagcagtatcactaagaagtttggtagcggttcctctgcaggccagggctgattgtaggagaggccatcatagagctgggctcattagtattcatattcatgatagaggccccacaggaatagaggccaagtgatagcacttaactatcaaaagtcaggaggctgcaattaccataatggcctgcaagatcagagcagccaatgggtttgatccacagggagttgtggagatggttgataaagcatggttttcctaggagcaaaatagaagggcagtcagcaagggtgctacttaacatctttaaatttaaaaaaaggcaagaatgggagagcaagaggcagaggatagtcatacctataaaaaagtcacaatcctctgctaatattcccagacttgagcagatttttagaaccaaaatccattgactaaataccacagaaagtatattctataatcattcctacgacacccactgcaacaacttggcagttggagtaacccccagattaagacccttggcctatggagtaagagctatcacagcaggaaaaaccaagtggaaatctttaaaattgttcctcctcagccaacatagtaattcaaaaacaatatatcctacagatgatgaaggagattgttgctgtcattaaagagctaaaggaggcagagatggtggctctcatcatatcttcatttaattcactaatctggcccctgcaaaagccatctgtagactatcacaagctcaacaaaggagtatccctgatgatagctattgtgccagacatggttctactatccctcttctaaattcccccttagaaagagacccctaaggaaccacggaggagttgcatcccaaagctatgtgaagtagacctgtgtggaacaagggttagacaggagcaggcatgaaaatgctcctgtcagacctcctgttgtgaggagcataactgaccaacagcctgagatcttgtccctctggatccagcactgcatttgccccaaggacatacttttgttgtggggggtggttcccagccaattctggaccacctcagagatactaaggtaggtccattttggcaatatacaggactcctcagtaactttgattcaaggactccccatcaacctggccaaatcttccttggtactgcactgcagtctgagactcctcatacccagtcttcctttcttccttctcttctacacaatctgaaggatctctccaccttctcctccttcccccagtaaatctcctacttcttaatggacttgacctaatataccccgaaaacctggaagactatggaagaaaggatctgcatttgcatttcccctggcaaccagaatgtttttaaactatacaaggggatcacagacttacttatttctttatttttaccacaatgaaggtaacctgctaagggaaggagaatctaaagatgattaaaataaacctggaacaaaaaattgctttgtatcttaaaatttgcataaggcatagtcagggcacaaaggggctgatgcagcctcagtgccaaggtaaatgaggcacacactgtacagtattttctgtgttggtgccagtcacacaaatgggatctgcccagagctagtcttacttgtgttcctaacttgcctgaaaatgtttagaaattgtcattcctggatcagcacttttagtttgggtcttggtgccagtaacacctttaattctgtggttttcattcatatgctgttgacttgtgatgcatgcggcctcacccacagaataataaatggttccccagttctgttggagttaacctaggttagaagccatagtttggtggactctgctcagattagtcaggttcagccagatttgtggttgacttgacctaaaatgaaatgcaatgacctattcactttccagacatgtccaggattctaggagtggtccaaagttaatctgaatccatgaaaggtgtggttttttggaaatcacccagaactaagggatcctagggttattcttattcttggtgactaatgtacaaacgatttaatgtctctgtacattcatttcctaatgaatataataatccctccctttaagaaggttgtaatgtttcatataattgtatgaaatgccttgaaatctttaatgagaaaaggaaaaaaagttatcatacacaccatttttaatctaaggcaaaagaattcaatcaaatcttgaggcttaatttattaggctttctcaacttaattatttatctatactgaagtctgctgaatgcacatttcattggcacattttatttttcaagggtgtagcctagcacagtgacagatatttaataaatgcacatcaacttgcaagaagaaatgtggacaatttaacagagtcatcgactgagaatccagataccagggttctagttccaactctgctgctagtgcattatacaatcttccacaaatcacttggctttaattctctcttccgagattgagaacattggtgttaagcatctctaaagtaacattcaggcctttaaaaaatctgtcataatttgtgaagttgttactcttttatattgctctaatgatgagacactttttttaaagaagaaatataaagacatttataagtaaatactttcctattttatttttctcaaaatctgtgctgcattttaaaggcactgtggtataactcaaagagtactaaacatggcttctaaaaatggatttgctactaactacttttggggctttaggtagttcatttcacatttttaattttctaaaaactaaagactcagttttcttatctgtaaaattagggtgttggattaattctcaagactcttcctactcaatccaaggtctattccagccctaatatcctataactcatccagataacatttttaagtgtctgggttatttttctaattacaaaggtaatacctgctcacttaaaaatattcaaagaatacaaaaatatgccaggcacagtggctcacgcctgtaatcccagcactttgggaggccgaggcaggcagatcacaaggtcaggagtttgagaccagcctggccaacatactgaaaccccgtctctactaaaaatacaaaaaattagctgggcgtggtggtgggtgcctgtaatcccagctacttgggaggctgaggcaggagaaccgcttgaacccaggaggcagaggctgcagtgagtcaaaattgcgccactgcactccagcccaggcaacagcatgagactccgtctcaaaaaaaaaaaaaaaaaaaaaaaaaaaaatatatatatatatatatatatacagaaatatattaagtaaaaattagagtccaccataatgctatcccttagagattgtgttaacagcttattatataatctttcaaaattgtctgacatactaacatagatgtattattacactattattttataaaagaagatatatatacttttatgatttttttaatttaataatatatcatgaacctctgccaactagatatatgtagctctatctcattctttttcatgactctgttccattcagtgggcatatcaagtttatttacctgctaatgaatatttaaatggttttaaaatttttgtaatgggtatgctggatcacctgaaggcatctttgcctatctatttttgtacaaatttggaagtactttctttaaggtaaattcctataatggaatttcttgatgaaacagtgtaatttcctatgtaggggcaaactgctctagaaagaagtgttatcaatgtacattcccacaaataatgtacgagaggagaacactaggtggtgctaagcatgctaatttatatttattatgtcgccggaactggtgaggcttattatctagtttgggccttatccccaaataaaactagactagtgctgatataaaggatttcagatcttaagtcaggtcttcctcggtctcccgtcagacttatcacatgcagtcccagagagcagaatagtcccagcatttggaaataacagacgagtaaattctggctcaaaaggacaaaactttctagtaatcagaattttcccataaaggactatgttgcctatcaattagaaaagccctgtcactgtattataaatggtgaacaactgaaagctggatgaccttttgtcaataagtagttggacctgatgacctttaaagtttccttcagattcaaaggctcacaaacacccagatttgaagggcaagaattagggttaaatcctcccacaggcacttgcttccctagactgttttctatcagagtaacattttttatgtcttctctgtcctctataattgaatatttcattaagttaattttcataagtctaggtaagtatccctcacagagctcaaggtcaatatttctatttccattaactaattcatcaggtattttctgagtccctactatataccaggcagaatactaaattctggggatctgacagtgagcaaaaccaacaattcctgccctgtggcatttacagattgtgcttatcaatgtaagctacatttgaagacagccataaagcatttattttaactgcctatagaattaactggataggctgcccagtaaatcagaatatgttcatttagaaaatcagaaacatgagacatgtttttaaactatttctcactgctgattttttcagttaacataaagcaaaacagagagcaaaaataattacctgagaatttgaggcaaagtaagagccaaagcaattatctcatccaaaagtaaaacaaagaaaaacatgtttaccatgattgaccaggaaattgcacctgcattctatttcacctatggataggtcttccaaggaccaaattctaagatagaaatctctgaatattctaaggtcataatgactttcctggccccaaacctaatgtcacatttcttctgacaggctacagaaacaagagaaaacaaaaaaaaaaaaaggtccacaggatggcttgggttgaattatgtgtgtttatgaaggaaagtgtcaactagaccacatgtgtcaaggggaaaaatatcataaagaatttcccaaagaaatccttgagccaaaaccctttcttaagtaaaaatatcatcatttcagggcacattcctctcctgtcatgcatgcatgagcagactgcttcctgctgaaagctcattctgaaaatgaaatgcagtccctatggtaagcctagctttccataaaggcaggacagagtaaacaaaataatcctcactttcagttccatttctttactttaggtaggatctagaatgttcagggaacaggaattcttcgggaaattctagctctttgaaatatagccacacagtcaaacttggcaaaaggttttaaaattgtattcttaaaaaaactatatgaagaagcttttataactcagtatattttttaaaaaccaattgtttctttataagtttcccaacccaacataccatgcaaatcattatttttaccttatgattcaaatgtatccttgaccacatgtaatgggtaaagccacagagacatgatccctctcctacaactcagaagctaactgatttggtgtttaatttttactttacatgatatttcttttgttcttatcattctcaggaagagtcctatagcctgatatgcaatgtacactttggtggtttttggatgcaaccaaaaaaattgtaaattttgtaccatttttgacatatagaaaccacagtttcacatgattcagctcaggaaaggactcatctctctagacctgtttcttcatcttaaacttggggatgttcaataagacgaactcaaaagtcctaggtttgctattctatgattctacaagttacaggatcatgttcatataaggatatactggggaacatatgcataggtgacatttgctattataatttcactaaatagggaaaaaaatcaattcatttcacaagtggttattgagcatctacttaggacaaggccctattaaagaaataattttttgatatgaaaatgatagggctttttatggagaaaaaactctaaaatatttggggggcttgaattccttcagctttaagccaaatttaattttacatttgtcaaatacttggttatgcttaggaattctaagaggattgcttaataagtacagtcatacctttcttctaatgccctggcctgagtccatgaataagaagggaacaagctgccccataagagtttcacaacttctttcaggcactcactccattatatagggaaatttatgaaacatacatgtgccagattctcccagagtaggtgttccctttataagtaagtgataagccactaaaagtgcattaactcttttagtcaataaatcattcattccacaaatattgcctgggtgtgtattatctcaaacactaggctaggattcaagatatgggaataaacagactctgtcttcaaggagctcgcaatctattgaacaaaatagaaaagtaaacaaatacttgtactaccttgtcacaagtatgtaaaaagtattataatggcacgaagtaagcatcagagggcctatttcacaaaaaaagtgacatctgaattggaatgtaaagacatgggaaggaatcaccataggtggcagaggggcaatggggcacaggatgaatactacaggttaattgaacaggttatgcaaaatatgaagacctgaaataatattctatattcagagaaaggtgagaacacctatagagtgtgaggaaaagatattaaagaaaacaaaatggataaagcagattggggctagcttttgaagacccgaaggcctgctgaagaacaccaactctattttgtatgtaagagagaaccactggggtgcctttaaaacggcaggagagcaacatgatccaatttgaaaggtcattgaatgacagtgtggaggatagtttgaaagtgggtaagctctagtcaagatcagctaaatggccattcttttttttttttcttttttgagacagagtctcgctctgtcacccaggctggagtgcagtggcacgatctcggctcactgcaagctccgtctcgtgggttcacaccattctgcctcagcctcccgagtagctgggactacaggtgcccgccaccacacccggctgatttttttgcattttttagtaaagacggggtttcaccatgttagccaggatggtctcgatctcctgacctcgtgatccacctgcctcggcctcccaaagtgctgggattacaggcatgagccaccgcgcccggccggcccattcttaatagtacggaaaagagatgaggaaggacgaaatttaatagagtaaaacactaaattaccactgactaacacccagaaacttaaaagcattcacgtatatcattaaatctcgagttccatctattcacgaattgatcaatctcaaactatgcaatgacaaaacaactagtttaactgattttttttgcaacaaattggccagtttttgtgtcacagcatagagatacttatctgttcatgaactgccataaaataattttcagctggggaaacaaaaagcaactttctagcttatagaaggatttttatgataaaatggatgtccaaatggtatttgttccacacgagaaaagaatctaaaattgaaattaagttctcctatttgagtatcacattaactcaatataataattttctatgtagagagaaaactgtttgcagggataatccaacagtagagaagtgaaatctgtgagtttatttgaaatcttttgggcaactctttgcagcaacagtgccatcttcctacattttgcttagattaattttaagatttatttttcttatttggaacacatctgtaggaagcaaggagcatgcaagctaggatatagcaaatctgagagttagcatttgtgacagataatacacatgtgcattatacacaagacaaaaataaaattttattctcaatttctagatattagataactagatggtggtagttccattctagttattagaaaactatttaggattggaagaactgaggtggtcaaatgaaaaaagtgaattagttgcattcttaccaactgtggagcaaagaaacatgtttctcatggcccaaggcaggcttgaatgagaaggaaatctggggatctacttagatagtgccaagaaagtgccagagatggatgccctggagatgagcaaagagaggtcctgaagtcacaggactaaattccagcacagtggaataaaacagaaaaaagaaaggagtacctacataagagaatcagtaggtttgggagagtgataaaatcttaacttttctattttaacagtgaaatcttttgcagagcaaaaattttgatttttgaagtccaatttatcaagtatttattttctagatcatgctttcagtattatatctaagaattatttgcctaccccaggtcatgaatattccttctcatgttttcttctaaatgctttatggttttccttttttttttttttttttctttttttttgagacggtgtctcgctctgtcgcccaggctggagtgcaatggtgcaatctcggctcactgcaacctccacctcccaggttcaagcgattttcctgcctcagcctcccaagtagctgggactacaggcacatgccaccacgcctggctaatttttttgtattttaaatagagacggggtttcaccgtgttagccaggatggtctcgatttcctgacttcgtgatccacctgcctcagcctcccaaagtgttgggattacaggcgtgagccgtgcccagcctggttttacattttacacttagaactatgatccatttctatttacttttttaaaaaggcatgagtttaggtggaggttaattttttttacatgtctatatccaattgttccaacaccatttgttgaaaagatgatcctttttccattgaattgcctttgcaatttcataaaaaatcaattggccatatttgaatgaagccaatttctggactcaattcagtaccactgatctacatgtctatcccttcaccaatgccacactatattgattactatagctttgtagtaaatcttaacatcagtgtaagtcatccaactttctccttttttcaaaattgttttggctattctggttttttgtttgtttgttttgtcttcccatatacattttagaattattatatatatattgagaatatgtctatttcttctttcagttttgtctatttttgcttcacgtatttttaaagtctgttaggtgcacacacatttagatttgtatgtcttcttggtgaatttacttttatattattacatgatgtctcagtttatccctggtgattttccttgctctgaagtctactttgattattaatatatttataccaactttatttttattcatgtttaaaatgtgtcttttcccattctttttcatttaaccttcctatatctttatacttgaagtatgtttctggtagacagcatatagtcgagtgatacctttttactcattctgattatctctattttaactagtgtgcttacaccatttacatttaatgttaatattgatatgtttgggtttagggctactatttaattatctgtttactcatcactccttatgtttttccttcctctgttaccctttttttcttcttcttttgggttacttgagcatttgttagtattctattttagtttcttattatttcactttgggctgtgtgtgtgtgtgtgtgtgtgtgtgtgtgtatgtgtgtggtgatgactgttacagtaaacaaacttaaactttctcagcatgctttgaatcaatatttgccactttaaatgtgatgtagaaattcttccaagatccctttaccttccatccttcatgttgtatttgccttatatattacttctatatgcattgaaaacccatcagataatgttatagttttggttttcaatgatcaaatatacttcaaacaccttaaaaggagaagaacagtctattatatttgcccaaatatttgctatttatattgctcttccttcattcctcatgctccatatttccttctggtgtcatttcctatctgaaaattttcatttcgtaattcttttagatcaggactgtttgtagtgaactgtattagttttctttcatctgagaatgtctttatttaaccttcattcctaaaggatattttcaccaggtataaaattcaagattaacaattcttttctttcagcacttaaaaatgttgttccactatctttttcatgaacagtttctgataagaaaaccgtagccagttcaataatacatcatttttctcttgctgctttcatagtattttgtctttagctcataatgatttaattgtgataggtctagacatggatttatttggttttgtcacatttaggattcactagacttcttgagtctgtaggtatatgtcttttaccaaatttgagaagtttttagctattatttattgaaatgatgtttcttcccccatgttctttctccattcattccgagtctctaatcacatgaacattagacttttgagtattatcccacacatcttccttcatttttaaaatattttttatgtcttttctgattggataatttctattactatatcttcacattcgctgactcctctgtcaattctattctgctattacacccattctgtaatttttaattttagttattgtatttttcagttctaaattttctctttggttattctttatattatctatttctttgttaggactttttatctcttcattattttcaagagtgtatgcccttacttatttgtacatattttatcagataatttcaacatttgtgatacattagcagtggcatctgttgattcttatgcaggttgagattttactgttgttcagttctgttccatgtgtgtgtcattgaatgaccagtgtgggacctagactgtgacctaccccttagttcagttctcaaagtatttagtatcctgtttaggatccatgcatgcacaaatccagggtgagctcaagagttcacagacaactttatgagttttcttcccaggctccctgctctccatgatctccctagtacttctggtgccctggggctcccttttcaatgttctaatcaggacactgaacttctctcctcccctccacattttctttttctttttcttttttttttttttttttttttttgagacggagtctcactctgtcacccaggctggagtgcagtggctcactgcaacctccacctcctgggttcaagcgattctcctgcctcagcctccctagtagctgggatacatgtgtgtaccatcatgcccagctaatttttttgcatttttagtagagacggggtttcaccatgttggccaggctggtctcaaactcctaacctcaaatgacccgcccacctcagcctcccaaagtgctgggattacaggcataagccaccatacctccctctcctccacattttctagtggcccctctctggagccaacagcaagataacaagtggagggaaagcaagagggtttcactccacatttttgaaaccacagcttctcccatcagagagaaatgttcccatgccccagttttaggaggaacccagtagctgctgttcttgctgtcactgcccctatcacagcacaattgcctaaagactggcagaagagaatggagtagagacttaaaggagaaagagtaggagaaaaagaagaggagggaaaaaaagaagaggaggagctgggggagagaaggaggaagaaaggggatttccaactctttctctaaatattagctaatcttttcctggaagaattagaggtctcctcctggagctctctgtgtctatgttccctttttggtttgggttgccttaagttcaggttaggggttacctagaaacaagaaatggttatcttatcacctatttggtggtactttgaattctgtaccactttctgcttactattacttttcaaataggagttgaaaatacttttcaagaagcacattctaattgaaccagaaccgtatcttatctggaaccataaacataatagacagttgtataaattgtgtttgcattttcaaataattcaaattgcagtatggcttccaataaacaaatatttgttttcttcatttgcctaactataaataacctagttccactacatgtgaagtttattatccattgacccaccagaggtactgctgtgtctttagaaatcagaagcattcttggccgggcgcagtggctcacgcctgtaatcccagcactttgggaggctgaggtgggtggatcacgaggtcaggagatcaagaccatcctagctaacatggtgaaaccccgtctctaccaaaaatacaaaaaattagccgggcgtggtggtgggcacctgtagtcccagctacttggaaggctgaggcaggagaatggtgtgaacccgggaggtggagcttgcagtgaacccagatggcgccactgcactccagcctgggcgacagagcaagacaccgtctcaaaaaaaaaaaaaaaaaagaaatcagaagcattcttattaataatttcaaaaaataattatttggccaatgttatctctacttccttctacttttttctattttactaaaggactatgataaatacaattacatgaagatataatttgtatttaggataaaaaattaatatagtattatgttgtttgatttgacaataattcgaatctctacatggctggaccatttgattatgcatttaaagcaacaatagcataaaaagccccaacatatcaaagactaaccaactaaatagccagtgatataaataaagaaccatttttagaagaagtctatgctgctgtttaatattttgaatcactccacaatgctgaaatcatttaaagaaaaaagatttttatttttatgtgcctgggtttccaatgctacttatacttactaaattataagaccttcatggtctttcataaaattaaaattccatgaaaaaagtataggtaggagttacttctcctaaaaggtatgtcttatctatctaaacagagtgctaaacactcgttgagacaagaatcacatctttgttaatatatgctaataaggctacgaatgcctggaaaatggaactgccaaagtgaaaaagaatctgggtaatattcctgggcactaaaggaaacagaaaaagccagaccaagaagaaagatctgatagattttgtgtatttcaaggcatgatggaactggccagaagtggggaggaggagttgaatgaaatttaactattaagaatatgataggaaaaaaaagagtgggtgcaaatgaatataactggcttttcagataacaaagagaacaaaatgtatcattctgtcttagcacatcaatctgttgataatagtttaataaaacccatttgttcctagacttttagaagttagaaatgcagcacatttttactatgtaagtgttccttatccaataaaactttgattacatagcattgattttattagatttgtacaaatttttcccaaaactccctcttactctacttgtgaaagacaaatatggtttgaaatggagacaccaaatatacactgtttatcccaatggatacttgtggaactataatctttaaaaatgctgaaagggggaggtgaatttccaccgctcactcaaattgaagtgggggaagtgatcacagtgagaatgtgtatggaaagcccacagtaactgttaaggttaagatcacaacttgccaatttagggtttttagaatgacctagctatctgatatataggtaggaaaccaagagttagtaaatggaccatatgtttataagcagagtatgtttcccatggaaaaaaaatacagatttctctgtgaagctgaagtagcctgttctcactctaacctagttattagagtccaaccatattcttcttaggatttcctaagtacctagaatggtgttctacatatagtaaattatcaatataaaagaataaaatttttactttttgtagtcatattatgtgtgtatgtatatatatacatatatttgattcaatttaaagtatcccagtggattttgtctaaaaacacaaagaataggatatgaagtttataatctactgacagtcccaaatatactattttacttgctttaatcaccaacaccaacctttgaacatagtgggcagtcaataaatatctggaggatgagggtatgaatacatgtatttgccagactataacccctgatgaaggaaagggattggccgattctttattgtggctccctacaccaaacattctgagctagcatacccacaatgaaagaacatcatctgaatgaagcttcacaattgctctctcattaccactgggcttctggcatccagcacaccttggagtcctagtgttaaggaatgtattctgagcctctgccggcacaggcatgtcacagtgatgcttctaaaacaaaccagagctcaggtttgtttcaagtcttcacatgcttttgatggaaggtgtgctggcagctgttgtcatcattagccttgtggcaatactttttcctttagtgtcttatgtttcatatgaaagcttaaagctcattaaatagggaggaactttggaatatgtgccaatgccaaacagtaaagtttttattttctcctgttataacagctttaaagttctgaatttccaaatcttagtccccaacaccattccaaattttaaattcgataatggggtaggagcagaaggataccaattccttttcctgactttacaatctttaccagagatctagtaagtgaaagatttagagcctgctagaaaacttgggtgtggaattctcctgtaatcctggcatttatgggatgagtgagctgtccatccatggttctgtaatctagacagttgagatatctgaatctgaatgctcaacctagtacagtcttccatggtattcacatttttctagcagctgacctaagtgatacattttaaaacgcacaataactaatggtcactaagcacctacttactatgtgccaggcaatatcaaaaagcacttcaaatgttaaaatgctcacaaacgctctcagataaatatttatctccattttacagataagaaaacctaggattaaagaggtaagtaacttgcccaagtttttattcactataaggagactttttaaaaaggttaattagtactacttaatattataggtatcttctaaggcaagaactattatctatttcatctttgtatcctccaccatatctagagcaaaaccttacacatacaaacttcttaataaaggtttactgagcaggccagtgtgttggctcatgcctgtaatcccagcgttttgggaggccaaggcaggaggatcacttgaggccaggagattgacaccagattttgaggttacactgagctagcctgggtaacagagcaagaaaacgaaaggccccatagttgtggagtactatatatttattatgtatatttctttctctctctttccctctctctgttttaaattttttcatattagaaaataagtttaagttctagagccttccaagtcattcatacacacacatacacccactcatttgccaaatttacttgggtccctctgaaaccacaagtagcagctgcttaataggtgaacttcaacaccaagcaacaggttggggcaggtaattaagaataccaaatccatttgaaattgcaggggaaatttagggaagtagaacgtatttatcagagttggaatttggccaggattctaaagaaaacaccaattaccctttgataatataaaatagcatataaacactgtttaactgaatttctgactaaggttaagaattccagagactcacagaagggacacatcattcctggacaaattcttccattgagaaagttctttatacttccatagtaacccccttgcctctcacaaagaaaacctcttgttgtcaggttagtaatgaaagtgaattctaataaacagagctggagcaaataagaggtctttctagcactactagctattgtgcaccttagatttagatatctcccttccacaaagtatcacaacctcacatatctcaatgtagaagacacttcaagagagccgatttcatcagaatggcaactttctcagacagctcctctctgcccaagataatttaggtgtgatcatgcttgacatgaagtatgaattcggtaactttctaaggtctctaaccaccttcaagttaggaattctattaagggacctaaccaaaacaagataaaaaagagaggggtctatagatttaagagatatagtgactaagtacaacatgtggactgtgtttgaaacctataattgaagaaattgaacacagatggaatacttgatatatttttaattttctattaattttaagtataattgcaacgattatattttgaagatatacacactgaagtattcgtaaatgaaattctgtaatacctagtattagcttcaatatgaaaaaagataggaagaagttagtgggtagatgtccatgtgttgataattactgaagcccagtgatgggtacttgggagttcactacactattttccataggttgtggcataggtgaaatagatcattgttcaagtgcaatttctgttaacacaattttctctcttttagcaaatgaaagcatctaagaatgcaaataaatgacagtgattttttatagcaataatcttgaatttccactatttcataaaataagtaaactttctaaaacttaatattctaaaacattaaccctcatacaattgtttagtttttgtttaaaattttccattaaaataactttaaaaaagatatcctgtacccattttcaccactcctatttaacatagtactgaaagtcctagccagagcaataatacaagagaaagaaataaaaggcatccacactggaaaagaggaagtcaaattgtccctctttgctaataatatgatcttataccaagaaaaaaactaaagactccaccaaaaaactcttatatttgatcaatgtgttcattcaatttgcaggatacaaaatcaacatacaaaaatgagtagcagtcgggcgcggtggctcatgcctgtaatcccagcactttgggaggccaaggtgggcggatcacctgaggtcaggagttcaagaccagcctggccaacaaggttaaaccctgtctctactaaaaataaaaaattagctaggtgtggtggcgggcgtctgtagttccagctacttgggaggctgaggcaagagaatcacttgaaccccagaggcagaagttgcagtgagccaagatcgcaccactgcactccagcctgggtgacagagtgagactccgtctcaaacacacacacacacacacacacacacacacacacatcagtagcatttctatacaccaataatgatctagccaaaaaagaaatcaagaaggaaatcctatttacaatagctacaaatgaataaaatacctaggaataaatttaaccaagaggtgaaagatatctacaaggaaaactacaaaacataaatgaaggaagtcgaagaagacacaaacaaatgaaaaaacctcccatgctcatagatcgaaagaattaacagtgttaaaaagaccatattgcccaaagcaatctaaagattcaatgcagtccctatcaaaataccaatgtccttcttcatggaattagaaaaaaaaaatcctaaatgtatgtggaactagaaaagaactgattagccaaaagaactgattatccaaatcaatcctgagcaaacagaacaaatctggaggcatcacactacctgacttcaaatataagactagagtaaccaaaacagcatggtctggttataaaagtagatgcataggccaatggaacagaatagagaacccagaagtaaaactacatatttacagccaactgatctttgacaaagccaacaagaatttacactggggaaaggataccctcttcagtaagtgctgccacaaacccacatgcagaagaatgaaactggaccccatctttcaccatacaaaatctattcaaaaatttatacatactatatataaaaatcaactcgaaatggatttaagacttaaacataagacccaaagctataaaaatacaagaagaaaacctacagaaaactctcctggatactgggctaggcaaagaatttatgactaagacttcaaaagcacaggaaacaaaaacaaaaatagataaatgggtcttaattaaactaaaaagtttctgcacagcaaaggaaacaatcgacagagcaaagaggtaacctgttgaatgggagaaaatatttgcaagttattcaacaacattggtctaagctgacacatccagaatatacaaggaactcaaacatctcgagagaaaaaaaatcatcccattaaaaagtggacgaaggacatgatagctatttctcaaaagaagacatacaaatggctaatgggcatctgaaaaaatgctcagcatcactaattatcagagaaatgcaaatcaaattacaaggaggtatcatcttactccagtcagaatggccattattaaaaagaaaaaataacagatgttgatgaggatgcaagggaactcttatatgtggctggtggaaatgtaaactagtatagccattatggaaaacagtgtggagatttctcaaaaacctaaagctagaattgccatatgacctagcaatcccactactggctatccatctaaaggaaaagaaatcaatatatcaaagggatacttgcactctcatgtttactgcagcactattcacagtagcaaagatatggaatcaacctaaatgtccatcaacagatgaatggataaggaaaatatggtatatatacacagtgcaatactatttggccataaaaggtaatgaaatcatgtcatttacagcaacatggatgtaactggaggtcattacgttaaatgaaataagcgaggcacaaaaagacaaatattgcatgttctcacatatgtgggagctaaaattacatggagatagagagcggaaagatagacaacagagactgggaaggatgagatagggggatgagggagatgaagagaagtgggttaaaggacacagccatacagtaagatagaagaaatatattcaatgtttgatagcagggcagggtgactatacttaacaaaaacgtattctattcaagtgatagacaccctaaaaatcctgccttgatcactacacattaaatacatgtaacaaaattcacatgtacccataaacttgcacaaacaaaacataaatgaaacaaaaataactcctaaatcaaacaaatcccattatttttctaaacttcaagttgagttgaacccaattaataacgttttattgaccaatacatgaagccaaagcactttttgggggtttttttagtacttttaattttaaatgtgcaataaattcactcatgctttttgtaaacatttgaatggtatttacaaaatttcgacatgcttccattaacatgctaaaatatattgtgcataccagaaaggtacgatacggtttctgccttcaagaacttacagccaaatttgaaaactagatttaggtaggatatacaacattaggaaagttttaacatctataaattaatatacacagttattcaaaccacagttcgttttaaaaaatcaaaacaaaactaaacccaactaatttatcattcaatccaaattcctacatctatttgcttagtttataattattttgtattactgctttttaatttgttagactttattttttagagcagtttttcttcacaacaaaattgagcagaaggaacacagatttgttatataccacttcttccaccagagtggtacatttgttacaattgatgaacctacaatgacatatccttgtcacccaaagtccgtaatttacgtctgggttcactcttggtgttgtgcattctatgggtttgaaaaatgtacaatgacatgtatccaccattacagtataatatagagtagtttcactgtcctatataagtcttctgtgttctacctattcatccgcctcttcccccaatccctggcaaccattgatctttttactgtctccatagttttagtcttttccagaatgtcttatagtgaaaatcatacagtatgtagccttttcagataggcttctttcacttagttatacacattttaggttcctccatgccattcatggcttgataactcatttctttttagcactgagtaatattccattgtctggatataccatagttaattcatccatttacctattgaaggacatcttagttgcttccaagttttggcaattatgaataaagctgttataataaacatctgcatgccagtttttgtgtggcatgttttcacctcacttgggtaaatacaaaggagcatgactgttggattgtatggtaagactacgtttacttgtgtaagaaactgccaaactgtcttccaaagtggctgtaacccttttgcattcccaggagcaatgaataagaaatcttattccgtcacatccttaccagtatttgatgttgttagtgttctggatctgggctattctaagattcgtgtaatggtattttactgttgttttaatttgcatttccctgaggataaaaggtggatcatattttcatgcttatttacatcatatgcatatttggtgaggtgactgttaaggtctttgggtcattttttaaaatcagtttggtttttcttattgttcagttttaaaagtcctgtgcaagttttggataagagtcctttatcagatatgtcttttgcaaaaatttttccccagtctgtgcctgtcgttttattctgttgaaggtatctctctcctagcagaaatttttcattttaataaagtctagtcaattatttatttcatggaccatcctgttggtgccattaatgtcatatctaaaaagtcatcaccaaacccaggtcatacagattatcttctaggagctttatagtttcccatttcactttgtctatgatccattttgagttaatttttgtgaggggtataggattgtgtctggattctcctttttttttttttttttttttttttgcatgtagatgtccagttgctccaacaccatttgctgaaaagactatcttttcatggtcaaaccacctttactcctttgtcaaagatcagtcaactatatttatgtgggtcaatttctggtttctctattctgttccattgctgtatttgtctattcttttgctaatttgtccattctgtcttgattactgtaacttcatagcaagttttggtcaggtagtgtcagccctccaactttgatcttctccttcaatgttatgttggctattatgagtcttgtctctccaaataaagttagaatcagtttgataacatccacaaaataactttctgggattttgattgggattgaattcaatctgtatatcaaattgagaaaaactgatgtcttcacaacattgaatcttctatacatgagcatggaatatctttccatttatttagttctttgatttttttcagagttttatagttctcctcatatcttatacctattttgttagatttatacctaagtattttttggaggtgctaatataaatggtattatgtttttaatttcaaattccatttgttcattgctggaaagtgattaacttttgtatattagccttgtgtcctgcaacctttctgtaatctcttattagttccaggattttttgtcaattcttttgaattatctacatagaaatttatatcgtatgccaaaaagacagttttatttcttccttttcaatcattacacattttccttctttttcttgtcttattgtactacctatgacttccagaatgacactgaaaagcagtggttaagagggaacatccttatcttgttcatagtcctagtggaaaacctagtttctcactattaagtatgttaactgtaggttttttgcagatattcttgtatcaagttgaagtagttcacctctattcctagttgactgagaatttttatcatgattgattcttgcattttatcatatactttttctgcatctatcaagatgatcatgtgatttttcttctttagctattgatgtgacgaatgacattacagcaatagtccccctgccttattcaaggggcacacattccaagaccctccagtagatgcttgaaattttgaatagtacccaaccttcttgctgtcaattggaacacatttctgtacatgtcttctgctcacacacttaatgtcttttccatcttatctagtgtttatcatacactgtggcaataacttttgctgttgagatatgagagcaaaactagcacgtttatttttccttcttcacaatctcctggttagaagattcattcttaccatagttcttagcaacctcagcatactttttttttctttccttattaagtcaagaacgtttacttcttcacttcaacaaagcactctacagcaactctttggtgtatccaaattaccagcatcactactcttgtactttggggtcattattaagtaaaataaggattaattgaacaaaaacactgtgatatcttatatctgatatcacaatctgataactgagatggctactaagtggataatgggcgggtagcatatacagcatgaatatattgaacaaagggatgattcatgttccaggtgggatacagcagaacagtgtgagatttcttcctgctactcagaatagcactcaatttaagatttatgagttatttctggaattttccacgtaatattttctaaccagggttgagcacaggtaagtgaaactgaagaaagtgaaactgaattgtaggagggtgccgggagagactactgtgattgatttttgaatgttgtacctgccttttacacctgagataaatctcacttggtcatgttgtataattctttttatacattattggatccaattaattttgttttagaatctattgctgcctaaagtcctttaagcatatgttgcagggagattgtgaattgaccccaggttatccctgcctcctactgtttatgcttgtataatcccctctgcttgaatgtggacttctagccaataaaataagacaatgataatgaaatttcctgtcactcctgtgattatgttaatgttacattccacactatcgtgctagcagacttactccacagactcttcttattgactttatgaattaaacagccatgctgggaaagcctgcacagtaagattgatcaatgcgttcattcaagttgcaggatacaaaatcaacatacaaaaatgagtagcggtcgggcgcggtggctcacgcctgtaatcccagcactttgggaggccgaggtgggcggatcacctgaggtcaggagttcgagaccagcctggccaacaaggttaaaccctgtctctactaaaaataaaaaattagccaggtgtggtggcacgcacctgtaggactatggacagcctgaggacctacaggcagctgctaagagctgaggctgacttccaattgacatcacacaagaagccagggccctcagccctacagtcacaaagaaattcatgcagttaacaacttgagtgagcttggaaacagattattccccagtcaaacctacagacaaaactgcaacccagccaacattttgattataaccttgtgaaaccctaagcagaggatccagctaagccattcccagattcctgatacacagaaactgtgagataacaaatgtgtgttattttaagtcaatgcatttttggtaatttgttatagagcaatagaaaagtaataaaaaagaaatgtttaagtcgtaatatgtaagagttctattgaatcctacaatagtactagatctttgtttgtttgtttaaaaagcaaaactttgcctggctaaagtcaacatgtcttttaaaaagacttctatgccaccctgggaagaataatttttcagatttagtcagatttttaagaggacacattaattccagaggaaataatccaggaaaattggcatgtgccatatcagagtagataggaaaatgaacagttatctccattaatcttcaaatttcaaagcaagtttgcatcctgggatacttggtcactagatattatcctttttatgtatcgttggaattgatttgctaaagttttaagaattttttcatctatgtctatgatagatattgctctatggctttcttgtaatgtctttgtgtggttttggtatcaggacaatgttgttctcacagaattaattgaaacatatatcctctgcttcaattttctgaaaaactccatgtacaactagtattatttcttcctcaaatgtttcataaaattcatcaaagcctacaggagtattcaggttatctatttcttcttgagtgagctttggtagtttgtctttcaaagagtttatccatctcatctatgttttcaaatttattaccataaagtttgtcataatattcccttattatatctatctatgtacctattcttaatatctgtggaatctgtacttgtcatctctatcattatgggtattggcaattcgtgttttcttttttcctcatcagtttgactagagatttatcaattttattgattttctctaagaatctggtgtggtttcatttatttttctctttttgtttattttccatttaatagactttgctcttaccattttttcctttttctgattagttttaatttgcttttttttccatttttataaaagagaagctgaggtcactcatttaagatcttctttatagcatttagtgctataatttccctctaagcactgctttgacagcatcccacaaatttcaatatgttgtgcattcatttttattcagttcaagtacgttatttccttttttgtttctctttttttttttttttttttttttggcccataggtcatttagaagtaatttaatttccaaatacttagaattttcctgatagctcttttactgaattctaattccactgttgactgaaaacatacattttatgatttgagtctttttaaatttattgagacttatttaacagcccataatctgatcaatgtaggcaaatgttgtgtatgcttaaagagaatctgtatcctgctgttgttgagtctaatattatataaacattgtcattatttgatagtgttgttcaagtcttctatatccttactgatgtttttctacttgttctatcaatatggagacaggttgaaattgtggatttggctatttttttctttcagttctatcagtttttgttttatgaatttctgaagtctattaggcaaaaaagatttagaaatggtatgtccccttgacaaattgacccatttatagaaatgactctttatccccagtaatattctttgcgatctattttgtttgctataattataaccactacaccttactttagattagtgttagtatggcatcttttttctttcttccttcttttctttcttcctttctttcttttgttcattcttcttttttgagacaggatttcactttatcacccaggctggagtgtagtgatgcaaacgtagctcactgcagcctcaaaatcctgggctcaagcaatcctctcgcctcagcatcctgagttgctaaaactacaggtacaaaccaccacacctggctaatttttgtattaaaaaaaatggtagagacagttttcactatattgtccaggctagtcttgaactcctggcttcaagccatcctcctgccttggagcacattttcatcagtctgtgggtgctcaatgggtccactttagtgatttaggaggaaggaatgatataacactttttttttcctttaaaacactggttgggtggtttgcttagtgagaaaactgatattaagtttgagtgttataaatttcctttagtgaagtccagtcaaacagtataggagaaaagctgtaaatgctaagaaagcactgaaagactttagcatttaattctagatgatgtatccaagcaccaggataaggcctcacaattctacccacacattgcaagcatccaatatatctgtccctgcaagccttgacattcttttagcccacagctgctttgggtagtgagatttcttgacttgccatggcaaggttccttgtattatgatatataatggaatgaattatttcaatggatccaattgtatactaatgccatgtctcacaaggactggtcagagtaaagacagtaagagagcctgccgtgcaaaccataattgaatagagtgtttcttcaccatgttgggaaaaggctgttaattggctcatgtaaccttttctaagatttgttcattggatgccaaaaaggaaaacagtgacattctgagtcacccttatgtcaggtattagatatttattccttgaggaaataaatttttaaccagaaattacttccattttcataaccaagtcccaaccctgtagaaaaaatttattctcaaacccaaagtttttctattttcatcaataattttaggttagggcaaaggacgtgaacagccacttctcaaaagaagacatttatgcggccaaaatatatatgaaaaaaaagctcaatagcaccgagcattagagaaatgcaaatcaaaaccacagtgagataccatctcatgccagtcagaatggtgattatcaaaaagtcaagaaacagatgctggtgaggctgtggagaaataggaatgcttttacagtgttggtgtaaaatagttcaaccattgtggaagacggggtggcgattcctcaaaacctagaaccagaaataccatttgacccagcaaccccattactgagtatatacccaaaggaatagaaatcattctattataaagatacatgcatgcatatgttcactgcagcactattcacaatagcaaagacatggaatcaacctaaatgcccatcaatgatagactgaataaagaaaatgtggtacatgtacaccatggaatactttgcagccataaaaaagaaccagatcatgtcctttgcagggacatggatggtgcttgaagccattatcctcagcaaactaatgcaggaacagaaaacaaacaccacatgttctcacttataagtgagagctgaacaatgagaacacatggacacagggaggataacaacacacattggggcctgtcagaggcggagtgggggagggagagcatcaagataatacctaggtgatgggttggtaggtgcagcaaaccaccaaggcacgtttgcctacgtaacaaacctgcatgtcctgcacatatatcccagaacttaaaagaaaaaaaaataattttaggggccaggtgtggtggctcatgcctgtaatcccagcactttgggaggccaaggtgggcggattatgaggtcaggagttcaagaccagcctggccaacatagtgaaaccctgtctctactaaaaatacaaaaaattagccaggcgtggtggcaggcacctgtaatcccagatactcaggaggctgaggcaggagaatcgcttgatcccaggaagcggaggttgcagtgagcggagatcgtgccactgcactccagcctgggcgacagtgcaagactccatctcaaaaaaaaatttaattaataataattttaggttattcagggaagatagcctctgactaacaaagttattgtttagatgaaacttacctgttgctgagctaccaaggatatctactattccttattttactctcaaaggaaatctatccaaagaaaagcatttttcgtgtgtgtctgtagctttgagtcagaacctttatggcttggttgcctgatgaaatagaatagcagttcctgttagcaccttaacttctcagtattttcaacataatcctgttgattttgtatactggatcttatctgtttccttatctgttatatttaattagaaatagtgatacaggtaaaactatttttcagtttttgagatgaacacatttgtttaatacagtgagagctggagttttagaaactttcatctggagaccaaaatgaataaagtaattattaataggtatgataatacagtcagactttatttttgatagtaatcatacttaactgggtcatcttgaacaaatatgaatatggcagagcaagaaccaaccacataatcctacggggcaatgcaaagtaaaaatgtggggcccactgttcaaaaattgttaaaaattccaaacgaatcattaaatcaaaccatagtccttttgggtgcaggatcctggaagctcgccctggacaaagcagacatactgagatagaagtcactgttaagaccccctcatactctccacttaattttttacctatttgggtgatcacacacataatttcatgatgtcttattactagtgagatgttcacagcagtgccagtaaacttagaatccattgaggagcaacaatagctgttaataaggaactgcaaacctttctacatgttttataaattagataataatcacttaattattgagtttaatggcactttggttctgatgatttaaaactggttttaatgtttaaccaccaaactgttgaactttttcatggttctgattattcctccacctgaaatcagttaatcaatatgaaaatcaactgtaataccggatggccaaggggcagaggtgcaataatggaaagatgctaaagacatttacatattgatatctaatggctgcatacagcaaaaacactgtaacacctctacaaataactactatatattgtctgcctatgaaccagacaccgtgataagcatattaattcatttagtcctcctaacaatcctatgaagtaaataagggaaaaaagagtattcacgaaagtaaagagtcacttaaatagacattacaaaaattgcactgggaactataccaactatactcaaatagggtcatcaagaagaggtcattaaagggactatttacaagtgtgggcagatttgagagaagctattaaggaagaatgtagcacctgtgaggctagccacagcaagagccccaagaggaggagaggttactgtgacctgcaaaagcctcctacagatgtggcctccattagaggaatgtggccaaatgccagtgacctcatagggagagagctgggaaaataaatgcccagaccacattctcctccctccctcagatttcctattgatgctccccactgatcaaaaccaactagaggccacaaaggagcttaattttgtaatctagtgattctcaaaggttagaatgcttcagaatcacttggccagtttgtcgaagcacagattcctgggtcccacccccagagtttatgattcaagaggtctgggatggggcctgaaaatgtgcacttccagcaagtccccaggtgatactgattatccaggggccacatttggaaaaccattgatttaatttaaaacaggtcagcctctctagacagaaagcagggtagataagggaggagtgtgcaattggaagacatccagcacaggaacaacagaagtgacatgaaaacaacagacttgcttatcatccaaaccactgcctctgatgattgcccttttgttcttctttcctccctttgtgaattctaaaaggtttatttctttgccttggtgcaagcaaagagaagcattaagtattttcaagatacctcccaaatagccccttttaacaactccaaacttcagacaatgtctagtctaaactgcctctcaccaaccagaacggatgccagcaaggaaggtttgacacacacagcaggaaagagccgtgacttttccttttactactatgttcaagagcctaggatgcttcggaaaggaaaatctagaaaactgacagttttgatgctaaatctatggcaggtgcttatgagtgtcttgactataaaaattaggttggttggatcatcaatcaggacttgtagtagctgaaatataaggttgaactggatggtctcagttacaatgcagtttgctattactagtctgtattaatccattctcacactgctataaagaactacctgcgactgggtaatttatgaagaaaagaaatttaatcgactcacggttctgcaggcttaacaggaagcatgaatgggaggcctcaggaaacttacaatcatggtggaaggcaaaggggaagcaaatatcttcttcacgtggcagcaggagagagtgatagagcaaagggaagtgctacacacttttaaacaaccagatctcatgataatccactatcacgagaacagcaagtggggaacccccccaccatgatccaaccacctcccaccaggtccctaccccaacaccaaggattacaattcaacatgagatttgggtggagacacagagccaaaccatatcatggtccttgttgcattttcattaaagacaatgagattatactgaaaacaactgaatccttctcttagcaaggcagaaaccgaaagtataactaaaagctaaaatgttaccctgctctgtgtaaacagagtagagcatgtcagattaatgaatgacctacttgcgaaaacgtgtagacaaggattttatctgtgtttgatagtggaaaggttatatccacttcctggcagagatctcagaatatctaatttatgtgacaaaaatgaaaagttctcaagaaatataccaaggcatgattagcctatttattcccccaggggtttaacactagcttttagttgtctgctcaatatacatagtatttttgtttatttattttgtaggattgtgttaacttaagctttgaaaggtgtgcacattttttatttcctgccttatctgggaaaaaacctgacgagatgtcagaaatagatcaggtttaaattagttttatttatttttatttttatttttatttttgagatgaagtctccctctgtaccccaggctggagtgcagtagcgcaatctcagcttactgcagcctctgcctccccggttcaagcaagtctcctgcctcagcctaccaagtagctgggattacaggtgcccaccaccatgcctggctaatttttgtatttttagtagagatggggtttcactgtgttggccaggctggtcttgaactcctgacctcaagtgagcctcccaccttggcctcccaaaatgctgggattataggtgggagctaaattagtattttaaattagaatcctacttgctacattactagggagaaggaaggtgatagatgttaacttgtatattctccatttacttactgtttactatttataagcaaatttctaaagcaataatcaccttagcattttaattccaaataccaatctaagaattaaaccaaataattattccacccagaatgtcattaagttctattagtctttttagtgttcatagtttcatctatgaaattggatttaacactgtgttctttaaaagttgaattatgatctggcccagtgtggtggctcatgcctgtaatcccagcactttaggaggccaaggtgggtggatcacttgaggtcaggagtacaaaaacagcttggccaacatgctgaaaacttgtctctaccaaaagatataaaaattagccagatgtggtagcatgcacctgtagtcccagctactctggaggctgaggtgggagaatcgcttgaatccaggaggcggaggttgcagtgagctgagattatgccactgcactccagcctggggaaaagggcaagattctgtctcaaaaaaaaaagttgaattatgatcaaaataatgctgtataaaatggaaaaagaatgaatgtactaatatccacttaaaaacacactaaattggattatttggccaaataacggaaattaagtcagtccaaagatgcacaattacaagctgttctccccacattttcatttgtgtattcctccaaaaactttggtctaattgcacagaaacattaagaccctagtcattgtttcatgactcctagggatattggggtctccacaatgtgacagaagcccagagagaactgaagctaaatggatattgtgagactggtaatcaacaaaaatcacagtgtctgggtttcagggcctaactctgggctgttatctttttcccagacggctgatcaagtggatgaggtatgaaatgaaagcaaaactccaagcaacaatactcaccagttggttcaatagcagtatcatttttaaaataatataaaatcaacagtacttgccataaaaatttcaaacagtagagagggcataaaattaaaagtaaaaaaatacctttatccctcttcagcttctaattgtattgcccagaaggtttttttttttttttgtagtcttccaggcattttctatgcaaattcaaataagtaaacataaaatatcctttgtttatatacaactgagatcatactctatatattaaatctgtaatgtttgtttctgtttttgttttttttgagacagaatctcactctggttgcccgggctggaatgcagtggcatgatctcagttcactgcagcctcgacctcccaggctcagcctcccgagtagctgggactacagacatgctgaccaccatacctggctaattttttgtatttttagtagagatgggatttcgccatgttgcccaggctggtcttgaattcctagactcaagcaatccgcctgccttggcctcccaaagtgctgggattacaggcaatgaaccaccgtgcccaacctaatctgcaattttttttttcatatactgtatcttgaagatttttctatagtggcacagcaggtcctcaaataacgtcatttcattcaacatcatttcattttaacattgatgagaaaaaaaattgattcccagccagggccatgtgaagtttgcatgttctcccatctttggtgagttttctcccaatcccaaaaatgtgcacattaggtgaactggtgtgtctaaatggttccaggatgagtttagggacatgtgtgagtatgccccgcaatgggatggaactctctgtccagggttggttcccaccttataccctcggctgcagagattagttctggcctcctgtgaccctgaactgaaataactgggtaaataattatcttacttatttttattaatctttcttaagcatacgtataattcacatttatttcaatgtttaatattagaagtgttttggtctttattgagaaatttggtgatgttctcatgaccagaactatgttatagaaacttaattcttggccaggcgcggtggctcatgcctgtaatcccagcactttgggagactgaggcgggcggatcacgaggtcaggagatcgagaccatcctggctaacacagtgaaaccccgtctctactaaaaatacaaaaaattagccgggcatggtggcaggtgcctgtagtcccagctacttgggaggctgagacaggagaatggcatgaaccctggaggcggagcttgcagtgagccgagactgcaccactgcactccagcctgggcgacagagcgagactccgtctcaaaaaaaaaaaaaaaaaaagaaacttaattcttgtttatatcaattagcctgtggtaaaatttatgttgttatacatcatttcccttaaagtcagtttccaagaacctagtgacaatgttaagtgaggacttaatgtacatatagatgtacctcacagaatgtattaccacataaattatggttactataatttaattaaccagtcccatattgatgaacattcagtttgtttctagatttttcctgttaaaacagttgagctttgtcacctggcttctataattttggaagcctgttatccccattgctatcagtaagactagttctgtgagagtctctctcttactgtcagctgtggcctatagaggatagccaacactgagtttctcaatgattatggtactcctttcaccatctcattccttatcactttagaaagcaggttctcctccaggctctgagtttatggcactctcctagaatataggatttagtcacctggcaagaactccaagagacactgctaccatgctgacagggtaactcttagaaccaaaaaaacaaaacaaaaacaaaatggcctacactaagtgaagtgaaaataccatccgcttgccaaactcataagccattagaagcaaggtaggcacaattatcacaagcaacagcagatcactgtgaaagttccctgaaccacagaaagatacagattttttaatagagcatggtacccatggtgccagacagatgggaagccaataagggtattgctcaatctaactgatcaaaagaaatcaaagatggatgaaacaagaggttgatggtaactactgccaacaaaaaaaatgaaatcccttgtttggtttcaagacctgagccaattctcagtcccagaactcaccgactaaatcaaaagccagggtcccaaggaggaagtaccttacaacatcatagcaagtatatacaggaatatagctattatttcccaaagactagaaaaaaagatattcgtcaatatggaactgactgactaaaccacggtacatcccaacacagaatactgtatagctgtaaaaagaaatgaggcatctctctttatacttatatgaagggatctccagaatgtatcattaaatgaagaaaacaaggtgcaaatcagagtatatgttaacttttgtcaaaaaaaagaaagaaaaaagaaaagaaactaaaatatacacattttctttttattttcaaagtgaattaatgagaagctaaactaaaaccatgcaaatgatactgtagagtgggaaagaaaatagtgaaagcacaggcacgcaaacaaaatttcgcatcagaaaactagatagtcacctcgaagggttgtcacttggcaaaggacaatttgagcatgaaaaataatactgattccaactgattaaaacacaacaaatatgtaaatccatgaattcataattaaactaataaaaaaaaaacttcatttgttaccattagaggttcttaggacacacaaacttactattccaaaaaattccatgaatgaagggaatcaaggatatattctgttttcatatgcaaactatatttcagagtaaacagtcactcttatcagagaaagttcttccttacagaagaactaattcatcaccattttggaacaattagtgaaataatggatataagtattaatcatcaatagctgctaaaaccctaagtaaaagattgatggaagtttttgggtggccagattaggttagcagcacaaacaataggacaactgttcattgtctcctggtgtgatgtaataggaagcacaaggcaccatgtatgaagtatactgcctccccccaaaattgaacctgagtataaataagcctttataatttagtattaatttttaggaaatacaggatatagaacaacaagttaaatgacaccaggaggtaaaatgagccaatccagaatgcagaacatcatatggatgaatgatccagtttcttccaatacatcagaaaataaaaagagataaaactataatcagttaaaagaaatttaagatatatgacaaccctatgagatatgtagattttggatcctttatttttctagtgctgctgtaacaaattatcgcaaatttagtggcttaaaacgacactttattctcttctaggggtcagaaatccaaaaaggggcctcacaggctaaaatgcagtcagaccaccttccttctggaggctctaggagttaatccatttttttgccttttccagcttgtggaggctgtccacattccttgccttgtgccccccttgcagcaagggcatctctctgccatctgtttctgctctcatctccttctgtgattctgaccctcctacttctctcacatggaaacactgtaaatacactgagcacatccagataatccaggataaccttcccatctcaagatccttaacataatcacatctgcaaagtccccgttgccacataaagtaacatggtaacatagattccagggcataaaatgtggacatcttcgtagggatggggttatggggcaatattctgtctaccatggattctgattcaaacaaactaactgtgaaaagatttttttcacattgttggggaaattttaccatagattgggtatcgtattatataaaggaattactattaatttttaggtatgagaatgacattgtggttatgcttttttaaaaaaaaccttatctgatgaaatgcttactgaagtatttagaggtgaaatgatatgatctctgggatttgctttaaaatactaaaaaaaaaaaagaatatggggaacagattaaacaagatatgcaaaataaaaaattgttaaagctgaactatggtttcatagggttcagaatacttttctctctactgctgcgtgtacttgaaaacgtccacaacaaaaggttttttaaaaatcaaagataatctaataaggtttaaaagggaaggaaaggagagagtccaatgcttcaatgaacagttcttatgcaaatattgttacataccagtgtggatgtatggtaggataaattgtcagatacagaattgcatttaaaatgtttgtagtaattgctttgcatgaataataaggttgaacaactaagtaaacaaacggaaggttgtgggagccagatttctccctgtgagagactaaagttgcaaataaactagaaggggaggataaaataaaccctgtggtgctggattagaattgaagacatcagtatgaactcacggttagtttaatagataaatagacaggtagacactacttatagatatgtgtgtatacaccagttaatatacatacatacatacattacctagccctgttgactcagacatcctggaagcaatcacaccccagcagcaaagcacaaacccagtactcatatcttggcttctaaataccattttccaataaaaggaaccagagattcttgggaaactggctgattctaggactggggccgggaaaataaaaataagcctgaaacatcttacaataccagaaagtaaggaactgctcaaaaaataaaatgatagaagcatgccaaagagtcacaacagccaacctgaaagaactaatggccaaaactggaaaaatctgagcaacaaaataaataacatagcattggattataatcccaaattataaaataaatatacatgaatccataatgatatatatagaagatcaaataataagtaagaagaagtactagcattgggttaatgctgggatctactcttggtgaggctgataacattcaggaagtcaaggtaaaagatggttaagtgtaatgggacaggttacagcccaaagaaactcatagatacactgggtctattctaggtttaggttatatggtgttacattttgctttcaaagatgaagagattggacatcctgaaagtctttcaatacctgcaatattgggcagagctaagatagataatgctttaaaaaaattatttactaaacgtagctcttaagaatctctctataatctggtatttccattatccacatactggctcagccaccagtttagaaaaaggaaggtaacttagatagttttccaagggcatttcatacacttctgtccccacggaaccctctaacacccctggggatagttatccttaccttttcagtatgagtccagcaatagacactatcctataacaaatgaggttattaaggcaaagtgtcagctgccccacatgacaaagtcagagtctcatagtctcctctgaggagctgaaagattcctaaaatctttaagataaactctatacaagcatttgaatgattcattctcctcaaaggaactttacaaggttcaaggctcttcctggagaccccaggtgtggcggcggcagcagcagcaggcagcaggccactgtctttcccaacaggctaaaactgatgtcaaaagcagttgtaaaaatacctaccattgaaccaaaaataactattagaaccatgaatgataaagtgaggcaaaaagacttttctttaagcttaacttttaggcacttaagtctcagtactcttcacccagatgtctacatggatcactcattttcttcttttaggtctttgtacaaaggttatctcatcagcgaggcctttcttgatcatcctatagaaaacagaatctgcctcaattctggatttcctttctctcttatcctgctttattctcctcatcaggcatgctttatatttgtttacataatatccatcccctccagtaatctccattttggccatgattttgactattttgcttcccatggtctcccatttttctttagaacatttgcctggacagttaatagtggtcagtaagtatgtgttgattgaacctcaaactggaaatgacccaaatgtccattaacatgtgaatggataagcaaaatgtgggtacttctatacaatgggatactactcagcaatataaaggaaagaactattgatatgtgcaacaatatatggatgagtcttaaaatcattatgtggaattaaggaaccaggcacaaaatagtaaatattatataattccatttgtataaagcacaaataaaatagagatgaggctgagatgggaggatcccttcaagccagaagtttgagactagcctggacaacatagcaagaccctgtctcttcaaaaaaaaatttttaattagccaggcatggtggcatgtacctgtggtcctagctactccagaggctgaggcaggaggatcatgtaagcccaggagtttgagattacagtgagctatgatcatgccactgcactccagcctggatgacagagcaagactctgtctctaaaattaaaacaaaataaaaatttaaaaagcagatcagtggaagtgaggatagagtatagaaaaagggaggaactgcaaaggagcacaaggaatctttgtggggtgatggacatgttctgtattctgattgtggacaggtgcatacaatttgtcagaactcatcaaattgtacactttaaatacatgcagtttattatgcataaattattcctcaacaaagttgaaaaagaaaaaatatttgttaaatcaatttacctagtgtatttgcagcttaactaaaactttagaaattttggatacattgtgtttgcaaatttgaacttcaaaatgctggaaatatagaggggttttttttccctttctccatttcaagcaaggggtttcagagtgctatttcccatatatgcagtgaagaaagctttctttagctggcccaaggggctatgaagtaggagttttgaaatcagctgactcaagcataaataagtgacctatgcttaagaataactgaagaaaggtgagattatgcttgagtggaggttccatattataattatgctttacaaattcatttcagccattgatatcaaaatctctaaacactcaaatgtcttgattaacactttccttgaggccagggtcatgtacctccttgtaattaaatctccttaatatattcacataatgctgagctccatcttattgtccatatgaactatagcacccagtgttacagagtattgccagtgtaaaatatgaataccaaactctggtttaagtttttctgtagaattatcaatcttaacatataaagtaaaatccattttgaaatggatttctaattcctacagaatgttttttggacaactgaagaaatgtgtacttgtttttaaaatgaagctgcaatattgtaaaggaactctgcagccactcataacagcatagtgtgttttatgaataagttcacattagttacatttggcaaactggacaaagaagcaataatatacactatgaacgtgttacattccacttttaatcaacaaagctttcagtacattgtcatattaagaaaaacattgcaattagaaaaagaagctagattatttactgattattcactattttcacataaaccttctaacatttataataaaagatgaaattgttaaatctcttagccatgaaaacaatacgataaaaacctaaaatatgtactatattttactaaagtatattttagtatcgtaaatgacaggaaaaggggattatgtacacaattgagacatcaatgacaataataaattgcttgaaacttcatgttgcatagctagaaaagagatactttgataagtaatatcaattactatcctctgcattgaagagatgaagtctttaagtaattctgctcccctttttccgttctcagctatagcatgccccatgatctaagatccgaccctcctcattctctagagagtaacataaaagtgattgtttggaaataaaatgaggggttgaaactctgtatttcagaagacacaatcagttacctgacacccaacaccaatccttgctgtgttaagaatgtcagtgtttctcatgcctcactcaggaagagttgcttcaatacatccctccacagctttattcagtttggtcacacctcagggagtttaatttcatgcaaagcttttagacagtgctttccagtgacaggagcaaatctgggtaccttaaggagtttaggaaaaatgaaaacaacttgaactattaatgcttgatctgaactttggccttgccccagagttagtcttcaagaagtgagaagaaagcagaatgttggcaagacttgagatattaactaaaaatgtaaacatcttctaagataactgttgtagaagaaagaggtaaacataatggaataaaagatgatcttgttgtatttagggctgatattatagccataaagggaaatggcaataaaaagtggatgtcagagatttgactaaactgaactgatttcataaaaggcttaagaatcagcctgactgggaaaagagaggtaaaacacctgcgttactagtccccacatgaacaatgcatttattttcaaacaaagagtagataatgctcaagctttggaaggggagatctatttttcagagaaagtatggacacctgaaagaaacacaaggggcattgtgtttaggaatgaaacatgtgatctaaggaaatgccagtttatccaagttttggctgagttactgctttgtcaagagaagggacatatttttgaaacaactgtgattaactgaagtttaatgtgcctttttgtaattacctataattttaaaagattatattgtagcttgtaagcctggtttaagaataaataaggtgatctttttaaaaaacaaaacatcacatgtgttttattgtttagaatttacctccaaatacagaggaactctacattttgctatttactaagacaattttgtttattcaatttggcttctcttttggcctttggtttctgaacatggtcatatcaccaccgattacttaatatttctcaaagtttctgtaattatgcaagtgactgaaaaatcactctgcataactgggatttcaaataagataaattatcacaatttataggaccttgttgttccatgttctaattcaaaggatagtgcctgagtaaatttttcttatacattctagaactcacagacattaaaactctctgggtcacaaatgagctaaaagaataaatgcagactgttagaattgctttttgagtttcacgtcatttctgagctagaggacattctcctagctgtagtctttagctgtgtgacctcatacaagtttgatacttcacttctccactcttcttttctccatctgtaaaaaaaaatgcaaagctatcccacagaattattcttagtattactttttgtagttcgtgtttataaaaatgtatcagtatatttaccagtctctttgataaacattgttacttacatcccactcttctccattgttttcttgtgactgaggtatatcatttagtgttctcttgggaagaatctgtgagttttgcctttgaatgatattttcattggttattaactcttaagcagacagttcatttacctcaactgttagaagatgtttatttgctgtattctgctgatgccgatgagaaatctgtcagcagactatcattcatgtataagcaatccattttttctctaagattaaagtgagacaattggaattaacataattttaaggttcctgtcttatttgtctggaggacagatatattaactttagacttgttaataaaataattttaagaaagccactgaaattacagaatatataactatcaaaccagtagagggggagagaagtggtagatacagagaaaaaaaaaaacagagtaaatggaagcacaaaagatgataaaaataattctaaatatgtcagtaatcactaagtggcgtaaactcaccagatacacactggagactacaaaattgttactttcttaaatccatctgttgggttccaagatagccaaataggaacagctccagtctacagctcccagcatgagcgacgcagaagacgcgtgatttctgcatttccaactgaggtaccgggttcatctcactggggagtgtcggacagtgggggcaggacagcaggtgcagcccacggagtgtgagtcaaagcagggtgaggcatcacctcactcgggaagtgcaaggggtcagggaattccctttcctagccaagggaagtggtgacggacggcacctggaaaatcgggtcactcccaccctaatactgtgcttttccattggtcttagcaaacggcacaccaggagattatatcctgcgcctggctcagagggtcccacacccacggagcctcactcattgctagcacagcagtctgagatcgatctgcaaggcagcagcgaggctgggggaggggtgccggccattgctgaggcttgagtaggtaaggaagccgccaggaagctcgaactgggtggagcccaccgcagctcaaggagtcctgcctatctctgtagactccacctctgggggcagggcacagccaaacaaaaggcagcagaaccctctgcagacttaaatgtccctgtctgacagctttgaagtgagtagtggttctcccagcacggagtttgagatctgagaacggacagactgccccctcaagtgggtccctaacccctgagtagcctaactgggaggcaccctccagtaggggcagactgacacctcacatggccgggtacctctctgagatgaagcttccagaggaatgatcaggcagcaacatttgctgttcagcaatattcactgttctgcagcctccactgctaatacccaggcaaacggtctggagtggacctccagcaaactccaacagacgtgcagctgagggtcctgactgttagaaggaaaactaacaaacagaaaggacatccacaccaaaaccccatctgtacatccccatcatcaaagaccaaaggtagataaaaccacaaagatggggaaaaaacagagcagaaaagctgaaaattctaaaaatcagagcgcctctcctcctccaaaggaacgcagctcctcaccagcaacggaacaaagcaggatggagaatgattttgatgggttgagagaagaaggcttcagaagatcaaacttctccaagctaaaggaggaagtccaaacccatctcaaagaagctaaaaaccttgaaaaaagattagacgaatggctaactagaataaccaatgtacagaagtccttaaatgacctgatggagctgaaaaacacggcatgagaactacgtgatgaatgcacaagcttcagtagccgatttgatcaactggaagaaagggtatcagtgattgaagatccaatgactgaaatgaagtaagaagtttagagaaaaaagagtaaaaagaaaggaacaaagcctccaagaaacatgggactatgtgaaaagaccaaatctacgtctgattggtgtacctgaaagtgacagggagaatggaaccaagttggaaaacactttgcaggatactatccaggagaacttccccaatctagcaaggcatgccaacattcaaattcaggaaatacagagaacgccacagagatactccttgagaagagcaactccaagacacataattctcagattcaccaaagttgaaatgaaggaaaaaatgttaagggcagccagaggcaaaggtcgggttacccacaaagggaagcccatcagactaacagcggatctcttgggagaaactctacaagccagaagagagtggaggccaatattcaacattcctaaagaaaagaattttgaacccagaatttcatatccagccaaactaagcttcataagcgaaggagaaataaaatcttttacagacaagcaaatgctgagagattttgtcaccaccaggcctgccctaaaagagctcctgaaggaagcgctaaacatggaaaggaacaaccagtaccagccattgcaaaaacatgccaaattgtaaagaccatcgaggctaggaagaaactgcatcaactaacgagcaaaataaccagctaacatcataatgacaggatcaaattcacacataacaatattaaccgtaaatgtaaatgggctaaatgctccaattaaaagacacagactggcaaattggataaagagtcaagacccatcagtgtgctgtattcaggagacccatctcacatgcagagacacacataggctcaaaataaagggaaggaggaagatctaccaagcaaatggaagactcaaaatggcaggggttgcaatcctagtctctgataaaacagactttaaaccaacaaagatcaaaagagacaaagaaggccattacataacggtaaagggatcaattcaacaagaagagctaactatcctaaatgtatatgcacccaatacaggagcacccagattcataacgcaagtccttagagaactacacttagactcccacacaataataatgggagactttaacaccccactgtcaacattagacagatcaatgagacagaaagttaacaaggatatcaaggaattgaactcagctctgtaccaagcggacctaatagacatctacagaactctccaccccaagtcaacagaatatacattcttctcagcaccacaccgcacttattccaaaattgaccacatagttggaagtaaagcactcctcagcaaatgtaaaagaacagaaattataacaaactgcctctcagaccacagtgcaatcaaattagaactcaggattaagaaacccactcaaaactgatcaactacctggaaactgaacaacctgctcctgaatgactactgggtacataacgaaatggaggcagaaataaagatgttctttgaaaccaatgagaacaaagacacaacataccagaatctctgggacacatttaaagcagtgtgtagagggaaatttacagcactaaatgcccacaagagaaagcagaaaagatctaaaattgacaccctaacatcacaattaaaagaactagagaagcaagagcaaacacattcaaaagctagcagaaggcaagaaataactaagatcagagcagaactgaaggagatagagacacaaaaagcccttcaaaaactcaatgaatccaggagctggttttttgaaaagatcaacaaaattgatagaccactagcaagactaataaagaagaaaagagagaagaatcaaatagacacaataaaaaatgataaaggggatatcaccacccatcccacagaaatacaaactaccatcagagaatactataaacacctctgcacaaataaactagaaaatctagaagaaatcgataaattcctgaacacatacaacctcctaagactaaaccaggaagaagttgaatctctgaatagaccaataacaggctctgaaattgaggcaacaattaataccctaccaaccaaaaaaaggccaggaccagacagattcacagccgaattctaccagaggtacaaggaggagctggtaccattccttctgaaactattccaatcaatagaaaaagagggaatcctccctaactcattttatgaggccagcattatcctgataccaaagcctgacagagacataacaaaaaatgagaattttagaccaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaacgtaatccagcatataaacagaaccaacaacaaaaaccacgtgattatctcgatagatgcagaaaaggcctttgacaaaattcaacagcctttcaggctaaaaactttcaaaaaattaggtattgatgggacgtatctcaaaataataagggctatttatgacaaacccacagccaatatcatactgaatgggcaaaaactggaagcattccctttgaaaactggcacaagaaagggatgccctctctcaccactcctattcaacatagtgttggaagttctggccagggcaatcaggcgcaggagaaagaaataaagggtattcaattaggaaaagaggaagtcaaattgtcccagtttacagatgacatgattgtatatttacaaaaccccattgtctcagcccaaaatttccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagagatgtgaacgacctcttcaaggagaactacaaaacactgctcaacgaaataaaagaggacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatggaaccaaaaaacggcccacattgccaagacaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggccagccatatgtagaaagctaaaactggatcccttccttacaccttatacaaaaattaattcaagattgattaaagacttaaatgttagacctaaaaccataaaaaccctagaagaaaacctaggcaataccattcaggacataggcatgggcaaggacttcatgtctaaaacaccaaaagcaatggaaacaaaagccaaaattgacaaatgggatctaattaaactaaagagcctctgcacagcaaaagaaactaccatcagagtgaacaggcaacctacagaatgggaggaaatttttgcaatctactcatctgacaaagggctaatatccagaatctacaaagaactccaacaaatttacaagaaaaaaacaaacaaccccatcaaaaagtgggcgaaggatatgaacagacgcttctcaaaagaagacatttatgcagccaacagacacatgaaaaaatgctcaccatcactggccatcagagaaatgcaaatcaaaaccacaatgagataccatctcacaccagttagaatggcgatcattaaaaagtcaggaaacaacaggtgctggagaggatgtggagaaataggaacactttgacactgttggtgggactgtaaactagttcaaccattgtggaagacagtgtggcatttcctcaaggatctagaattagaaataccatttgacccagcaatcccattactgggtatatacccaaaggattataaatcatgctgctataaagacacgtgcacacgtacgtttattgcagcactattcacaatagcaaagacttggaaccaacccaaatgtccatcaatgatagactggattaagaacatgtggcacatacacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtggaattgaacaatgagaacacttggacacaggaaggggaacatcacacaccggggcctgtcgtggggtcgggggagcagagagggatagcattgggagatatacctaatgtaaatgacgagttaatgggtgcagcacaccaacatggcgcatgtatacatatgtaacaaacctgcacattgtgcacatgtaccctagaacttaaagtataattttaaaaatccagctgttaatctgctgttaagaagacatttaaacctgagagcacagaaaagttactattatagaaaaaaatacactaggctgtcactaccaaaattaaacgctggtggagctacactaattgtcataagcagaatttgaagatggccctaacatttccagtccctagtgtacacacacctttgtccagttatgcagtcaaacacaaatttaggtactcctgaaaaggaattttgtagatatcctaaatcagttgactgtagataaggaagttatccatgtgggccagaagaagccagagagtcaaagcatgagggagatttaatgcataaaatgttccccattactagctttaaaatggagagggctatgtggcaagaaactctaggagctgagagtggtccctaattacaggcagcaaggaaatggggatttcagtcatacaaccacagggaactgaattctgccacaaccacatgaacttggaagaggacccagagctctagctgacaacacagaccagccaataactgaatttttatctttataagaccctgagtcaaggaacaaataagaaaatgtggcctatagtcaagaaaagcaaaatattcaaaatagtacatctaaaccaaatggtcaatatatacatgaagatactccacatcattagccatcagggaaatgcaaatcaaaaccacgatgagatacttcttcacactcagtaggatggctaaagtaaaaatgtcagataacaactggagaaatcggaatccatatacactgctggtggaaatgtaaaatggtatagccactttggaaaacagtccagcagttactcagttaaacatagagttatcatataatttagtaatttcactcctaggtatctatcttggagaaataaaaatatatgtccacacaaaaacttgaatgcaaatgtttatagcagtattatttattatagttaaggatggaaacaacccaatgtccatcaacagacaaatggataaacaaaatgtggcatatctaattaaatattatttggcaatataaaagaatgaagttcagatgcatactatatcaatgaaccttgaaaacattttgctaagtgaaaaaaagccagacacaaaagatcacatattatatgatttaatttgtattaaatgtccagaataggtaaatctatggagatggaaagtagattagtgttgcctagggattggggaaaaaattaggagtgataactatagggtttctttctgatgtgatgaaaatgttctaaaaatgaacgtggttgtgcttgtatatatctgtaaatatactaaaagtcgttgaattgtacatgttaaacgagtgaattacattatattaaatatttcctgtaaggctattattttttttaaatgaattaaatggaggtcctaaaccgaaaactatataataactgaaatgaaaaattcagtaaatgagcataatagcattttggatatggcaactgaaagagtcagtgaatgtgaacgtaggtcaatagaaattatacactgtgaagagcagagataaaaagtatatgacacaaagtcactgaaagtaaaagaatggaaaaataaacatgatgaaaatgggaactgatatgacaatattaatattagacaaagtaggattcaagataaagaatattacaaaggatacagcaggaaatttcacaatgataaaaagaacaattcatcaggaagacctaacaatctaaatatctatgtagactggacatggtagctcatgcctgtaataccagcactttgggaagctaagacaagaggattatttgattcaaggagttcaagagcagcctgggcaacacagtgagaccatatctctacaaaaatttaaaaattagacaggcatggtggcacatacctgtagtcatagctactcaggaggatcacttaatgcacaggaatttgaggttacagcgagctatgatcatgccactgcactccagcttgggcaacagagtgatgccttgtctcaaaaaataaaataaatacgtatgtacttaagaagaacatcaaaattcattgggcaaatattaatagaaatacaggaaggaatattaataggcaaatctacaaataatattagagattataatagctctatctcattaactgataacaattaggcaaaaaagtcggcaaggaaataaatgatcaataatatttacctaattaatatttataaaacactcagccaacaactgcagaatgtgcattctactcaaacgtacatagtaaattcactaaggtaaaatactcatatatactaagctatacattctcaataaaaagtttctactttaaacttcatatggaaccgaaaaagagcctgcatagccaagacaatcctaagccaaaagaacaaagctggaggcatcatgctacctgacttcaaactatactacgaggctacagtaaccaaaacagcatggtactagtgtcaaaacagcatggtactactatcaaaacagatatatagaccaatggaacagaacagaaacctcagaaattaacaccacacatctacaaccatcagatctttgacaaacctgacacaaacaagcaatgggggaaagatcccctatttaataaatggtgttgggaaaactggctagccatatgcagaaaactgaaactggaccccttccttaaatcttatagaaaaattaactcaagatggattaaagacttaaacataagacctaaaaccataaaaatcctagaagaaaacctgggcaataccattcaggacataggcatgggcaaggacttcatgtctaaaacaccaaaagcactggaaacaaaagccaaaactgacaaatgggatctaattaaactaaagagcttctgcacagcaaaagaaactatcatcagagggaacacgtaacctacagaatgggagaaaatttttgcaatctatccatctgacaaaaggctaattttaatccagaatctacaaagaacttaaacacatttacaagaaaaaaataaccccatcaaaaagtgggcaaaggatatgaacagacacttctcaaaagaagacatttatgcagccaacaaagatatgaaaaaatgcccatcatcacttgtcattacagaaatgcaaatcaaaaccacaatgagataccatctcacaccagttagaatagcaatcattaaaaagtcaggaaacaacagatgctggagaggatgtgaagaaacaggatcgcttttacaccattggtgggagtgtaaattagttcaaccattatggaagacagtgtggcaattcctcaaggatctagaactagaaacaccatttgactcagcaatcccattactgggtatatacccaaaggattataaatcattctactataaagacacatgcacacatatgtttactgtggcactattcacaatagcaaagacttggaaccaacccaaatgtccatcaatgatagactggataaagaaaatgtggcacatacacaccatggaatactatgcagccataaaaaggatgagttcgtgtcctttgcagggacatggatgaagctggaaaccaccattctcagcaaactatcacaagaacagaaaaccaaacacctcatgttctcactcataagtgggagttgaacaatgagaacacatggacacaaagaggggaacatcatacaccggggcctgtcggggggtggggggctaggggaggaatagcattaggagaattacctaatgtaggtgacgggttgatgcagcaaatcaccatggcatgtgtatacctatgtttcaaaactgcatgttctacacatgtaccccagaacttaaagtattattaaaaaaaaaaaaaagttaaaaagcgtaagatgttatacaatggaattaaattagaaattaatcataagatatctagaaaatctacaaatatctggaaattaaataacacaattctacttaatactggggtcaaaaaaaactcacaagagaaattataacatatttttggtgtgccctgcccatgcccttctgctgctttttccaggagcagggaaggagtggagacaaaggctgatgagggtctaatctaaatttaatctcttgttttttttaactttgtatgtggaaataattaaagattcaaacgaaattgcaaagatagtacaagaagttttcaatctcttgtagttttttaactgtgtatgtggaaataattaaagattcaaatgaaattgcaaagatagtacatgaagttttcatgtacctgctagcttccccaatagatacatcctagtacttatagttacttaaaaccaggaaattgacattgtcatttttctgtgccatttatcactcaccacctctaaaattaagatacagaactatcaccacaaagatctccctcatgctacccctttacaatcacaccacctccccatgctaaacccctggcaaacactaatttgttctccacctctataattttgtaattttgagaacattatataaacaaaattatacaacatgtgaccttttgagattggtgtttttcacttagcataatgagagccatctaaatgattttgtgtatcaacagttcattcctttttattaagtagtattccctgtagtattcactgctcccatcattattcacttattgcagaacattttaatgtttctggtttggagctattataaattaggctgccataaacatctgtgtaaggatttttgtacgaacacaagttttcaacccctttgggtaaataccaagggatacaatgctggatcatatgttatgtttagctttttgttttgttttgtttgtttgttttccaagagggagtctttgtcacccaggctggagtgcagtggcatgatctcagctcagtgcaacctccacctcccgggttcaaggaattctcctgcctcagcctcctgagtagctgggattagaggtgtgtaccaccatgcccagctaatttttgtatttttagtaagagatgtggtttcaccatgttggccaggctggtctcaaactccaaagtgtgtttagttttttaagaaactgccaaaccattttccacagtagctgcactattttatattcccatcagcaatgtatgaaagatccaatttctgcgcattctcaccagtatttggtggtatcgtaatttttaaattttagctgttataataattatcttaaaaatatcttattgtatttttaatttccactttgctaatggctagtgatccttttatgtacttatctgcatctgtatagccttttcagggatggaaagagtgccaaggttactgtataaaaaagcattcaggatgggagatattgttgctggcatttctagaaaatacagcctggagtctggcataggttacctggaaaaggcggatcttgagcatgacaggatttagataaggaagaagcaagaaaagatatttttagtgtatactgctgcactctgtcatttagagtttaaaagaatgcagcatttttatttagtcaaaatacgtaaccagaataaaaggtatggaggataggctacttcaatttcaaatagtaaaacttcctcaaaagatctgatatttgtatctttatcccaaaacttgccacctctagtaattgcccacatctctttaacctccacttttctcctcttctctgcagctctatacatcaatctgtctctcttttctttcttataagaaacaaagtagtacattcttaacttctcccaacttcttctgttatcagttcagaaaaatagaaggattatattgtgactgtttattctacgaatgttaggaaaagatacatgttccacatgatatgcgaagaaaccagagggaagagcaggtgttttcaaatagaaagagtaaataagatatcttaaattttcactgagtttcagtgtatggcaatatatttctacctatatgtgcccaattaagtgcacttatggattactaaattcactctcacacaatggctttaaaaggcaaagaaaaggcaaattgaaggtaatggaacaatgcacacacaataccaaacaagaaaatagcacaatctccatcagccccatttttatttaaaaacagtaacaatataatcaagtctggaaagaagctaatcaaaataatttaaaattattttttaaactatttgaaaaaattgcaattatcagtaacaatgaactttattattcattgaactaagatgtaattgtgtacatgtgtataatatatgaatgaataaataaataaataaataaagatcaacaatcaaaaaaggtttagagcccgcttagaacactgaaagtgctgttctctccacctctctcactctaccctaccccctggttagatactgctcttgcaaatgtcaggctcccagcttgagctcctacccagatctcttgagttcctgaagtttctctggtccctcttttccaaggtacaggtgcctggaggaatcctggccttgggtatcaactgaatgacttgatcctgtttttctttgcctcaattttggatagatttcctgagtttgcatctcatattctggtccttcctctcaacctcccatcttgaccaaaactcatcttctagggtgaatatggcccattatttggatatcatgcccacttggctgtcttcttggtacctaagaaagagcccaacagctgtggggctgaaacagaactaagaccaggacagagaatgccaatacctacagttctaacgagtcatttacaatactttgttctaagtataaagttcttaaaatccaaagttaagaaaaaaaatttttataggtaatttttaaaaacagtaacacagcatttcatggaaataccaagaaccaactatccagtaccaagtacatttccaatataatgatacatttacagtgataccattttaaattgataaacattgtatgtatttttggtgtacaacatgatgttttgatgtatgtacatattgtgtaatgattaaatcaagccatttacttcacataccattttttggtgataagaacacttaaagtctactctcagcaattttcaaatatccagtctatcgttattaatgataatcaccatgaggtaaaacagatcacatgataatcaccatgaggtaaaatagaacatattcctcttgtctaactgaaattttgtgccctttaagcaacatctccataatactcctacccttctacagtgatgctttttgagtcacatactccgttagtctattgagtttcttgaaaataatgaccatggcccatgcaactttgtttccccagacctggccttgaaaattacgattaatattattttagttattgttactacttttaaaacacttactatgtgtcaagctcttgctaagcatatcgcaaatattatcccgtttaatccttgtaataatcttatcattcctttttacagatgaagaaactacactcagaagcccaataacttacctaagatcttacaattagtacatggttgaactgggattttaactcaggtctttctcattttgaaattcaaactcttaatacgactactctaatactgagcggggaaagtggggtagggagatatataaaagtttgccactactttccaggccagaagtaatagcatgttcctacttagaaaatgtgacctccagccatgtttccagccaattatgacttctctggcattaaagacactgatcacgacactctcagacgaaggaaatctctaaaatatgtcacagaaaattttcaataagttatagtgacacatgtatccagtgaatgaaatataaaatactaacttttgtaaatgtagctgaggttacttttccttgtgagtctaattactgctggcacataaaatgaagctatttgcaaattcatatctcttaatttggcacaaggcagtaacttaaagaaaaaaactataggtaggcaaaaaaaaaaaaaaaaatcactgcttacagcagcacacaggaccaaagagtgatgcaattttcactacatgtcttctcaagttggagaattcattagcacctgtatagtacttgggtaatttcagacaaagcaagttgcatatttaaccataagttcatcttgctttgtagttctatggcttcatattagaagtttaagtataccaattacttcatcattaaatacagatataaaataaccatttcaagttatttttcttttaagttttgatcaatcatagcattttctaagtaatacattcttttctaagtatacattcttaagagtatattctactattgaaattggttttagccactaaaattagaaaatataccataatgctctttccttttctattctaaataaattttaatttacaatttctttttacaaaaataaacaaaatgtatttatttaatatacatcacaagagctcaatcagagacttaattttaaaaacagaaatgggcaaaatgtcatggctcatgcctgtaatcccagcactttgggaggacaaggtaagagaatctcttgatccctggagttccaggacagcctggataatacagggagaccccatatctacaaaaaaaaattaaaaattagcctggcactgtggcttacacctgtggttccagctgctcaggaggctgaggtggcaggattgattgagcctaggagatcgaggctacagtgagccgtgatcatgccattgcactccagcctgttagagcaagaccctgtctcaaaaataaaataaaaaataaaaaacagaaacaaaacaaaaataacaccacagctcaagatacagagtcctatacagaaatcaagcaaagacagaccatctaagggaaaaatgaagagacaacacaaggagaggttgggcagcccgagttagggctccttcctggagacgtgctttgagtagatttcttgcagatatttcttaaaagctgtggagtttttctagagctcagcagcatgtgtgttcaaaaggctattgatgttgagttctactagcaggctgtggatggagtgcagggtgttcttgacatcatacagggcagaccactcgtccttcaggatgtccagacaggtgttaacactgggcgtccacgttgagatagtagcagggcgtgaggaacttaaccaagggcatgttgtatgggtagccactggggaactccagggaaaccttacatctcaggtcttctgtgccagctgcttcagggatggtcctactgatttcaaaaggttgtctgatgcaggtaaggcagaaattcctttgttgccagagatcacaagggtcttcagctcttgctgtatcctgccgtacccactgctgcactctgctcctttatgggcagcaatgctggtggcagctgtgttgcagttttggcaggccatccaggcagcactggcagggagacaggaactcagagagcatgactgcaactgcctacttttttttttaatggtagatgaaatgcttaagtggactagccagctcctaattgtctcatttcactgaaaactgtttctagtcaacaaggatggatcccatcagccttactgtatgagaaaacctgatccctggccaaaagtgagtgttctgaagtggatacataatctaaccactgttaatctgattcttcctcctggagatgtggaattgagacccaattctaatcagctaaggctgcttgcttaaactaatttgcttcagggagaacgtccccccaccccccgcccccgctccgaaccataaacactgtgaagcaaaagtaacatgggcaaatatgtattatcttaacaaaaactaccagcactataggctgaattacgtccctgccccaaaaattcttatgtagaagtcctagcccttagtacctcagaatgtaactgaatttagagatagggtcattttttaaacttcttcacatcaggtaatgtgcagactggtatcaaggtctgagggaggcacacctcacacaataatgtgaaaacacaatcattactttatgaaacacaaaagaacctaggttctttacagaggtaattaaagtgaagtcattaggatgggccctaatccaacatgaccagtgtccttactaagatgtggaaatgtggacacacacacatacagggggaaggaaatgtgaaggggcagggagatcatttccatctacaaaccaagaagaagcctggaacagatccttccttcacggccctcagaagaagacaaccctgctgataacctaatctcagacttttaacctccagaactgtgagaaaataaatttgctagttagccctagcaaactaacacaaccataaagggacacatccttgtttgagatgcttgggatagaaggtaagaccctgagggaataggtgtcagaagccacagaaacaaagcagatggtaaaactactctggatggcaccagaagaaaactgttttttctgtctccaggaaagaagaggaaagaaagagaaagaagtcagtaagaaaatttgaagtgtagggactttttggacaaagggccaaaagaattttctcaggagggtctgaaagtacccccaacaggaaattctgattatattcctatgatataaacccccaaaccttcaacaaaatctattacatatggaaacagaaacccacagccagaggtgaccatgagaatatcaacctggcattcctccacccccttatctcactgccctctcattcagaaatttgtagaaatctcacagaagccacatgagccccacaaggtatgaaatatggttcatgccaatattatctaaatctcaaagcactaggatattttagctgacacttggaactgcaaagaaagatgaagtagacttgcagatagatgcagaaatgaaagaccaagtgaccctagagagagagaatgagagttataaggctattttctggttctaattcctcatttggccagactgactccctgcttttgaaatacccacatccctatattcctcttgggataactttatagcctcaaaataaatctccctttcttgttgttggttaaagtagctcatgttagtttcatttgtgattaaaataattttaactaggatttatataatatacatatcaaaggacatcataaataaatagcaaaaccagacagttattagaagttttaatctgggctgctattccaggggggacatttataccacaacaatacagtgaataaaagtactgcctcatttttccaaactagtgtcacatagaatacttcactcactattaggtaggggttaataagtatgctataaaaaagaatgttttgaggtcaaatacatttggaaaatactaatacagaataaatgacttctgagcagttgggggagacttttttttaaggggagttgactataagaccctttcttcccactgagtggcagagaagagaaggtacattattggagggaacttaaaaggtaattacttcaacaataacaagtttatacttgttacaaaagtagctaaaataatataatatcaatgtaaggacaaaatctagttcatctctaaggcagtataatgtaatggttaaaacacatgacttctagaactaggctgccaacctctgtaactatttcttcatctctaaataatacttacctcaatgctttgtgagaattaaatgagttactatatgaattagtccattttcatgctgctgataaagacatacccaagaaggaggtttattggacttacagttccacgaggttggggaggcctcacaatcatggcagaaggtgaaaagcaaggaggagcaagtcacatcttacatggatggcaacaggcaaagagagagcttgtgcagggaaactctttttttaaaatcatcagatctcgagactcattcactatcatgagaacagtgcacaaaagacccacacccataattcaatcacctcccactgggttcctcccatgacacatgggaattatgggagttactattcaagatgagatttgggtggggacagagccaaaccacatcactatataaaaagtacttcagctgagcgtagtggctcacacctgtaatcctagcactttgggaggctgaggcaggcagatcacttgtggagttcaagaacagcctggccaatatagtcaaaccccatctttactaaaaatgtaaaagttagccaggtgtggtggtacacgcctgtagtcccagctgctcaggaggccaagacatgagaatcgcttgaacctgggaggtggaggttgcagtgagccaagattgtgccactgcactccagcctgggtgacagagtgagactctgtctcaaaaaaaagtacgtcaaagtggcaaacttctgaaaatgctagttattattatgaagaagcctccctaaaaatctgtaatttatcaacttccaagacaggcttagaactttctagattttatatatcagcttaaagaaagtgacccattcagggcagggcgctgattataggtggctcacacctataatcccagcactttgggaggccaaggcaggtggatcatgaggtcaggagttcaagaccagcctgaccaagattgtgaaaccccatctctactaaaaatacaaaaagttagccaggcacagtggcaggcacctgtaatcccagctactcgggaggctgaggcaggagaattgcttgaacttggagggcggaggttgcagtgagccaagatcgtgccactgcactccagcctgggcaacagagtgagactctgtctcaaaaaaaaaaggaaagtgacccattcagaatgaaccaacttgagacacagaagaagactggccagtgacaccacagaaggccaaaaagtcaagaactctgattagaaccaggacaaagggttttaaaatatgctgttgctgttgaaggggttggtagttaacgtagagccacaatttagctatagctttatagtatttcaattttttatgtataattatttttattatgttctgattcgtatcccatttagatggcattaaggatatatactgtacctggggacaaccacttatatttgcatggctgtcatatctccaaggtcatgttaacagggcctaaataatttttctaatttaatgttaactcactttttaaaaaaattttttgtttatttttagtagagacacatttctctatgttgtccagtctgctctcaaactcctggcctcaagcaatcctccagcctcagctttccgaagtgtggggattataagctaatattaacttactttaatcgtgtgtagatgatccttttcttaactgagataatgacttctactttggtttcagacattttttgaccactattatgcaatttcttttttaaattttgttttattaatctatttttaaatttaaattttaatttatttttatttgtatatattcatggaatacaagtatgactttgctagactgatatattgtatcatgtaatttcttaaactaataatgcttatcagaattatctcaaatagatttttactcttggaggtattgtaaactagtattaacaaaaataaatcctctcaaatctcaaaaatgatgtaattatatacagaaagatagccaactgggcttttctttatcattctaaatagcaaaagtaaaactcaaaataattggtagaatattttagatatttcaaaaatatggaataaaattattgtgatcagaaattctacttaaaaatataattattttgtaaaaattgagtttacctaaaaccataaaagttatagttgttatgttacatttgcttacaattttccttgagaataggattctgttacctcacccccaaaattatttaattacaatactgagatatgtaagggtccatcagttattctgatcctataaaaattatttaaaacacttacaaatgtgaatgcagaacactatcttccacataatagtttcttgagaactctccatattttacacagaatttttcagctatacatgaccttataagccaaacatttcaactccctcattttaagcaaactgaaaatcacaataacgatacccaaagtgacagaatagaaccataatacagacctccagctccaaagttctttagatatttcttctgcatttcattaatggttttatctaggtttgatttttttttttttttaagacggagtttcgctcttgctgcccaggctggagtgcaatggcgtgatcttggctcactgcaacctctacctctggggttcaagcaattctcctgcctcagcctccctagtagctgggattacaggcatgcatcaccacgcctggctcattttgtattgttagtagaggcagggtttcaccacgttgatcaggctggtcttgaactcctgatctcaggtaatctgcccgccacggcctcccaaagtgctggaattacaggtctgatccacaaagccaggctaatttttttttcattagaaaaattgcttatataaatcagaatacaaacatgctttttttttttttttttttaagacagtatctcactctgttgcccaggctggagtacagtggtgcaatacagctccctgcagccttgaccttctgggctcaagcaatcctcctcttcagcctcccaagtagctggcaccacaggcacagaccaccgctcccagcttctttatgtattcttgatataagccctttatctgatatgtcatttgcaaatattttctcccagtctatggcttatcctttcatttcttaattatgacttttgaagatcaaaagttcttaactttgtcaaagtaaaatctatgaattttgttctcttgaatcattcgtttggtgtcatacatagtaagtattttgtataactcaaggttacaaagtttttatcctaaaaattctgaagttttatattttatatttagaaccatgatctaagttaacagttgtataatgtatggatagttcttttttatgtaaatatccaattcttccagcactattgttgaaaaaactgtttcctttctcctgaattatcttttcacctttgtcaaaaatgaattggtcatatatgtgtggctctatttctgaactctctatacattcttactgaatttttattgcctatgccagtaccataccattttgattactgtggctttatgataaatcttaaaatcatgtagtgtaataagtggtgtgctgaaactggcttgcacccattcacaagaactgatcttgtatatctcttccgtaccctgtgttcagtgatgtcacattagtagcttgaaatcagccatggtgtatttataccacaaaagtatttccagagagctagttgttaaacatcagcacatcactaggtataaattatctatttattcaaagttgttctgacttggcatttcaacataaattttagaatcaacctgtcaatttatacaaaaatgctaggatgtttactaggattgcataaaatttatagatcaatttaggaggaaattacatctttttttctccctctgttgcccaggctggagtgcggtggcatgaacacagctcactgcagccttgaccccctgggctcaagcgatacccccatctcagcctcccaaagtgctggaattataagcatgagctacaattcccagccaagaaattatatcttaagaataaagagtcctccaatccatgaaccctgtatctctctctatttgagtagtctttaatgtccatcagcaatattttatagtgtttagttacagttctcacacatcttttgtaaaatttataccaaaatatttcataatttttggtactactcaatatactattataaatagtattgtttttcagattttaattttaggttattcattgctattatttattattgtttttgtatatcgatcttgtttactacaagcttgctaaattcaattattagttttagaatattttttgtagatgctacagaattttctacacagatactcatgttacctgcaaagacagttttacttcttccttttcagtctacatggccttttattttttcttgccttttttgcctcagtctttcactatccccattaactatgatgtcagcggtaggtttttcatagatgccacttgtcataatgagtgaattccattcctagcttacaaataccttttatcaggaaagtctgttaaatattgtccaaaattttttttgcacctattgaaataatcattggcttcaatttgctaaaatttttagaattttataactatttcataagaaatacgaatctataaaattcttttcttgcaatgtatttaattttggtatcagagtaatgctggccttataaaatgaattggcagttatttcctcctctttgattttctggaaaagtttgcattaaattggtgttatttcttcctggaatgtttgtaagaattccagtgaaaccacttaccagtgaaactcttggcttggaattctttatggttaggtctttaactacaaattaaatttatttaataaataaaaggttatttcttcttggattagctttgatagtttgtgtctctcaagtaattgtgtctatttcatctaagttgaccatactgacataaaattcataatatttccttctcacacttttcatctgttgcatctgtattgataccacttctttcattccaaatattcaaaatttgtgttttctccccctaccgctaatccttttttccccccggatcagtgtggctagaagtttaaatcagttgtattgattcagtcaaagaagcagcttttggttgtactgattttttctatctgtcttccagttcattgatttctactctaatttttattattttctttctcttctttttctggtttcttaaggtggaagctgaggtcattgattcgagatctttctttttccaacatagacatttaatgtctatattttatttaaaacacatttagtgttataaatttccttctaagtactgctgtagcaacatcccacaattttaatatgttgaattttcattaccatctagctcaaaatactttcctgtttgatttcatcactgacatatgagttatttaggagtgtgttgtttcgtttacaaatatttggggaattccccacacatcattctgttattgatttctaacttaatgccattgtcatcagaaaacatactttgtattacttgagtctgtttaaatttgagacttgttttatgacctagaatatagcctaacttggtcaatgttccatgtgcacttgaaaagaatgtgtgttttgttgttttaaagtgatctacaaatgtcaattacatctactaggttgatagtgttaattaagccttctacacttttactgattttctgtctacttaccctatcaattattgaaagaggagtattgcaatcttcagatataattatgggatctagttataaatttttcctgtactcctttcagttctatcagattttgattcgtgtgttttccatttgtatcattagacacatgaatgtgtacaattatattaggtacccctgatgaattcacccttttatcattttgaaatgaccctttttatccttagtaatatactctgatctaaaacctattttgtctgatagtaatatgagtatcttttgattagtgttgccatggtatgtcttttttggtccttttacctttaacctatttggttttttatgtctaaaatatgtttattgcaggcagcatatagttgggtcttacatttttaaccaatctggcaatctttgtgaaatcactaaactctacctgggttactgacttcctttctactatcatatctttactttccaatatctcttttttgttctcaaaaagttctacttttggatagcctttctattcttgttttacacaatcagtaacttgtcttatttctttgaacatattaatatagtcaatttaaaacactattctattctccgcattgactgttttttctatgttcattttacctgttggtttctcttcctctctctttttcatgttacatgctctctaatcagtcattgatttatgttagggtgatgttaactgatagacttaatattagggtaggatttctcaactttggccctattgacattttgaactgaataattattttggggaacaggaagatgagcttccctgtgtactgcaaaatggttagcagcatccttggcctctatccacgagatgccagtagcacacctctgcgcatatctttagttattacaatcaagtatctctccaaacattgccaaatgtcccctgtggggggaaaccagtcctagtttttagccaatgcattacggtgatcagggtcttgagagtttctcagagaagttctccagtttcctactttgtgagtgaagaatatgaacctagtcactagcatttggaaaccaagcagatgaacagacataggtatctcaccaaccaatacacagactctgacttaatctctctggtaggcagaataatggcctctcacagatgtccacacatcctaatcccaggaacctatgaacatgttatgttacatggcaaaagagaatttagatagcaggtagaattaagcttgctaaaaaattgaccttaacaaagggagattatcttggattattcagttggatttaaatacagaagaggagggcaggagagtcagggacaaaatgatatgacatgaaaaatccattgctggctttgaagaagtaaggaagccatgagccaagtaatgcaggtggctgaaagaagctgggaaaggcaagaaaacaaaatttctttctagagcctccatgaagaaagacaactctgctgacacgttaattttaacccgctgagattcattttggacttctgacccctggaattataagatgataaatttgtgttttttttaaaccactatatttgagggttaatgtgttatagaaccaataggaaaaatcatataatcatttgatttcagtatggtgctttagcatccactctcagttctgcttagtattcccaaatctagaacaaacctgagataatctcttctaccatgaatcaacaagtcctatctatctctgtcaaggttgaagaatccaggcttcttcattgagatgggaccaacggagcaaactgttgcttaaacagattttcaaccaatccttccattccaagcccactctactccccaaggctatttaaggggaacttgtacctccaaatcctgagtttttccagcattctacagtagagacagacatgcttttatcatggcaagtagtcagacttcctctctattctgctaagtcaccactcattctcattcctccttgcaaaaacacatagacgtctcttatccgctacgtctctcaatctttttggtctttaagggttcatgcagttttggtttctctactgtcattttactgggatttcaagaacaacagaaataaacaagttcacctgcaatgtttaactagttttattttcagctgacattttatcaagcgcttactgtgtattagatttgcagataaacctttatataaattatcatctgaatcttgtaataactctaggagataggtactattattttgcttcccattttataaataaaactgatgtttgattcaggtgacaaggctagggtggaacagaactgcgatggaacccaagtctttatgactcaaaagccaatttgcctagacaattatgcaatcttgttaatttttcaattaacaattcacaggttttactctagattagaggtcagcaaactatggtttactagccaaatctggtctgccccttgttttgtaaagttttattagaacatatccataccaatcgtgtggaaaaaagcacactcaaactcaaagtactttttctattctctcactcaacaccaagaattaacacagaagacttctgcagccaaatgtgtggagattttcccctaccaacaagcaagtaatgaattctgcagcagataccaggtaggtatcctccaatttagttctgacactatctacctagaaatcaaattccacaagttggggctcagtaccgaaagactgccccctacttctgatgccaacaagtcctgggttatttttacctgtgcttttaactgattggttataaattggggatcccaagaccccctccttggatttgattaatttgctagagcaactcacagaactgaagggaaccatttacgtttaccagtttacagtaaaggatattgccacaggtacaggtgaagagagtcatggggtaggcacgttagaagaggtgttgcacttccctgccctctccagtgcaccaccctccaggaagctccatgtgttcagctatcggaaagctattgtgtcctttgggttttcacgggacttcattacataggtatgattaaaccattggccattagtgatcaatttaacccacaggttgtagggaagggctgaaaatcctaagcccctaatcctgccttggtctttctggtgaccagcccccatcctgaagctacctaggggttgccagctaccagtcaactcattagcatccaaagacatcactttggagagtaaggattttaggagtcatacaccaggaaaaagggtcaaagaccaaacacgtatttcacaatatcacacccatttaaatgactattgtctatgcctgtttttgtgctacactgttacaactgaatagttgagacagagacaatctagctgacaaactctattagtctctgctcctttaaggaaaaatctgctgaccctgctgtagaaaataaccttattaccaagttttgaattcatggtgtcctcatatacttaacacttttgttactgttatcaaatcaaaggcactatttttattgttcctttagccttttgttaccctgcagatagaaatctttggccatggtttaaaaagaaaagcctctaaacccatctcccatgtgaagtcttccccatacttatagtcatactcactcccatttctgagctcccatctcaattattataattacagtatttagtggagtttgattcatatagtcattactagttgtgattcccctgagatctagcaactgcttaactctgataagcatttattaagtaccttctaagtgtcagtcagtgttctagacactagaaatacaaaaataaaaatggcatcttttggttcatatgtattctttttaattaggtataaaaatagaaaagaaactgagcatggaattgtgcctatggtccctgcaataattgcatcagaatcactagaagtgcttgggcaacattcctattgaatgttgaagcagaatctgcggtggttaggcccaggaatctgtgctcttaatcaacacttcagatgattcttaagcacaaaggtttcagaaacactatgtcagtagacaggaaatactgcttctaaatgtgcaagtattatgagagagtaagaacaaatcccacatgatctctcttaatacaaaccaatttctgtcaaaatgtaatgttttgctgctcatttcttctttccaaaacttactagacacgcttaatcgagaactttgacgttgctctcatctttactaattttacttacattgtgaaccctgtacctggcacagttcttgaaacatagttgataccaatactttgtgttgaactgttgaatattcagagcaaaacctttttaagttgtccctagtatgtagaagtaggagtttttccaattttagactggaatggtatgaggatcatttgagaacaaggaagataacacacccaggcaaatgtttggtcaacctacaccttgtttctctccttctagaaatgcttccttctagctctcaagcccactaccctgtggggaatatcaatctcgctcctcaaggctaagctagatcaagcaaagccaagcagactagtggaaaaggtcaggcattataggatccatcttcatcataggtaatctatttctagaggctgtagtcaagagaatgccctagaatacatgtttaaaaggattacctacctctgaagataatagaccacttgcttatatatgtctaccacgagagtcttataacaatggactcttgctatacctgacacagatctacccctcccactagaactctgaattattttgctggaggctacaacattctgagtagtttgttgggagttgacaggaggtggggataacccacccagtacaagcttagcagagctgagccgctgcagcaagttgggctagcctttgatacagactggttggacaggttctggatctacagaagaaccggttttactggcctgttgtgccaacatattctggtttgattccatgttccacagacggtagaaacctgcccagccagttaaatgaaaggcatattaggttatccattgcactcagtatatagcttagatgcagcagaactcttccacatagcagtagtgtctagcaaaccagtgtggtccagagaggtggtgttcactgatttaatgtttaagttgatagattcagggaaagtgagcagtgaaacaatttctgcttttcaccaagagcagaggttttctaaataagtcgaagggtaagtatatttttaaaatttctcagtttcctatgcattttggaaagttaaattaagaaatgatgtttaaaaagataatcaatttttaacatagtaatacctgcattataccttttctgtaaagctagatattgttttataacacttgcgttatgttcattgattgtttgcataaaggttatttggtatataatattctcttactatgcttttctgtaagttgtgcatggctatagtcattttaaaagctggactgaataattttgccaaataaatttcacatattaatgatttacattaagccatctacttccttcataatgtaactattatgttttataggctgttgctatatggtaacaattttatatggtaaatctaattgtggataaataataattgcccttttaaggccaaaaaaagcattggccggctggtgatcctaagtacattcattagaggaacaattcacagtaaaaattgaggagtgtgaaaaacaaagaccgtggaatctggtaactgattaactattggagctcaaaagcacttgctgagctgaatagaaaggaatgaagacaggttttgtcatgcctattaggtctgaaaaactttttaggttaaagaatacctggatcttcctttcatttatattaaaaatcttccttttatctctctctttacgtaatccaattaatttattttagtagtttgtatcatgtaaaatgaaagttaccaatccctttagatttatgttggcataccatcctacccctttatttactgatattagattgaattgaagcacatgtcttctagggcatttaatttaacataacagctgacatatgattttatctgggaatttaaaatttttttaacatattatactgaatgctttcctgtcatcttagtaggactttgctttgagctgagcaagactgatgcatccttttcattgtccctagggttcccactttgtcactatgttcaaactcaaaggctataaaattattttctaactcaaaggctataatattagtttccttaggatgttgacaaagaataaatttaaaagtgtgaataaatgttcagatgagatttcattttttgcagggaaaacccttggatgcttcatagtcctacttctaggcagttctgcatgaatttctggtaatccaggtaaactgctgaaaagctatgtaatgttgtatctgcaaaagcaatgtgctgattcagcaagccaatattaattttattcagcacaaattgtattttgacaagtttttggtaatatggatcaaaacttttaattggctgaatttttctgaatttactacatgaaacctagttttcaggtaatatatatataccaatagagcacattgttagtatttctggtgaatatattgcatatgataatttaaaaaatttaaaccacaccgtgtttaaaacatagggcttactgtttaaagataaatttaatttgggattctaatttatttattgagcattttttatgtttatggttttgaagaaagctatttaagaactagatatacatttatataaaatccatgggtaaaatttcaagcttaactctgtattttgggagaggattttacaattttcatttaatggaattttcattttcaaatatatgtaagtcctattagatattactttcatgtattttccataaatttagtcctttaaaatattgatacattgcgatatttttgttaaaactgaggatatataaatttgtcaatcaaattaggagtgtgtatgtattttatacagaccaacatacttcagcgcctagtcaaaaagtattccactcatttaaaatttttttactcttttagtcgaggatgcatttctttttattcctagctgcacaatttcgcataactctttctgtcaacaatgctagctttcttaacaactgcaacttctttccctcctgaatatcttcatgtgttttccactaaaagcacttagaattatgtcattttttacctaagagggacatttaaagaataaccaatgaatccaatatctcatttttgagttaagaaatgaaaagccccaaaatatagctaagtcactattatataatctaagggtagatctggggccagaacatccaggtttcctgacttccaccaagaccagtaattttttcactaccctacattgactcttctgaatactacatgaaatctaatctaaaaaggtaaaattatgttgtatagtgtgttaatgaatctttggtgaactaaaaaatcatttgtttttatattttaatctataccattattgccccaaacatttttgggacaatggctgaatatatatgggattgccattgataacaaaggtgactaccacttcaaaccccaatctcttaatgccatcatattattttgtttcagactgatgaaagcctcacattctttcatatttgcccaacttgtggatcccgctctcattttctgactcaatattgctttaagctgtctcaactgtctattttcttagtatgtatatatttttgtattattttagtcattcttaaatgctcataatttaggatttgcctaagttaatatagtattctttaaatttggttagaactgacaggaaaattttgttatgaagacagaaattgcaggacttaaaaacccatcttagaggtgatagaagctgttattgaaggggtaagctttgcacacaagtgctcaaaaaagttttaaacatttttaatttgaggaattcctaggaaatgtgattacagaaagttggagaaccaaaggccaaaaatttcaattctgattcctggtactaaatgttaattctactaattaccttatcttatcacaggtaaaatcctacctggaaaatgcttctaaatttggtcattttagttcagtccaagtggactctgaaaaaaatcgctttcatttgtttcttaactttacaagagaaaaggcagtatactgaaaagcatgtgagcttttgagccaaattgacatgggtctgaataactctgctacaaattacgttccccttggaaattatttaactctctgagttagcttttctccatctagttaaggaagttaagttaataccattctttcagagttattggaagaattaaatgagatatcatgtaaaacacttcacatagttcctagaacatagcaggtgctcagcaaatgtcagtatccttcttaccccttttacagactatataatacatttcaacaaatagcttcggtatttcctgaagtatttcagtattttctttcagtaagagaagtcaactttaacttagaatatgcacgtttttgtcagaaagataaaaataaaatcagcaatcttggaaggcattaagatataatgttggggccgggcgcagtggctcactcctgtaatcccagcactttgggaggctgaggcagccagatcacaaggtcaggtgttcgagacaagcctggccaatatgatgaaatcccgtctctactaaaaatacaaaaattagccagtgtggtggtgcgtgcctgtagtcccagctactcgggagactgaggcagaagaattgcttgaacctgggaggcagaggttgcagtgagccaagatcgcgccactgcactccagcctggtcaactgagcaagactccgtctcaaaaaaaaaaaaaaaaacatataatgttggaaaatattttaaccttcttaaatttaaaaaatcagaaacccatataatccaatccaattaaagattcacttcaaagaagtctttgttaaaagtattttgagagtggtacaccaagatgattaaaagccttaaatactttttaaaaattcaatttcaatcatctgtactaatggaagaaagcgtgacatggataattcaaattataatgcattcatgcatcaagtaacaacagggatacattctgagaaatgagaaattaggtgatttcattgttgtgtgaacattataaagtctacttacaaaacctcaatggcagagcctactacacacctagactatatggtatgtcttattgcttccaggttataaacctgtacagtatgctactgtactgaatactgtaagcaactgtaacatagtgtgtgtgataagtatttgtgtatctaaacatatactgacatagaaaaggtaccgtaaaaatatgtggtattataatcttataggaccactgtagcatttgtgttccactgctgatcaaaacactgctattcagtgcatggctgtaccttacttgtgccttctgagttttccaacagcttttttttgtctattatctaacatgacgtcaaattaattggccaagaatttattttctttcttctttttttagatagggtctcactctgtcacccaggtttagcctcccatgtagctgggaccacaggcacatgccgctacacctggataatttttttaaaaattttttgtagagatgtgttctccctatgtttcccaggctgatcttgaactcctagcctcaagcaatcttcccacctcagcctaagaatttctatatgctctaaggattgtgctttttctactaccaagtaaattattctttcaggactctggaatgtgttttctcctacaaaaaaattcccttctgaattaaatttattataggctaatattaaattatattgcattattttgatagcaagtaatgatgagcagagtgagtccaaaatgtatagagcacaagaagatagaagaggatttaacattttctaaagataatattaaattagtcttagactgattaattgattagggaatgaagccgatgagcaaagatcacaaaggaggagctttttgtgaaatgtattggtcagagggagttcagaataccacgacaaacattctgagagcttgcttaactaaaaagaggtcaattgacacatcttccaatgaatgaataaagagcaaaaaattggtttagagttaacattagaaccaactaataatccatttataacacaaactgatcttattgagctcttgtaatcaactttaatttcctgaaagatgtttaatcgctttacaaaaagctttctgctgatgctataatttcaatttaagtccacgataaaagaatcttttcacttaaattgtagacactgtatgtagatggtgtgcagaaagacaaaagcatcatttcaccaatttagcccactaattaatcacatattctttttttctttttttgagagagagagtctcgctctgtcactcaggctgaagtggcatgatcttggcttactgcaacctctgcctaccaggttcaagcgattctcctgcctcagactctggagtagctgggattacagggacatgccaccacacctggtgaatttttgcatttttagtacagatgggatttcattatgttggccaggctgatctcgaactcctgaccttagatgatccaccctccgtggcctcccaaagtgctgggattacaggtgtgagccaccatgtctagcctaattaattatatattcttattaaaactattttattagctacgtaagcaatttagcctatgtgactagtcattaaaattagtatttaatttgcatttacttttaaatgtttacagtagatattactacaaacaattgcaaagaaggcaggaaaaaaacaaaaattttaaatatgtttttaaaatgttctggtggggaatggtggatcacacctataatcccagcactttgagaggccacggtaagcggattgcttgagcccaggagttcaagaccagcctgggaaacaaagtgagacctctgtctctacaaaaaataaaaaataaaaaattacttgggcacagtggttagaaggatcacttgatcccaagagatcaaggctgcagtgagctgtcttcacactactatactccagcctgggcaactgagtgaaatgctgtctcaatagataaataaatggttttatacaaatagctaatttgcataactcaagactaacaactaaactgcctataaatccaaaactgggaaatagagtacataacagttcattgtgttaaagacatacagccttaagaacaaccagaaactattatcttagaaattatgtatcactgacaaagtgaaaatgtaacttgaataacaaatttttagtttcaaagttataccttaaatctattcccttgaaagttctttgcctatcatatctacaatgattcagattaggagtgagaaacacttccttccaacatgaaaatattttaaatctaatgaatttctcaatgactctcgaaacattaagaaatataagattgattataactttatgtagctaataatacccaggagtattactactataataacctagcaatgtttctcaaagtgtagtccatgaccatctgactcacctggaggaatgcctattaaaaatgcagatcgataactccattccaaacgtatcacattagaatctctggttggtagatcctaggagagcagcaagaaaagattcttctgcctataacagagaatgagcaagtgagtgaatcttttcaaatctaacccattaacattatcagaaaaataacctcaaatgcacatgttcaaccaatcttgggtcattaacattcttacaaatgactaatacaattaatctgcctgtcccatccatgcatgcaaatttttaaaagttgaaacttccattaataattcaaaaatagtgaaacagaaatctcaagtttccccttttactctaggttctccatgagagtaagagcctgagacctctggcttatgtgcgagttctttatttgggaaagcacccagaaacaggagtaagggattagtgaaaggaaggaaggaaggccaatacaaaagttcatccttgagttcatccaccactatgagcaaacagagctcaagcccagtatcttcttaggagccatcaaactaccccagaatagcctgtcagaagacacaagagaagagcacttatccacaacttctgacttccatcagttaagagttgccgcatgggttgctaatttcttacactttcaagttgcatacttgtttctattggcttcagagaagctcctaggacagaaagtcaggtgagggactgtaaagtttcacctgcatgaatctggttgccactgaaatacctggagcaagcagggcccaagacgtgtccgatacatcatgttataggacaaatgtggtcaaactgcttttcctttagttttataattctaatacaaaatacaattaaaacagatgttctgagaaatgagtacagcaatttcaaatggagaggaaggaactttagcctatttttgtctgatgtatttgatccattcccacaaaacctgagatgcactgaaacttgatcttctgtgagaaaggtattttctaataaacttcaatttatttcctgaatttgcttgccaatttttaaagggccaaacagcagcaaaatggacaattagtatgtacgctgtaaatacttttatgtccagcattgatccaaagactttattgtttaagttttcacactagtaaagttatagtaaaaacagattgactacattggaccctcgagtaacacttttcattacagtgaaacacacaattttgaatagtacaagtttgtcttggactgtgtccaagagggtctagttacaagaagtaattcattataacctataatgtgatcctgaggcttggctctgaaaaacacattatatgaaggctctagtcaagcagattaaaaattttaaaaccgaacagataaacagtactttaattaagtaaataccatacttgtttgtataatatgtaaacttagttcagagaaagcgaaggagaaataggtgcaaagaaaaaagaaatctgaccaaaagcacatcatctttttgtttaacttgaatttctgttagaataactaaatgtgagtttaaaaaaaaataacactatctccttagaagttaggtaaagtagctaatgaactgaataaagatgaaataggaaaactgaagagtgcacagcaaatacaaaaaagtggagacacacactgctgaaaaaagcccaataataacagatattattttattattattaatttttttgagacagggtctcactctgtcacccaggctggagtgaggtggcaagatctcagctcactgcaacctccacctcccaggctgaaacaatcctcccacctcagcctatggagtagctcggactataggcacgcataaccatgcccagctaatttttatgtattttctgtagcaacggggtttcctcatgttgtccagtctggtctcaaactcctgggctcaagcaatccgcctgccttgacctcccacagtgctaggattacaggcatgagccgccgcacttggccaataaataatttcttataaccactaattctgaaataaataaagagattagtttctcctttctatataattttgccattgggttagatgattttttaaatcccttggaatataataaaactaataacaacaaccatataataatactatctaacttacctgaactcaattatgtaaatcaagataatacatgtaaaagcatttaacaatatagtgtaattctttctataattataaatctttcacaatttgcctagcaattcaatagtttcactataactatacaactttagccattgaagagatctgattagctgtagctcttaaatctatctaccgttaacaacagtttcttacattgttacagtttcttacatatatatatatatcttctctctctcatttaatcctatcaacaatcctgcaaaacacttaaagtacatattattaccttcatttcattgatcaacaaccaaagtacagagaaattaaattatttgctcaacaagattagaattaaaaattagaattcattcagcaaattagatggtgcagctgatgccttcccagtatcaacttatacaaatacattactatacacttgcagttatagaactcaacaatgattccccacagtatagcctttgcacatgccttctgcctggaaagccttctgccattcttctcccaataggcaagctgcttcaaatgtctcttaattcttctttaagaaatttcaaatatattatttcattcttacaacaacccctttgagcacagtgagtattaatatcctctttcagtgagggaaataagacttgtctaggaaacatgcagataatcagagatagggtcagaatttaatctctcatcctatctcccagctcacgactctttccatagtacaagaaggctgggaatatggttatatgccagcactgactgtagaacatgatcacaattttttggagcacttcctactctgtcccttctgagattacaacataatttaagacccttcaatctacttgattttaaattttgtacatgaaacaactcacaaccagggctgggaaagctagtataaccattgttctaattctattagaagtaaatttatattcatttctcaaatgtacatatctattacaaggcaagtaaaaaagcatatgtgccaaaaatgctaagaaataaattagcctaaaaaatgaagtgagatgattataataggtgtttcactccaatcctgactgagaaagtccagtttattttcagctctgaggctaattaaattacaatcaaattttaaagtacttttagttacctcctacagtgtaaagcattttttagttagtttgtttttggttttttttttttttttttttgagacggagtctcactctgtcatcaggctggagtgcagtggtgcaatctcaggtcactgcaacctctgcctccctggttcaagcaattctcctgcctcagcctcctgagtagctgggactacaggtgcacaccaccacacctggctaatttttgtgtttttagtagagatggggtttcaccacgttgacgaggatggtcttgatctcttgacctcatgatctgcctgcctcggcctcccaaagtgctgggattacaggcatgggccactgcccccagccaaagctttttgaagtaaaaagaaaaatgtacttgctctgtcacccaggttggagtacagtgcatggctcactgcagcctcgtcttcctaggctcaagagatcttcccgcttcagcctcctgagtagctgggaccacaggcatacacaccgtacctggctaatttgtttttattttttatagaaacaaagcctcactatgttgcccaggctggtctcaaacttctgggctcaagtgatcctcctgccttagcctcccaaaatgctgggagtacaggcatgagccactgcatcaggctctgaccatatggtttacagtcatccaaaccaggatgttttttaaagtaaaagtgagctgtattaataattaagctagagcaataggaatcaaccaggactgtcactggtaagctagggcatatgatcacctcacataagaggtctaccataactgagaaaaggaaggaagcttttttttttttcttttttttgagccagggtctcgctttgtcacccagagtgtgagcaaggctcactgcagcttcgacctcctgggctcaagcaatcctcccatcttagcctcccaagtagctgaggctacacacaacactgaacccagctagatttatttttattttcttgtagagacagggtcttgttatgttgcccaggttggtctcaagcaatcctcccacctagacttcccaaagtgctgagattgtgggcatgagctgctgcacttggccggaagcctatctatttcaattttagtatcctaaatagtccacaaaaacaaactgtcaccaagagtatgaactgaattaaaacacaatttcactgtacatttttaatctttctgattataacttacataaaactgaaaacatttctagctaaaactcaggatctcctttaagtactgaacgttgaacataaaacatttttaaattttttattttacctttggaaaagtaactatcaaagcttccttaaacttagattaacatggattagaaaaaacaaaaagccaatattttaaacaaagtcttttttctcaagcataattagaataaagaccaaaaaaagacagtgcgtttaaagatatatctgtaatctgtgaagcacataattacattaaagatcacaactatttgctggcagtgaataaatccatcaattcacaggtgaaaaaaattagtgtttaagatgcgatgattttttcacatggacaaagcaatgaatattaaacatgtttgcttgtgtgaacctatcaaagaattctttaattaatagaatccaaatgtcactgacttgttccgacggttagcccttcataatattttccattgctgtaaataaatattactcccacagcttgtatcatggtagcattatacataggtacaatgcagtataatactttaatagacaaaatggtaaagatttgtttttcgagattctgaaaataaaataaacttttttactctacagtcttagtgatcactcttaaattatcttattttttcagcagttaagttctgagatccttttaagtgccagggttagaaaaaaggcttatgggctaaccaactaacaaaattcctgggcttcataagcttatatgaatagatacgaaatattgtccaaacagccactgcattataaatagatgacatggaagaaacaggtgtccctttccattcataagaaatcattttgctggctgcggtggctcacacctgtaaccccagcactttgggaggccaaggcaggtggatcccttgaggtcaggagttccagaccagcctagccaaaatggtgaaaccctgtctctactaaaaatacaaaaattagccaggcgtggtgccacatgtctgtaatcctaactactcaagatgctgaggcaggagaatcacttgaacctgggaggcggaggttgcagtgagccaagatcgtgccactgcactccagcatgggggataagagcaagactctgtatcaaaataaataaataaataaaaaagaaaccattttgcaaataacagatcaacaacgttcttcatcaccccattataatttaaacctgggcaactatgaatatactgtttaaccttctttatcaagtataaagagatagttcctaaatcgggcaaattatgtgccagtaaaactttggccattactgatgggaaatgaagcagcttggtgaatgatgtttaaaaacaaacagaaaactatttcaacagattaaaaagggaaacgaagaaggtatgaagtccaatgtagctagagtgaagatcaaaataaagcttccttatctaaactggaaattggccaggctacacgagactaatctttctaattaaaaagcaaggtatactctttaatgtccattatgagcatttaaatgaacacctagaatattgtcaaaataaaaactgtgatgctgacatcttccaccaatgttaaatatatatttttatacaattataaaacttctcaatctggaatcttggcaccatcaactcaaatcataaacaaaacattttggcacttgaggcaagatcactgattgatgtatactcccactcacaaacaacacttactaattactgtaaacaacttttaaaaaattgaatcaagtgttcattcaagttaacacaaatgttgccagttaagatacttttcttttgtcttaaagtttctttccctcacctctcaaacagcctttgttgtgttcttaaaatagttatgactgcaggtataacaattcaccccagtttaccagtattgtgtgttcatgtcagagatactagagagttttagataaataatcataaaggatttaatcacttactttttaattttatgcctggagacacaggcacttaatgctgggtgggggatgggatgatgcagggagcaggacagagatgggaaatgcccagcacaaatagcagaaataaacgaagaattggatacccacgtcccagttccatcctgcttctttaagtaaatcacacaacctcatttgttcactcattgattatattatatatgctgggcctgcgctgtacgatacagtagccactagtcacatgcagacttgagaacttataatgtggctagtctaaactgagatgtgctgtaaaggtaaaatatataacagatttcagagacttagtatgaagaaaaagaatgtaaaaagtctcattaatttttatattgattacatgtttaaataatattttagataaactgggttaaataaaatatattaagttaatttcacctgatttttacttaaaatgtaatttttagaaaatttaatattatatatgtggctctgtgggatagttctgtgctaagactctagtaaaaagtaggaaagaacccaggaggcagaggttgcagtgagtcgagattgtgccactgcactccagcctgggcaacagagtgagactctgtctcaaaaaattaaaaaaaaaaaagcaggaaaacagggctgggcgtggtggctcatgcctgtaatcccagcactttgggaggccgaggagggtggatcacctgaggtcaggagtttgagactagcctggccaacatggcaaaactccgtctctactaaagacacaataattagctaggcaggtgcctgtaatcccagctactcgggagactgaggcatgaggattgcttgaatctggagggtgaaggctatcataagctgagatcgcgccactgcactccagcctgggggacagagtaagactttgtctccaaaaaaaaaaaaaagtaggaaaacagaagaataaagaaagcacagtctgacatcaaggagcccagctgaagattaaaaacacaaaaataattacaatataatggtgttaagtgcaatgataaagatatatattgagggcatgggagaatgaggaaggccatttgtgaaagggtatagaaaggaaggatgaagagagatgttaggttagtcgcctgaaagaggtagtgcctgagctgagacttaaaagaataagaaagatgaagtgtaacaaatgggggtgaaagtaattccaagagaaaaacattgtatgagccaagagtaagacacagccaagggaaggagagaggaataaaagcagtttcctgttgaaagagggaaagagcaaggggtacagcagagactgtgcaaggataagagcttgtgtgacattttaaagaaactgatttttaacctttaggcaatagcctttttttcttttttttttttgagacacagtctcgctttgtcgcccatgctggagtgcaggggtgtgatcttggctcaccacaacctccgcctcctgggttcaagtgattcacctccctcagcctcccgagtagctgggattacaggtgcctgccaccatgcccatctaatttttgtatttttagtagaaacagggtttcaccatgttggccaagctggtctcaaactcctgacctcaagtgatccaaccacctcggcctcccaaagtgcagggattataggcgtaagctaccgcaccagtctggcaacagtcttttgaagagttttaagcaaaggaatgccaggatcagaaataatggtttagatgttgggcagctgtgagactgaattaaggtgaacaagactggaagcagggaggctgttgcctaggtaagaaacatcagggcctcaactagggcaataagtgaggttggaaaggaaagcactaattcaaaattatatttaagaggtatcatcagcagaatatagtgcctgactcgtcctgacaccatggaaaggagtttggattttattctagggtgatgggaagaccctgaaatgctttaagcagggagtgtgattttctgatagattttaaagaacctctcagactgctgttggagaatatactgtaatggagaacagagtggataacagatttttttttttttttaaaggaggatattgccgtagaagaggttgatggtagcttgaaccagggtggacacaaaggtgagaagcaactggattgtttgggcaggtgtgtgtgtgtgtgtgtgtgtgtgtgtgtgtgtgtgtgtgtgtgaagagacaggcgggtgtgtgtgtgtgtgtgtgtgtgtgtgtatgtgtgtgtgtttaagagacaggttctggctgtcattcagcctatactgcagtttctcaaatctcaagtgagcctcccgcgggcctcccacagcgttgaggttacagatatgagccaccctatctggcctcaggttgtatttttaactgcaaatggttttgcctaattcgtagggttgagaaagaaaaaagcaagtttaggaagatcacacttgtggagctcaattgtcttgtttaatcaggaggccaggttgtccacctagagtgaaaatagcttcagaggcttgaggactgaaaatagtaaaggtctggaagacagcagagaaaataaaaagagctgaacaaaggctattttaaggattaactgatgccctgcatgaagtttgaaaccatatgactttagtgatatcagtctaacgtgatacgtcattttcccttcacaacactcaactacccagctgcaggagttaagcatagattctagaatctacaggatttcatttgtaaatggcttgagttagatgacttttaaatctacgtgagttccaaaactttacttttaagaatcctagagtctgtactgctatcacacaatttattttaaattggtgcctagatatacataatgtaaacttaccattttaactatttcactagtttatttaaattcagcattctagccaggggcctccaataggtgtgctgggacattaaaaacctagccctgaaggtggcagcactgggcctgaggtgactagtctcaacttctgttgccactggatggaagcagcctcatcttttcattacaatatataacacaagtgttcattttctaagcatgctgaaattgaaaaagtttgggaagtactgtcctaagccacaacatatgagaaacccagtattatgaagagttcaaaataactgcttctctgttaaagatgttttttcagcagatctttggaacctcaaaatttattccatgtggttcttaaagctttagaacctatctatgaggatgcccgccatttccattgttaaagtggccatataaaatctcatttaaaaatctaagaattttgaatgtacccaaaggtttccatttacatagaaatgggatccaccagggaatgcccatttcattcattcatagaatattgatttggtggcagacactgggctagttcctggagataaaagggtgaacaaaccttttttattttttatttttttaattttaagacagggtctctcgctctgtcacctaggctggagtacagtggcacaatcatagttcactgcagccttgaactcctgggctcaagcaatcctcccacctcagcctccacagtaactagaactagaggcacgaaccactgtgtccagctattttggtttgatttttagaataggagacaagatttcactatgttgcccaagctcatcttgaactcctggcctcaagtgatcctcttgcctcagccacccaaagtctggcccaagacgtggttttttatctcaagaaatttacagtccagtggggagacagaattaattaaataactaaaacaataaaaactgtaagatggggaggttacatggtactgtaggaggatctagtagaagagactattgaaataagataaaaacatgattagtagatagctggggcaaagagtgggggtaggtttggtggagaactccaggcagagacaatagcacgcaatggcctaggagacatcaaaagtctagtgagaccagaggacagaaaatgtctggaaataaagccaaaggggtagcagaggcaattcaaaggggcttccttcacagagtaactggaagccactgaaagggtttaagcagcatagtgacattaacagatttacttttcaagatcacagtagctgcagtatagagaagtggtctcaaagtagacacaatttaaggtggaggagggaagatgtatttttattctattttttatcctttaaaaatgcttttaaaatggattataatcatattagctaagaaatactaattatggctagcttttgggcacatagtatatatctgaatactaagcagtttacatatattcatttaatcttaataccctgtgaggttggtactattattatcctcaatttacaggtaggtaaaatgggacagcgagcttaagcagtcagtccaaagtcactcagtaaggaagtattagagcaggatttaaacccagatgtctgacttcagagcctgtaacttcattagatcatgtaccatttttcaacagtacatgtatgtaatttaaaattaaatatatatatggagaatagaagttcaaatttttttctgaacaccagtgaaaacaaagatttaggaggggtggttggtagcgtggatgtggaaaggagcctagcagtagactaggtaagaaataacagtatcttggattatggaggtagtgatggagagaaggggatggatttacatgtttagtaagtaaaattggactgcgtgatggcttggatatggaagttagggatgaataaagtgtcaaggatgactctttggtttctgacttgcataaatggattagagagtgagacacaggcagaggccataggaacaggttgggtcattctgctcagtttttctttggaccacagtagagaccacagcacactgctctttcaatactctgttaaatgacaaacttattacaggttatttctgtcataaacataaaagcttcactctgtcaattatgtttcctatcttgcgttaaaaattacatagtcaaaatttcatccattttcttttaaaaatgtggagttaagtcttataaaatggggaagtgaatgatagttgctgtaacaggctaatagaaggtttagcacccctcttctgtatactaactttttaagttatatttattcatcccttaagatgtgggacaggtggaaaaattacctttccactttgtatttatgatttctaagtactaaacttttaaagcctgttaatattatcccttcccaggtcttagaataattacacaaaagtactggactggtttaaaagatatttgattctagtctattttgttcatttgtagaatttctagtggtctaaaaacgattcttttacaaatcaggagaaataggaatacctactatcggtttgaatctcaaacgaacagccacaagaaaaatggactttttaaaaaaaattatctaacagcatgttgtcccaataaataatgctgaaggagattccttctcgtttcaaatttgccagaaacttcccgtttaacctcagcaaaatacagatcgttttgatctatggcgttaccgcacaaccctgtcaggtcacatcactaaactgcagataacagcgacaaggccgaaaactatgttagacggatccgcgtccataccccccatcagttaattttaactcttcattcggtacaggtcactctacacatgcttccctgcaaaatgcttaagctagacacagtgtacagataactttcacagaaccgcaagggcttgatgctcccccaacagaacggcttgagctttccccagcgcaattcagaaatgctgtggcggtcgccagactcttcgggtagctcccggcagctccgaggtagcgctcccctccccaaccatcgccctccgggatgggccgcaccgaagagcccgctcctcagctagggcacgaagtgcgccgccgcgatgggcagctggaggaaggggcgtgacgcaagtggaactcccgcgtgacgtcgcgcgggctcccgggcggggcgggtccggccgcctccgagcccggccggcagcccccggccttaaagcgcgggctgtccggaggggtcggctttcccaccgaggatttggcactctggtgagggaaaagggcgaaagagaaaagcgagcagccgtcctttcacagcctcagaaagtgctcgcttcccttcgggggctttcgcgaatcccgaggcaatctcggaggcggtgagtaaaagcaatctctttaccccacccggagctctgggtcggagcgactgcttctggtctggagctgcgtgcttggcgaagggctcccggggtaggggtggctcccggctctggggttgtgtctgatgaaataggccgggcccgggctacactcggtggtggtggaccggcgggaggacgagcgctacctcagtactacttctgggtctcccgcgcgggctgaggaagcgcctttcgccgccaagcccgccccgcgcatgcgccgactgcggctcgcgcgcgcgcttcggaggttttttggccagacccgcacgcggaaccggcgcgggcacctggggagaaatggatggagaagggacctggctggaaagcctttgccccgctgctctgctccgcccataagaggacccctgaaatgtcccgtgcagtttgttcaagtcccctgtgtgatgaaatgtgcctctcgccttacccgtgtgagaatacctgtggtgtggcagcgagtattttggtgagcacctgcagtgtagtggtttatactaaggaatacacacaaattacaggcctttgagcccagaatgcaacttgggaggtaagacgtgacgttctgagagattgaaaaatgtacattgtcgtcgtgcctcgaataacggttcattgcagagagagatgctaacaaaaagtgccgggcatgcgggtaggtggaaagggttttgcgagccagaatttgcaagttgaatgttttgtttttatgttttgtttttaaggcactgtacatcacttacttgaagatagatacgtaaaggatgcttattttacactctttaaacgaatatgttaatactttttcggtcattgaagtaattaaaccttcattttaaactgttgacttaatagaaatcgtttatgtcttctttttttttctttttgctgcagagaggtattttttctttattttattattattttttatactttaagttctagggtacatatgcacgacgtgcaggtttgttacatatgcatacatgtgccatgttggtgtgctgcacccattaactcgtcatttactttaggtatatctcctaatcctatccctccccccaccccacggcaggccccggtgtgtgacgttccccttcctgtgtccaggtgttctcattgttcagttcccacctatgattgagaacatgcgggctacagagaggtattttacagttattggtctcatgacttgatttccatccctgacatagccatgtcccagctgtgtgaccttggacatttactgccttacgcctcttcccccaactctaaaatgaaattatagtagctgtcttacagagtttttctgaaggttaggtagaatataaatattctataatatataattatatattaaataatatataaatacaaatattaatattaatattctatagtttctggtatgtgggaaacaaatggtgacttttattcacaattatatataggcccatttgtttatctgttagagttaaagatagaataaaaacctctttggtaacaaaactaatgcagtgcacctaattctacttttaaaaacttttttacagaaataaatgtacacaagagaaatactggaattatgaaccccattgtatacgcacccacccagcttcagaaattgttgaagttcagcccttgtttcatctcttcacccaacatccatttttgtttgtttttgctggattttttttttttcaagcaaatcgcagagtatatccctttacctgtaaatatctcggtaaatatccctttaacagataaggcctttctaaaaaaaaaacaaacaaaaccgcatcattatcatacccaagaaaattaataatttcctaatatctaaaatccagctcatatttagtttctggattattttttaaaagtctaatcacaatttttgcaaagcttgatagtttatttttgtagctcttgacggttcaccaagtggcttcacatatactcctgctcccttcagaattactctttcagcccctttgtcagagacctcaggaaatggttagcaggaaacaatcagtttgctttggctaaggagccagatgtgaggtttagtagacttgctgatcactattactttttaagttgtagctaattaatggtttcattttaagaacacatattaaaatatttactaatccattcaaacttcttaacctgttggtttcttcaaggactatgtaataaacttaatgattcacctttattctaagagaggcatgaagtaacattaccctaattgtcttatgactctaagatgtttctgtattcatagatctttgctgtgtttaaatcttactgacttctcttgtttttggaaagttatacagatcctcatctgtgttaatacatcagtcaactgtctcttttataaaatatatatagatatgtgtatatatgtggatgcttgttaagtcaagactaagaatatttttcagttttgggctcagtatgtttcaccaattcaaaagttaaaaaaaccaatttttttttttaattgagacagggtctctgtcgctcaggctggaatgcagtggcacgatctccgctcactgcaaattccgcctcccagtttcaggcaattctcctgcctcaacctcctgagtagctggggccacaggcacgcactaccacacctggcaaatttttgtatttttagtaaagatggggtttcaccatggtggccaggctgatctcaaactcctggcctcaagtgatctgcccacctcagcctcccaaagagctaggattacaggcaagagccatctcccccagccaaaacaatacattagtctatagtggtaaattaatactgaccatgaatgataaaaacccctcaatatctgaatcctttctgtttaatataattgagataatttcttcctctaagagaaataagaaaatttgcctgaaaatttacctcatatagccaaataactgaaatcagaacttttctcaccattatcatctttccttattctttccttcccctcccaaattctaaaaatgattgattataggtaaataaggaaatggtaaatgaggatatctgggcttgtgtttcatcctgatttcaaagtacataaagataaatgcaaagttcatttatgttgcaatctgtcatttcaggtatttgacctgtccaaagacgacttgatacctctataatgtaacagaaaaggtcagaaaatattaagcaagtagaagtgtggagcatattaagcaagatgaacatctcgggaagcagctgtggaagccctaactctgcagatacatctagtgactttaaggacctttggacaaaactaaaagaatgtcatgatagagaagtacaaggtaaaatcttttcttaaatacttacagcagtattttgttgagactgtagtggctttgtatacctttgtatgacagtcctgtttattatttctatttcagcttttaggttccgggggtacatgtgcagatttggtacatggatagattgcatgttgctggggtttggtgtgcaaatgatttcatcacccaggtagtgagcatggtaccccataggtagtttttcaatccccaccctcttcccacccccctgaccctccaccctcatgtaggtcccagtacctgttgttcccctctttgtgtccatgtgtactaaatgtgtagctcccacttataaatgagaacatgcagtatttctgttgtctgctcagggtaatggcttcatctgcatccatgttgctgcaaagaaaataattttgttcttttttatggcttcattgtattccatgatgtatatatacttttttttaattcagtccactgttgaattttgtacatttaatggccatctttaaattcaaagatatcttttttttttttttattttttttgagacagggtctcactgtgtcaccaggctggggtgtagtggtgtgatcacagctcactgcagcttcaacctcccattctcaagtgagcctccctcctgtagttgggaccataggcacacgctgccatgcctggctaattttttattttttgtagagtcagggtctcactatgttgcccaggctggtcttgaactcctggcctcaagtgatccttctgtctctgcctcccaaagtggtgggattacagacgtgagccactgcgcctggcccaaagatctcattatttatttatttatttatatattcatgtatttatttatttactaattaattttcagagaggttctcactccgttgcccaggctggagtgcagtggtatggtcacagctcactgcagctttaacctcccaggctcaggtgttcctcccaccttagcctcctgggtacctgggactacaggtgtgcaccaccacgcccagctaattttatgtattttttgtagagacagagttttgcctttttgcccaggctggtcttgaacttctgggctcaagcagtccactggcctcagcctcccaaagtgctaggattacaggtgtccgctgctgtgcccagctgatctttttttctttttctttttgagacagggtcttgctttgtcacccatgctggagtgcagtggtgcaaacatggctcactatagtgtcaaactctcgggcccaagtgattgtcccacctcatcctcccaagtagttgggactacaggcgcacgcaccatgcccagctagtttgtttttgtttttgttttttttaaacttatccttcaccttagaacacctagctagtttttgtattttttgtggagtcagggtttcgctatgttgcccaggctggtctcaaactcctgagttcaggtgatctcccgccttggcctcccaaacagctaggattacaggcgtgagctgcgcccagccagatctcatttttagaggacatttacaattgtagtttttgtgattcatttttatggtcaaattggtgctttttaaccacagaacatagtttgtatacaacttgctgttatttacttgtggtaatatgtatgagatagtggaaaacgtatacaatttgttgactgaagacctgcatttgaattctgatttcatttacccacttgctctgtgatcttagcctaattacctaacctctaaatttaattttcttctataaaattctttgcaggatatagacataaaaatactacataaagtcatttgacaaacccgtagcactgaaatacaaaagtgaatggccacttaccttcagacagcctgcagtcttagtagagtcgtgtaaacagataattacagtacagtgaaataacagttaaaaggtttttatgacgtgcaaggagttttagaggattaagcaattgtggttgagatgagtaaatattatttgtgttaaaagatacaccatatgaagctaagctcaaggttttaatattaaattttaatatactttaattctgtaactttccctatgtccctatgtatgagaaatgcttcatattacatttgtttcttgattacctattataagtttaatattgcagtgctttatagctgtatcattacactggagtactattaaaacataatcaacctgaatctaaagtgtagtatgtgagtctgtattagaactttcttatggtaggctgggcacggtggctcacgcctgtaatcccagtgctttgggaggccaaggtgggcggatcacctgaggtcaggagttcgagaccagcctgaccaacatagagaaaccctgtctctactaaaaatacaaaattagccgggtgtggtggtgcgcacctgtaatccccgctactcaggaaggctgaggcaggagaatcgcttgaacccaggagaatcgtttgaacccaggaggcggaggttgcagtgagctgagatcacgctattgcactccaccctgggcaacaagagcgaaactccgtctcaaaaaaaaaaagaactttcccatggtaagtttagtttcttgcaaaacttctggtgacacccttattaattaatgagttttgaaatatgaacaaccccaaaagtattctttcaagccccagtgttcatggagacacaaagaaatgttcaagaaatgttttttgggcacttactatgtgccagaccttgtgaataagaataaatcctatatagtgctagctttaagggaatttctagtctagaattttaatgcagtatactatgttattatctgaaaacatgaaggaagaactgagggtgtgtgtggttgcatggggaagtgggtttgtgcatggtttatgtcagaccaggcttgataattaagtctaattagccaggcaaggaagatggtggaaggggagggaattttctgagtagagagaatagcacatgcaaaagtttgcagataagagcttgattttattcaaggaactctggatagttaggtttagttctaagaggaaatggaatgggagattggagttttgggggaggtggataggatatgatgctagaaatgtacatagatccaaattatgtaaaatggtatgtgctatgctgaagagattgtcatcttgccttgactttaggacagatttctctatttctgcaaaaaatgttgggattttgggatttgggattttgataggtaatgcattgaatctgtagattgctttatatagtattgacatcttaacaatattgttttgtagtccatgaacacgggatacctttctattagtgtcttctatatttcttttttttttttttttttgagacagagtcttgctctgtagcccaggctggagtgcagtggcgcgatctcggctcactgcaagctccacctcctggattcatgccattctcctgcctcagcctcctgactagctgggactacaagcacccgccaccacgcccggctaattttttgtatttttagtagagacggggtttcactgtgttagccaggatggtgtcgatctcccgacctcgtgatccgcccgcctcagcctcccaaagtgctgggattacaggcgtgagccactgcgcccggtctatatttctttttaagattttttaatttttaattactaatttttagagatgaggtcttgcctcattgcccaggcttgagtgcagtggcacaatcatggttcgccgtagcctcaaattccagggtgcaggcaatccttccgcttccaccttcagagtagctaggactacaggcatgcaccaccgaacctggctaatttatttttttatagagacagggatctcattttgttgcccaggctagtctcaactcctgggctcaagcagtcctctgacctcattggcctccaaaagtgctaggattacaggtgtgagccaccacacctggtcattctataatttctttcagcaacattttctgattgtcattgtacaagttttttgtctccttggtgaaatgtattcttaagtattttattcttttgatgctactgtaaatagaattgtttttttaatttgcttttcagattgttcattgttagtgtatagaaatacaactggttttagtgagttgattttatattctgcaactttcttgaaactcttgatttctatttttgttttttatgttttgaaacagagtctcactctgtcacccaggctggagtgcagtggcatgatcgcagctcactgcaacctctgcctcccaggttgaagcagttctcctggctcagccccgcaagtagctgggactacaggcacgcaccaccactcctggctaatttttgtatttttagtagagatgaggtttcaccatgttggccaggctggtcttgaattgctgacctcaagcaagccgcccatctcggcctcccaaagtgctaggattacaggcaggagccactgtgcctggctatttataagctattaatttaatagaaataaaatatttgacagatttcttcttcctattctttggtgttacaggatcttcatgaaatccctattttacagtgaggaagcatcaagaaacaaatggtatactctttaataggaacaatatgccatatttatcaaattatagaatatataaagcttgcaaatattatgtagtagataattcctttaaagtgtactcctcatggttatgttctaatcacattcccacaaaagtttctatactctgaataactttaagggaggaatacagtaattgttggtgtatatgataaggtccatgtgttttatgaatattaggtattggatatatgagctcataagagaagataatctttggtacgttatattgatcatgccactttcccaatttcaaataacttatggattcttaaaggtattaaatgaataagtactattttttaagtagatatgtcattttaaaacattttggtttgggccatgccttcgtcaatatgttccacatagttccatataaaattagagtctctatatgataacatcaaagacatgcctgaagggaacttaatttttttaaggaggtggggaatccatttgtagaaaccagtgtaagaagctgtttgaaagacatcaaacatggacttgtctggactttgcaggttttaaggtatatataggaatcaaaattgactcatgacttttaaagcttcatgtcagtaaaaaataaaagagaaatgttgggaatggtaatatttgagatatatagtttttacttagctacagaaatgtacccataggaacttgcttgaatctgaatgctctgctacacgtgtttagaattatttttgcctcttttgccaaaacataataaaatgatagcaaaatatgacagtatgtgcactgatcacaacaatataataaactgcatccatgtcttttaaaactaggcaagaatagacaaaatgctctaatttctgttggagactagcaatatgcaaaccagaccatttttgttgaaaaattctggagacatttatgaccgagtttttatatcctttaagataattttatcctttcatgattgtatcatttcatgatatgttccttttgtgacaaatgctgctagtatcagtgtcacagattgttactgatgatatacagtgtttatgctttaaattccgaactcacagaatttaatggaaacttcagaattctttaaatttcaaaagttttaaagcatatttatttgggtacaaaattttattgcctttaaaaatctttttcagtatcaagtttattatcaaaagcacaaataataaaatagaatttaaaatatttattttcagaataccactattttaataaatgatcttttgcctatgccagcgtctgctattaacatctagctaatatattttctgtgtctagtaaatatggtaatcagtttcaaagaaaactaggtaggttttgtgaggcaaagttgaaacaccttgaagaaatgggaaagtttgggggctctaataggacaggataaatatttcttgattcattttttaattgctccatttattttctatacatagaatcaaaaattctaaaaagagaacattatcttaagactgcacaaattaacagtgaaaggaattgtcccactcattattaagaatgctgtcaggctgggcacagtggcacacacttgggaggccaaggcaggaggattacttgagtccgggagtctgagaccagcctggacaacaaagcgagaccctgtctctacaaaaaacatttttttaattagctaggcatggtggtgtgtgcctgtggtcccagctacttgagaggttgaggcaggaggatcgcttgggcctggtaagtcaaggctacagtgagccgtgattgcaccactgcaccccagcctgggtgacagaaatcctgtctcaaaaataataataatattattattattatcagtaactctcacaccttttattttttatttgcattcacatctgtaaataataaaatccacaaaaattaatttacccattttgagataattcaatcttaagcaaagtgagcacagcttaagtatggctttggaatttaaataatttgttaggcaattatagaaatgctagcagtagtagttttggttgaagtttaattacttcatttgtatataaagcccccactgtttgtcaagaaagtgatgttaggggtattatttataattcagaaccataaataacttgtttaaaatgacagtacatacattttatatatatatatggtttggtctgggtaaagaactaaaataagaacatagcagtgatttttgttaatgcataaggaattcttgcctcatttctgaactcttaaatttgctttgtgtattacaatatacaggcccttgattgtttcatttcctccaaaatttatgtatgagtgtgtgtaaggttaattgtagcacagtgcttggtcttgtgaacactgtttcctcaataggtatcttaggttgccagtgttacaatcccagatactttgttcaacagattacctgttcatacaggagctacattgttgtatagcctcattccttccgatgggtgtggagcaggattaaagcacactttataggggttctaattgtagattcctaattgacttggtgaatagcaaatgctaaaatttaaacacacacacatatacacatataaacctgtttcagggtgatctacgtgacagaacaaatgcctcacaggtgttgaatgcttaccagataaaagagtagttcttcccctgtttcccaaggattttcttttgaagtttatatggattttctgtctcattgtttcttttcttaaaatggtttgtggcaagaatccatttcatctttggctgcacttttcacttttaaaggcagaactgattgttagaagtcagccaaaattaaaaacaaaaaaaaaatctgtcaagtaaaatttcgcacatttttgagaagggaaaacatgtgcatggatgcaccacaggttttggttttttaaacaactcacttattgaaggatgtttgggttgtttctaatgtttggctaagactgctgtgaacattcaatacaggtttatctgtaacatttttttcaccatcttatttataacattttatttattcaaattatagagcatagaatcgaagataaaatgtgtcatatcagttggacattttctaaaggtgaaatttgagacataaggaaaaaatgtaacatccaaaaaattctccagggcctttatttttccacagtatatggatttcctggcaataaatcattactatggagggcaataagaagagatgacttcttctttagtgtctatgtgaccatggttgggaaatgtataggtttgtttttaaaatttgtatttgtctaaattatgttgtccaaaagattgtatcaagtttaacaaataaagaaaaattatgttcttaggaatgataaatatattaatgtttctatacacatatatgaaaaacttttctgatttataacttgatagaatctgtgaactaccaaaggcatatagtaaatattcttgggttcttcggaaatcagtcaactagtaattatttattggtaactaactgccaccaaataaaaattcttgagtagatctataattgggtaaattgtagaatagtaaaagcactgattgagaaattaaagagtaaatattgagggcttttttcccctttatgttaatcacattgcagaaaatggggagcatagagaaaatagagggcacagcaatattcaacagaaaaaattttctagttttttactattttaatatttgattaaataacttcattttattttattttgttttgttttattttattttattttattttttcagacggagtttcgctcttgttgcccacgctggagtgcaatggcgggatctcagctcaccgcagcctctgcctcccgggttcaagcgattctccccagcctcccgagtagctagggttacaagcatgtgccaccacacccggctaattttgtctttttattagagacggggtttctccacgttgatcgggctggtctcggaactcttgacctcgggtgatctgcccaccttggcctcccaaggtgctggtattacaggcatgaatcaccgtgcccagccgattaaataacatttttaaatcaatattgggttttataatttttacaattttgctagttgttttggtttgacttatatttagttgctgatgatgtatgtattttcatatttgttcagtgacttttttcttttgttaattactgttcatgaaaattagaaatgtcaccctgttttgtccatatccttccttgcagtttcaatgcctgtcagtctgctttcttctcagtaattacctgagtccataggcagtggtcttctcttatgttttgtatcagacttaattaaaattaaaaattcatgtaatagatatcttgagataaaacattcatgccttttgttaggtacttttccataaggaattttgctactagtccaggacttcctaccacagtctagtttaatcccagaagatttgtgcctacataaacaccattgctgttagcaaatacacaggctatgtcagaacatagaccttcatttacagtgaacttctaattatatgcttgccctgctattagaaaagtaataacttactttagatggggaaaatgttattccatttgactgtcatatgatagactaaaagcaatacattgcagatatgcttttgtgactgcagagtacacgtaaggggcatatactgtaaactaatgagacctggtttattatttagaggccagactgatgtgacttaatagtggagcatttgactcataaaggaactgttgtagaagtaataccttttctttttacttttcaggtttacaagtaaaagtaaccaagctaaaacaggaacgaatcttgtaagtatcagtatgtaatactcatgtgttatttatagagtagttgatactgatgtccaatttgacattcatagagtagttgatactgatgtccaatttgaccttaatgtcttatttataaaaaaaattagccctacttagtatgggccttggtagtcagcagcagttttttttttcaaattctaaagtaaaaagaataattttgcaattttaagtgtagccttaattatgtatgtttatattgtaatacaacttacatatgtaatcttttcccataaagtattaaaatgacaattgatctgtagtctcattttgatttgtcagcggagttctttgttgagccataattaacacatggaattcaacatgctacaagacgaggagcagaataattctgggatttctaaactcatatgaatggaaactaaatgggtattttaagactccttttaggtagtttgaaattacttgaagattctctgaattgttttgcttataaagttctaaatcagatctgattttttaagttcgggaacatattttactcatgattctctagagcttccacattcaggaatctgaaacagatggcagagtagctttgtaacacttactaagaaaattctctttagctgctgagaaatttagaaattctggaatatagactattcaccttcagataaactcttgttttcttttaaaattattttaattaagaaatttaaagaattgtaaagacaaaaaaaattttccagttgtgcagcactgttttcatgcttttgattccttatcacaaagtttctttgtagagggtataactcgaacataatgttttgtccattttattcatagtagttcctatccctccctatagatccccccaccccagcccccatatatgacatttgatttaaaagtaatgaaaaaattgttgaatgtgctgcataggtatgtaaaagagacaggaaggtttgttatctattttattacagttacattttcaaatacaagatttacccagcttcttatgccagttgtatttaaaatgttcagttaccttagaaagacagaaggccaccaattaggaaaatgatactgagtttttagtaaaatgctgctaatggcattgagcttgctttagaaatgaagttagtgattggtgtagtaataactcttcctttggatgaggtccagggtagacctgtctttaatatattagacacttccctgtttttgaaattgcatgactctttttgcactgtctggaattcatcaatttgcttttttaaagaccttgttaaattatttctgcaattagtaaatgctctttatgttaccactttcttgacctgaatattttattaagtaattgaagttagttttaacttcaacttaggttattcatctacataatagtttagctttaagacaaatactgtcatgctctgcgttattctaaatagaacagtaatggaatatatgaatatgggaaaatcagataactcactactattacagagttctgttcatcatttaagaaaaaaccctttgctattaacttttcactccttaagagtgaaaatgtatatgtgtgtaaatcttcaatgtgtgtgtaaatcttcaatttaatatttactgtattttatgatacagattatttaaggcaaatgtgtgtaaattttcaatgtaatatttactgtattttatgatacagattaagttaaatattaaatttgaatacatgttggcagtctgttttaggacatgattaatcacacctccaggcttagacaagttatctggttgtatttgctgaataggatcagtgaaaacctggtgttccttctgaattaaatatattttctagaagtagtaggaaatattttatttatttatttatttatttatttttgttaaatgagaaatggccaggttaacaagcttcaatgatatattactttctgttattttcaagttctcagatgtccctacatgctaccataactatatttgttgtatagccagaaggtgttgctcttacgtgtattggtttttcaattaatataaacttttcaacaaatatttaagaaattccctctatatttgatacctgacattttggcttagttgttttactcatctattttggtgccagtgacactatattctagccactttgacacaatcattttgacatctactttttatgacagactgatttgccactcttaattgatttgatattttagacccttcaagggactgggagaaggtgtttgaatcatagtattacattttcagcttcaagactatacagaaaatcctaatcaaatttctaatgggttttcttagaattaaaatatgtgaatactttatataataaggtgatttttaaaaataatgatagaggggtaaaatatgacaactttggaaggtaatcaggtttaagtagaagaagattctggttgtctttgttagttttttttctcactataaagtcataatggtaaacacttaacataaagcctactgtgtgccacactgttccgtatccaatacatacattaatacttatttctcagaccttttggagtagatattaatgtatctacacttggtgaggcacagagagtttaggttaattgtatcaggtcacacagctggtaaatgaagagctggactcaaacccattttgcatctgggcgtagggttcccgttcgtccacttcactgtaagctctgacttaaaagcaagaccaggtaaaaattttaaacaacacagaaattagtaaaatagaaagtatgagttccccataattgaagagatgatgtgagtagagaaatactatttacattaataaatatatgcaaaataataaaataatgtacattttgatagctattttgacaaagttgagtcaatagtggcatgatgactttatggtatataagagctctgcagagaaaattctggtataatttgaactgtgatttacaagatattccaacctgaccttttcagttgttttgttttggtacaagaaatttgttatataaacacggtggagctcttagaattatcctgttaagagtatttttatctgaaaaacttatttattttttgacctttagagatgcacaaagactagaagaattcttcaccaaaaatcaacagctgagggaacagcagaaagtccttcatgaaaccattaaagttttagaagatcggtgagtctggcacttaggtcttgagtaagaagtgatttcctccataataagaagtacattgactttcatttgtaattagttttgggattgaaagtgatctttcccacagccttctctcacctttgaatgaatactttatgaaaacaaggatctattctttaagattttcattaattctgagatcacatcagtttaccctttaaatgatatctttatctggtgtttgatgtagtggaagctcaagggtagcaatgttctaattcatttaatgctttaattccagttttacttctaagtaggtggaaactgcttcacaattctgtttctgtcgtcttttcttgttcttgctgttctcttttcttctttgcagatttcctcactttgagggagtctagggatcttctttctgagtattcctgaaataatattatcacttacttccatacacagacttctttctttcccactcctatgaggttaacactgaggattagaaaaggcttccagcatttgctgttttcccttttctgaattgtaagtgctatttaggacctataaactacctacctgctatagtaaacaatattccagccaagcgtggtggctcacacctgtaatctcaatactttgggaggctaaggtgggaggatcgcctgaggccagacattcaagaccagcctggacaaacaaagcgagaccctgtctctacaaaaaattttaaaagctgagcatgatggcctgaacctgtagtttcagctactctagaggatcgcttgagtccaaagtgattgaggctgcagtgagctatgatcgcactgctgcgctccagcctgggtgacagagcaagaccgtgtctccaaaaaaaaaaaaaaaatacaaacccacgatatcccatactttctttatagtttttatttttccagggtaggcatagtggctcatgcctgtaacctcagttctttgggaagccaaggcaagaagatgattgcttgagtccagtagttcaaaaccagcgtcgcagtatagcaagaactcatctctacaaaaaattaaaaattagccaggcatgtgactggagtcctagctactcaggacactgagacgggaggattgcttgagtccaggagtttgagcaagctatgattgtgccattgcactccagcctgtgtaacagaacaagaccctgtctcttaaaaaaatttttttcttgatatttttgtatatgttacggaagggctgggtgatttgagtttgtctctatccttttagtggtgaaataatttaatattcttcatatgtgcaaactgaaattgagtactttctacaactaccaactcaatggatgcacatttgttggaataggcagtgtattgtggaataaagacctgtgcgctttagaatcacatatgtttttgaattccagcttcaccctgtgttcttaattcagattccacaacaaatatttgagtccttgctgtcttaggtgttgctctagggggctagggatgatacttttcctagtatgtcatggattaaatgagacagtgcaagtaacaatacataacagaagttgaataagacttacatatcttagttggtgaatataatttagcactcctgtctgtgcatatatttaattttcaaaggttgggagtgagccatacgacaaacaaatgagacaatttcagattataaatgctatgaagaaaataaaatcgaattatgtaattgagtaaccacaggatctgtgtagaaaaaaaaaccaaacgcagcttttcccactgtactcgtacaacatgcttcagacaccagatgtgaggaggagtttcccctaccaacaagcaaacaattaattctacagcagacactagctgggtatcctcttaattcaattcctacactggatatggcatcaggtcccacaggttgagggctttgtccccatgactgtgtccttccctcaattctgatgccaatttcaagccccaggttgtttacccatgctttggacagactctaaattggggttcccacaaccccctcctcgggttatatttactagagtgactcacgaaactcaggaaaacatttatatttatcagtttattacaaaaaatttgttaaaggttacaagtcaacagccaaatgaagagatacatggggtgaggtctagaaggatcctaaacacaggagcttctgtcaccatggagttggggtgctgtcttaactgagacttgattgacagaaaggaaccatccacttgaagaactagagacaaaaggaaatagaacagacaaatgtgaaagtctagggtagaaataagtttgaaatatttgaggaacagaaagtctactgtggttctagtttaatgagtaaaggggatgagtgataggagtgagattggaaatctagtggggcaacaactagatttcgtagggacataggcaaaaagtttggattttaattgtgatggaaaccacttaagcaggagaataacaaagggatataagtaggtagcaacagcctgtctatccaaatggaaatgtcaagtagatagatgtatatgtgaatctaggattcagtggatctcttaaggacatctttgaatagtataggaagaaagaagaggtcttagggctgaatcctttggcattcctgattaaggtttcatgaagaataaggacccagccagcaaaagattgagaaagagaaactattaaaatagaagaaaagccaggaacataggtcttgaccactaacaataccttctttgcagggctattttgaagtttaaatgagataatggaagcagcagtacataacagatatttaataagacatatactatctcctaattggaagatgattccaacttttagcactctaatctgtgttatataacacagccatgtctaggctgtctagctgagaagccaggaaactagaaagccatctctcccactcaccctttcccaggtcagcaatggaaaggaaatcattagttactcatctgtagtgtggtgaggcgcttccttctgttttctctggatatgtagtagaggatttcagggaacatatctctctcagcctttaactccagccattgaagagcttccttctcttatttcaccacgttttttctctcatttctaccattacaccactttctacaagcagtgaggttggagtgagtaatggcattaacgccaagagattaggaatgctttttgttccatcattcctatgtaaagaaaatttcaagattggtattaataacgaaatatgttagcctgagttctctgagaagcaaacatcaataagactttggacactgaagagatttattgggaaaaatacctgtaagaaatgaggcgtctgggagagctgtcagaccctcatgcctctaactctgtgaagaagagagggaagaggatactgtacttgtaagagagctttgacaaagctaacagggagtcctggagccatagttgccctgctttcctcatttatagcaggatctgactatgggatgcctggtgtattcacctatgtggaaacaggtgaaggatttcacagcacagaaggtggagccagggattttattctcctactgtggtaggagacagtaagatgactggccaacttatattgacttccagtactcttcctgtttagttgttccttagcaagttgttagagcccaaaattattacactcaaatttactggataacattttcattatgtttttcttgaaacattggcttaatacaattggctctccatttcatccccaagatagtattcttcatcctgccccttgaagacattgctttccagtgtcttcaaaacactcttcattttatggcttaaagtttgagcttcctgttctggtaacctttgcagtcttgtacttcctttttaagtagtttttcttctccaggccgtttcagagaagaaatcagtggatgagtgcctcatctccttcccattaaattactttcttttatgtagtctatatattttttttttatttttatttttccctgtattagtccattttcacgctgatttaaaggactgcctgagattgggtagtttataaagaaaggtggtttagttgactcacagttctgcagagctggggaggcctcaggaaacttacaatcatggcagaaagggaagcaaacacatcctttttcacatgatggcaggaagaagtgccaagcaaaagggggataagccccttataaaaccatcagatctcatgagaactcactcactatccacaagaacagaagcatgggggtaaccacccccatgattcaattacttcccacagttgggactgtgggaactacaattcaagttgagatttgggtggggacacagccaaatcatatcattccactccttgccccttccaaatctcatgtcctcgcatttcaagacaatcattgccttccccacagtcgcctagaatcttaactcattacagcattaacccaaaagtccaagtccaaagtctcatctgagacaaggcaagttccttccgcctgtgagcctgtaaaatcaaaagcaagttagttacctcgtagatacagtggggatacaggcattgggtaaatacacccattccaaatgggagaaattggccaaaacaaaggggctgcaggccccatgcaaatccaaaatccagcagggcagtcaaattttaaaactccaaaatgatcccctttgactccatgtctcacatccaggtcatgctgatacaagaggtgggttcccacagtcttgggcagctctgcccctgtgattttgcagggtacagccccattcccagcttccttcacaggctggcattgagtgtttgcggcttttccaggtgcacagtgcaagctgttggtggatctgggtgtttctggggtctggaggatgatggccgtcttattacagctccactagacagtgtcccagtggggactgtgtggaggctccaacccaacatttccctcccacacagttccacatggttggggaggcctcagaaaacttacaatcatggcgaagggggagtaaacacgtccttcttcacatgatggcaggaggaagtgccaagcaaaagggggaaaagccccttatgaaaccatcagatctcgttagaactcactatcaagagaacagcagcatagcgttaactgcccccatgattcagttacctcctaccagatccctccctcctgatttcaagcagttctcccacctcatcctcccaaagcgctggtattgtaggcataagccactgtgcgcagccagttgatacatttaattgttaaaattatgtgttttattctgcatttcttaaaactaggttcttttctctttaagatctattctacctctggtggatgccatgctgctttggtatttctcattctaaatattcccttgcctttcattccattcacctttacatcctcaggtacatgggcctgtaattcattaggtggtattaatttggtggcagggagtcggggtgggatgagggatatgtagctcgttgttttgtagacttgcttttgctcacctttcttcaaatgcaaatccaaaatttcctgtgggcacacttaaagatttatctcttgtttcatgaagctccatttaattaagctgaagatctgtttttttaaatacagtagttagtatgtattgaggattcactttgtacttaggcatccagcgctaaatctttctattaacgctacaggatagatgatagatccattttgcatgtgaggaaactagctggcaaagagcaaagaagctttcccaggatcacatagttaatacataattaggtttatatcttttttttttttttttgagacagagtcttgctctgtcacccaggctggagtgcagtggcgcgatctctgctcactgcaagctccgcctgccaggttcacgccattctcctgcctcagcctcccgagtggctgggactacaggcgcccactgcctcgcccggctaatttttttttgtatttttagtagagacgggttttcactgtgttcgccaggatggcctcgatctcctgacctcgtgatctgcccacctgggcctcccaaagtgctgggattacaggtgtgagccaccgcgcctggccaggtttatatcttaaatctgatccccgcttccatttttactatttcatgatgcctcccctttatattgtcttaactttattaatgttatataaattaattacatcttaaatgatcatctcaaagtatttgtgcttgatctaaagtttaccaaaacagacactctgaaatatcaggtcttcaacattgcctattgtatagtctgtttccttggaaggtttttttttcgtttttgtttttttaattgttgctaactaaatactacctttaaaggactaagtaggtaacttttggtgaatttctgctttatttaaaattttcttttagttctatgtcatatgtaagaatgattatctagagtaagctttaaaaatctgtacaaactaacattttgctgagacctttaaaagcaacatgtattttgttaatttttttttcttttgtttggtctttttgttttgttttgttttgtttagagacagggtcttactctgttgcccaggctggagtgtaatggcaccatcatagctcattacagcctcaaattccttggctcaagagatcttctcacatcagcccccccaggtagctaggactacaggcaagcaccacgccatgcctggctaatttttttgtttttatagagactgtcttgctgcgttgatcataggctggtcttgaactcctggcctcaagtgatcctcctgccttggccttccacggtattgggattacaggcatcagccactgtgttcagcctattttgttaaaatttctgaacagtaattcagcctactcttcataaaacaaagcaattcttagtatgttaatgggaaaacactgagatatttcaatgaagggaattacctagtaaaagtaaattagataataaaaagttctaagttctaattttatgtggctcatttatgtttaatgattattatgttttatattatgtttaataattattattatgtttaatgagtatatttacagactttccttccaggaactaaagtatttcactaaatctaagaaacagtcactgtgctggagaagtagatagaacgcattttttttgaaaatctgaacaaagaagttaaaacacagttgtctaatagagtttaatattttttaaagcattttggcagtcagtgagctcattttcagatgctgttaaaaggaaaattgatacttataatcaggagatgtatggttctgcaactatttttcaaacactgaagcaagtgtccgcttttgtgttgctgttattcatagatttgaatttaaacatcatattattcaggagactttctctaacttgctagactaggttaagttgctgtgtgctttcatagtactctgtatttctgctgtcacagtatgaattatactttgttgtaattactttttcttttttttttttttttttttgcctgtctttctctggtagactataagctttttaaagaaatggcattaccttcatctctgttgtatttacagcactgagcacattgtaagtaaacagtgaaaccatattgaatgaaaatgaataaatgtcaataaatctttttgggctatagcaaacaattgagcataattgttactctgataagttttagtagcaaatggaagcttttatttcttcatctttgtgaactggaataaactcagaatgcatgttgctttctgccttttgtggaattgcccttttttccctttacctgttacatagctactgaaactgcattctcttgtgaaattgggagtgttttttctttagcagcagcagtggaagataggcaagaggaaagcaatggaaccatgctgatggaaacaggagctagcacattttcttgcttctatttaaatttaaactaggatcagcaatcaaaaattgaccctttttcacagatactattatcaagaatggtaggtgataagaaaaactgaaagtaataagctagggaatattgcttcattttgtttcattttgtaaccatctagccagtgatattttaaaaatccctctcctgtatttgaaaagttattgttttagctcttctattttacctttcaaccttaatatatatatttaggtctttgttttatattgcttcacctgtgaacagtttccctgttcttaccattatgttacaggaagatactggtgtttcttaccctttcctctatcacttttccgctctttctaccatctgcctttgatgagctgaacctttacgatataaatatggtcaaggttgacaatagttatcttcttttctattaccagatttcagtcttttttgtattttgtttataagctgattctagaagttggaaaatagtaaactgagtttatttattgactgtataaatattcactgcagagctaggattgcatttctttacgtatctgatgtcatggcctttctgccactgagggaaattgtttctaatgtccagatgaaatacattgttttttactttgtccccaatcagttgttcaaatcagctcataattatgttatgataatgacttatttaaatgtttttttctagaatttctcactaccctttttcatgttgagacaagaaccatgtttccttacatcattaatattatttaatgccttagttattctactcattcattaatttttttttgttgtaggttttgtttgtttgttttgaggcagggtctcgctctgctggagtgcagtggcgcgaccttggctcacttcagcatctacctcccaggcccaagtgatcctcacacctcagccttagagtagctgggactacacataacactacacctgactaattttctgatttttttatagagacaaggtcctcctatgttgcccaggcttgtcttgaactcctaggctcagaccatcctcccacctcagcctcccagagtactgagattataggcatgagccactgtgctcagccagttctttttcttgaagaaatatttcttgggctaaaaaacttcttgtactaatttaggtcattcactttctagactattctagaaagctgtcattctggatttctcttcattagatccctgcattaattcagttatttcatttctctcatgttaaacagtcaacaaatacttaatgaaccacctgttttgttccaggcactgttttagaccttggggatacaccagtgaatgtgatcgataaatgtgggcctttctattggttttttaagctcattttgttacagcttaccctcaagtaactgctgaaaaagaaggcacaggaactaaattttcaaagggtccttgcattctcgaaaatatttttattctactgtttattatatagttgatattttgactggatataaatttctaggtttaaaatagttttccctgaaaactttgaaggcatttctcattgttagcattccagtactgatacagtctgccattctcgtgttaattcttttgtaggtaacagattttcttttcctttctgaaatttttccttgttctgatcaaccttcgtgatgctctgtgtgtgtgtgtttccttcattgcactggacactcaacctgttaacctaaaaactagcactcaaagtctggtaatttttttctgccactttctctattttttaatggtctctctttctggagcacttcttagtcagagactgattttttatcatcttttctcttattttctattacttgtttttcttccatgttctgtgagatttcttttattctccaaccctactattgaagttattttgacaatcacgtacgtaatatccaagaactttttattatttgttgattgttgctgtatatttatatgtgtgtgtgtgtttgtgtgtgtgtgtgtgtatactcttgttttatggctgtatcatttcccagatttttccaggaatgctagatagcttttgcttttccccctcaaggtctttttgtgtggtaaaaatctatataagatgaactttctttttttttttttttttttttggtggtggttgttgttttgagacagagtctcgctctgtcacacacgctggagtacagtggtgcaatctcagctcactgcaagctccgcctcccaggttcacaccattctcctgcctcagcctcccgagtagctgggactacaggcacccgccaccacgcccaactaacttttttatattttttcgtagagacggggttttaccgtgttagccaggatggtctcaacctcctgaccttgtgatccgcccacctcggcctcccaaagtgctgggattacaggcatgagccaccacacctggccgaactttactattttttaaaaaacaactttattgagataaaattctcataacatacagtttaccaacttaaagtgtacagaggctggtgcattggctcacacctgtattcccagcatgggaggccaagtaggcagatcgctttagcccaaaagtttgagaccagccggggcaacgtggcaaaaccctgtctctaaaagtacaaaattacccagcatggtggtgagtgcctgtagtcccagctactcaggctgctgaggtgggaggatcacttgagcccaggaagtcaaggcagcagtgagcagtgatcatgccactgcactccagcctgggcgaaagagcaagaccctgtctcaacaaaaaagacaaatgattatcaatgcttatattacagtctccctttataaaaaaaaagtttttttcttctgacagtctcgttcagtcatccaagctggggcgcagtagtgcaataatagctcactgcagattctcctgcctcagcctcccaaagtgctaagattataggagtgagccactgtgcctggcctataaaaattttttataatgtaatttttagtatcctgaaatgaaatttaaataatataacctacctacatacataattattttttaaatatcacaactatatagagaaaattgatttgtagtatatcagaaagtaaatattacgggtatgtctgttctaaaagatgagttgttgagatactcgttcctttgtataaaatgatcattaatgtgactgatacaagtatgtttattgatgattcaagtaacactaactgcatttttcgtcagtgacatgatttttcaaaattgtaaagattattggtaaataggaacagttccaacagacctaatcatttttgtttgtttaattaaagttgtactagctcctagtttaacttgtaaaaagcattatatgtatgtgaccagtaatcagcaagaaataaggaaaagcgaatgacaaaaaagaaaaacttgcatgtgtagctgggagatcagcatcaatatcagatgcctgttagccttgtttaacccttctcttagctgtgagtttaagccagacttaaaagccaagcatgagtggaagagctgggggcccagctatacaggtaggaaagctaagcatgtaatgagtgctgatgatgaaacttattgcaagccatggatggctccataggttcaaggcataccatacttcttacaccccagagtgagtggtagggcaagtgtgtatattttaagtactcaggcattagattttcactgttaacaaaatggctcaatataaggataagacatgaaaagaacataggtaggagaagatgagagtgccttattctaaagcaagcttgtctaacccacgacctgcgggctgcatgtggcccaggacagctttgaatgcagcccaacacaaatttgtaaactttcttaaaacattatgaaatttgtttgacttttattttttaagctcatcagctatcattagtgttagtgtatgtgggcccaagacagttcttccagggaagccaaaagattggacaccccgttctaaagctttaaggatcaatctgtgaagagaagcttctgagcagattcccgggccccgtccctgcagattctaattcagttgatcatgggtagacttacaaatctttttcctctctttctccctccctcccttttaaatctgcttaggtggttttgagaaatagccaggtttagggaccactgatctaactatctattcaacatgtgtttaaaattaccttcctaatttctgagtgatcgtcttttctgtgcttaaacatgtccagtgacaaatgaaatcactcccttcttaggtaacacattccatccttaaatactgtaattggaaagttttctttatactaggtttatatctgtagaattgctgcccattggtcctagttttagtcctttagatcataaatctctttcacatgattaacttttcagatatttagacagctgtcagccctcagtacccttctgacttttttttttctcctgctgattttcctctttgctttactctactgaagttatactggcctccttgacatttctttaatagtccaggcacttttcaactgtaggaattttgtactctatcctcattcacctgtaacagtctcttgcaggtattcttaaaactcactccctctcatcatttacatctcctcgcaaatgttaacttcacagtgaagtttttcttcaatagcctatttaaaattgcaccaagttccccaacctaactggatcttctatctccctctgtgatttgtttcctcccaaagcacgtatcaccttgtttttttttcctttttctttttttgagacagagtctcactcactctgtcgcccaagctggagtgcagtggcataatcttggctcactgcaacctccacctctcgggttcaagtgatccccccgagctcacacacatacacaccccctcctctccaccccccctacctcaacctccctagtagctgggactacaggtgtgtgccaccatgtccagctaatttttctgatatttttcgtacggacagggtttcaccatgttggccaggctggtctcgaactcctggcctcaagtgatccacgtgcctcagcctcccaaagtactggagttacaggcatgagccaccgcacccagccccaaagtacataccaccttctaatacgctatacaacttactttactttcccttttttttgtctattttttattgtgtctcttctaccagattccaagtcaaacaattgtactgatctttctcatctttataatttcagccaaaagaacagacatttattcagagtaggagatcaacaaacataattaagttctccttctttccaatttccccttcttcagaagcagtcattttcaattcttcatattgttttgctgtttacttcaaaaatctctttttaaaaatgtttatgagctatctataaatttttcttgacttaggtgtttttttttcttttttctgctttctacatagacgccattcccatttccctcttcctcctatgtagtgtataataattttggttagatcactattgagtttttattttatgattatgtaaatgcagttcaaagctgaaacatattgtaaactgtaatttttcttcctatgcaaatttctgttgtccatagtgtttatgatggacctttttttcatatgcttagtgttcttaccaaccactagttcaaccacaacgttctatcatttatctaaatgtatcaaggtgtttagatgggttgtatcttctgtcatttcaccttttcaaacagatctgtctcagaggctctgatctgcttcaatttggactctgtcctctttacctgctacgtagtggtcatcagaggttccttttactgctttcctttttcatatatctaggacttcttttctattttttcttattttggtagaatgcctcctccagtagatttctgagacggagtgtatgagacctaaaaaaagtttattttagaaaatcacacatatataaaagtagacatagtagtataaccaattccgttgtacccatcacttggtttcagcagttaattgtggccattcttgtttcactttatttcgattagtccctctcactaccattttgagaccttgtctcaaaaaaagagtaccattgtcatgcttaaaaaaaattaatgataggaagcaaaatttttgagatttttacatgtctgaaaatttttgttgaaataatagttggagaatataggtttaggttggaaataattctctttcagaattccaagtcacttcttttagcttctaatgttgctgttgaaatcccacactattctgagttttcttttttcccccacaatccccaccaaaacagtgctgttagtctttgtttgtttttgagatgggatctcatgttgaccaggcttgtctagaactcctggcctcaagcgatcctcccatctctattctgattttttatcttttctgtgtactctttaaaaagaaaaaaatttcttctgaacgcttatgggctcttatctttgcagcatccagaaattccataatgatgagttcttttgtatagatctgttaacatccattgtgctggagacttaggttttttttttttttttcttttcagtcctttaagtagtgggccatgttcttgattttcttcactattccccacactgcctcaaatcccctcctgcgtttccttgcttttcctggaactcctattctttatatgatagaccttctagaataattgcccagttttatctaaattttctctttactttttgagtagattttcttagctttactttcttaccttctatttgtagttctttcttaatatttttaatttttaatttttattttattttattttattttattttggtttttgtttaaatagtgacaggatctgactatgttgcctgtgctggtcttcatctggcctcaagcaattaattcttttttgcttcagcccccaaaaatgctgggattacaggcatgggctgccacacctggatactatttttaatttctaaagtctcttttttgttctcagaatatttccttttatggcaatcccattctcattttatagttttcacatcatttcttacctctagaatatagtatgtcctcacttaacattgtagataggttcttggaaactatgactttaaaagaaatgacctacagcagccttcaaataacatcctttcctttgacatcatttctttttaacagtgagggggaaaaattagcttgcttatacatcatttgacttaaagtcacagtttccaagaacctatcaatgatgttaagtgaaggcttactgtattcttcataatttgatgattgtgactgtgatagcattggcattttttctttttctttctgtatagcttattatttcttccagattttttatttctttttttaatgttttgtttgctatggtttcttataatttataagcatttctcagatgccttttgatacttggttatttgttatatttaagagatgagaataaagtaattggaagctctgagtgcatgggtagagctgtagactgtgagcttctctgttagaatgatctggctggtctgtttcctcgaagatgccctaatgtcagtacctttaggtctttcctgtcaggttggtcagatttcctaaagaagactccttaattctattttctagaatgtgtaatagggctgactcccagtgttcttggagccaagtagatgacgagggcctaggctggaatctgagaatttggtgtgtatatatattcatttcattattgtactcctactcctaactgagcctcatggctcccagaccagacactctctgttttagattgtctaagcattaaacctccagtctgctgctgggatgtcaaaggggtaatcacttgactgctcagaatataggagagaatgttcgtataataatttcttaaaacgtgcttttaatcagtcactcccagaaccaattgttgagccttttgggaattttacagtgtgaatcaggttggttctaggtcagtactgtctaatagcattttctgtgatcgtggaaattgttctaaatctgcactgttcaatatggtagcaagtagacatgtggctgctgagcacttgtctgcaactgagaagctcagtttttatttttattttatttatttaaattgaaatagccacatgtgtctgtgtctaccatcctggacaatgcaattctcagcttttcctatcattggcttatgatttagcattctcaggtcactttctatttgcccaccagctgccttgctttcgtttttttgttttgttttctcttccattcttcttgtcctcatgtgtttgtatctttaaaatatagatatatctttactgtaattttatgagattctagaaaggagcagaaatagttgcaagtgttgactttaccatctttagttaagtggtgttctttatacagtgtgattttaaggcttctgatctaattcctgtcttcagactgcattccacttaaatcatgatgcctagctgtttgttcattcattctagaaattccgattctattaatgctacatatgacttcctatcttttgattttacatctatatcaacattgtttcatatgagttttacttttgtataaaatgtctgggttctggccaggcacggtaactcatgcctgtaatcccagtactttgggaggccagggtgggaggatcacttgagctcaggagtttgagaccagcctgggcaacatagtgagaccccatctcattaaaaaaaaaaaaaaaaagtctatgttcttttattttgctttgctttagttgtatacttttcatgttttatctctaacttattttaaaattcgtggcatatgctaccatgctgtgacttccacagacacttaaatacttactatcttttttttttttttttttttttggagagagagagtcttactctgtcacccaggctggagtgcaatggcactatctcagcttactgtaatccctgcctcctgggttcaagcatttatcctgcctcagcctcccgagtagctgggattacaagcatgagccaccacatccagctaatttttgtttttagtagagatgaggttttgccacattggccaggctggtctcttaacacctgacctcaggtgatctgaccacctcggcctcccaaagtactgggattacaggcgtaagccaccatgctctgccaacacttaaatacttattatattattggcttagttattgacttgaaattattatctttgggccaggtgcagcggctcacgcctgtaatcccagcactttgggaggcggaagcaagcggatcacgaggttgggagatcgagaccatcctggctaactcagtgaaaccccatctctatgaaaaatacaaaaaattagccaggagaggtggcgggcaccggtagtcccagctactcgggagactgaggcaggagaatggtgtgaacccaggaggcggagcttgcagtgagctgagattgcgccactgcactccagcctgggtgacagagcaggactccgtctcaaaaaaaaaaaaaaaacaattatcttcgaatttatttcctgaattcttaacgtggggtatgtgtctcctttttaactgtatttttttctgattaggtaaataatgaaattggaaaatgtttcaaaaatatggaaaatgaagaagagaaaatctcccataatactgtcacctacaagataactattattaacattttggaatataactcttcctcacctgcttgtgtgatatgtgtttttctcttcaacagtcacaaataattagtaaaagctatttcgtatttttttttttttttttttgagacggagtctcgctttgtcacccaggctggagtgcagtggtgcaatctcagctcactgcaagctccgcctcccaggctcacgccattctcctgcctcagcctcccgagtagctgggactacaggtgcccgccaccacgcacagctaattttttgtatttttagtagagacaggggtttcactgtgatagccagggttgtctcgatctcctgaccttgtgttccgcccgcctcggcctcccaaagtgttgggattacaggcgtgagccactgtgcccagcctgtaattttttttatgtaatacattgtgaatttttactaataatttttttaatgccaaaaggaaaatatgaggtgactttttctcccttgtatttcttgacctttattcaacaatattgacaaaaaaaaattttttttttttttgagtcagagtcttgctctgtcccccaggctggagtgcagtggcatgatctcagctcactgcaacctccacctcccgggttcaagcgattcttctgcctcagcctcccgagtagctgggactacaagcgagcaccaccacagctggctaatttttgtattttttagtagagacggtgtttactgtattggccaggctggtcttgaactcctgacctcatgatcctgtcgccgcagcctcccagagggctaagattacaggcatgagccactgtgccctgccaatgattggcaaataaattttgatgaatttaatttttcatcaaaaatattattgaacactcactatgggtgacatactgtgctgagcaaagcagctgcaaagttgcttcaggtataattctaccccttggtattagactagggttcatattttgaccataacaaattaaaacaaggtcagcttcttcaataaataagttcccttagcatgagtttaaaattggcagatttttatagaattgcaatctgaagaaaatggtggtataacatgatttcagcctatataagaatatgttaaaggtataataacatcattaatctagttgattttcacagtatttgccaagtcagttccttaaatctttataaaagtcttggaattccaaagaaggaaatctcttttagtggatgaaaaataccttgttttgtttcataggttaagagcaggcttatgtgatcgctgtgcagtaactgaagaacatatgcggaaaaaacagcaagagtttgaaaatatccggcagcagaatcttaaacttattacagaacttagtgagtttcctttcttcatttattatttaaagtatgtaatgtattatttttaagacctattagtaaattggttgtaattaaatggatggtttacatatatttttccttatttagtaaaagttcaaatgtccttttttgtactttttgtagatttaatctcatgcttaatttagtaagaaatagggtacaaaaaggttgtgcaaatactgtccacattggtcttaagtcatcagttgtaagacaagaagcaggtggtgttttttttttttggacatgtccatatttgcttctttggttttaatctttatttcatgtaaccttaatacttagtaaagttaaatacaaagcagacaatttattgttctacacttgttttctctcttggtatttatgacatactgttttcataagtatactattttcagtttattctccttacctattgagtgtagagtttttctacattcttagccgccttcttttattcttttaatacttctgttaaccttattctcttataactatttatttcttttggtgaccattacctggatttcccataagcaactcacaatcaatatattcaaaatctaattaattatcttcttttccaaactaattctgtcttttatttttttctgttaattatattgctaccctgtggttattcaagcaagaatattgaatatatgctcattgtttttaaaagaggtaagaaagaatatagctttattctgctcccagaggtaactactgttaatagtctgatacatatctgtccaggtccaggtttttctgtctctgtgccttgttagaccccgcttccctcccttctcttttgaattttaatgttatcataccatactttgtgttctaatgtgttacttcactttagactatgtcttggaagtctttacatgttaatatgtctatagattctgtggtgtatatgggtgaacgtgtgcatacatttatttaggaatgtaagaatattatcaatgagtagaaaattgttacatctcaataaatatgtagttgttccttgtcatctgtagggtattggttccaggaccctgacgcataccaaaatccttggatgctcaagtaccttatataaagtcacatagtattcgcatataacctacccacattctcttgcatactttaaatcatctctagattccttataataccaaatgcagtctctacgcatcacttcatttgtgtgaattaaatgtagtattcggtgtctggcaaattcaagttttgctttttggaactttgtagaatttttttttcccaaatgtttcccatccacagatttagaactcacagatatagaaggccaactgtagttgagatccacagtaatattattgttagtactactggaaataatctccaataatgtctacatatctaatagatttccagcaactttatctaaaatagagccaaaaactccaagcaagcaaaaaagcttatctaggtgttaaagtataagacaacgtttttttaaatggctgcattgtatgccatagtataggtgtcaattttttagctattgtcactttaatggactgctcaactttttgtttgaatgtttgagaatttttattttcttacatcctcttcagatttgggcaaaaatgtattaataatattcaatctggtgggtgaagaatgatacctttttaaaattggcattccctgttactgttccagtcaagtattattttatatgatcgtcttcttgggtgaatggcttatttattctttgcccagtcttaaattgccctatttgctgtttgtatcttttaatttagtgaataactaagagttatttatatattatggaaggattattacactttggtagatatgctgtgcatatattttctactttgccattacctgttgacttcattttataactacttgacaagtggaagttttgtatattttcttaccttgtttaggaaggctttctctatccccaagaatataaaaatacacacacgtaaatttgcatatttaatccatctggaatttttaacatggaatgtgaagtagaaatttaccatctttagaatttgcaggcattcatcctcaagcttactgtctcacagtcaaaagatggcaggtactttttcaggcctcgtaactgcattcatacaagaaggaagaagcagcagcaaaaggctgaaatgagcatgccaggagagtctttaaaaaaaaaaaaaagcttctttgaacacccacccaataacttttgcttcagtctcactagccaggaaccaccccgaccctcccactcactccatcattggaagatgactaaggatttctgaggtctttcattagctttattttgctgtagattgtctaggtaaaaatatttgcaaatagtgacaatttcgtcttttctttcaattatttttacagtttcttttggtgattgtttttctttacatactttattggcctaaggggctttagaatactgcccagaatagcagttgatacataagggaagactagactatattacatttaagtgtgctgtggccttctagtagatacgtgaaattaagttatggatatttctttctgtacctcttttgccaagttttgcttaattgtgaatttataaaactcttagcatctgttcatgtagtaagttttactgatagcttttctagggtgaaccaatgtttaatttcttttttttttttttttttttttgagacggagtctcacactttcacctaggatggagtgcagtggcgtcatctctgctcactgcaacctctgccttccaggttcaagcagttctcctgcctcaacctcccaagtagctgggattacaggcgcccaccaccacgcccagctaattttttgtatttttagtagagaagcggtttcactatgttggccaggctggtcttgaactcctgacctcgtgatccgctcacctcggcctcccaaagtgctgggattaccgttgtgagccaccgtgcctggccccagtgtttaatttctaaaacagacaggcttgatatgttaatgttttaattggggaacatacatttaaatcatcattttgttcattcagtttttctgccagcaaggttctgttacgatccaaagaattagggcaggcgcgttggctcacgcctgtaatcccagcactttgggaagctgaggtgggtggatcacaaggtcaggagttcaagaccagcctggccaagatggtgaaaacccgtctctactaaaaaaaatacaaaaattagccgggcatggtggcaggcatctgtaatcccagctactcggaaggctgaaacagaattgcttgaacccaggaggcagagattgcagtgagccaagattgcgccactgcattccagcctcggcgacagagcgagactccctctcaaaaaaaaaaaaaaaaaaaaaatcaaagaattagctgggatgctttgaatcttgtttatttctttttttttttttttagagatggattcttgctctgtctcctaggctggagtgcagtgatgctatctcggctcactgcaacctctgtctcctgggttcaagcaattctcctgcctcagcctccccagtagctgggattataggcacgtgcgaccacgcccgactaatttttgtatttttagtagagatggggttttgccatgttggccaggctggcctcgaactcctaacctcggttgatccgctttgcatttttaaagttaatatcttaattctcttccgaataatataagaattttaaagcacttaactttgatgatcttctccacttacattctgctcttgcccagtatttcatttctgtatagttttggggttttttagccctacaagctagatatttttttaaaaaattacctttaagtaaaattacctttcaattagcccaagggagaatccttgctttgctgataataaatcttacagggaccctactctaatgactgaaaatgggagggaaagacaccttgctagagagcttttccgtatggatagttggtcttctgagcgtgaaagcgccttttcttgtgtctactataaattacttgggagcactgctctgattttcttgtctcggtatttattaatgactcctacgtcaaaacttttagagatctatcctcatgactttagcctaagggcaactattaggcaccttttatttacccgtttagcaatttgtgggccatgttgcctctgatactagaattggtatgagattcttctaagaatactcccttttttaaaggccctttttcattggattttaccatcaatctgagcctatttttaaataattcagaaattttttatagttctgatctgttagtgacaccctttctggctttttaatactgcagtagacttattttagagtgttgtcattttatttggatttggagagggaaaatcaagtaaaccatcttaatcagaaatctaaggtcatctttgacttctgtgaaccctacaaaggatgagttgccaaatactatgattctgcctctgttacagttcttctactggtctttacttcctgtttatccacctctacataggtccagatattcatttcttttaatgaccacctgactttttgtcttgtcaatactttcttctcacattggtatatgctatatgtactaacaaatcagtcttcccatcattcatctataaaaaatgattcctggtaatctataagataaagttttaatttcttaacctgctattgaaaactttctaccgtttattatacccagtctttgttccactgattctctctgtagaataatctcctgtccagctcagttgccctttttttgatgaatgccttcctgatcttctcaagggcccaaagtaacctctttctccttggaaatttccttagtactttatttgtacttctcgattgcccttgtcacttttaaacctataaaacatgtttatgtagtatcttgtctcctttgttagactgcacattgctttaggtcactgtctatatcttaatttttttggatcctccacgaaagtagtttaataacctcacatgttgtagatagtccagaaaatttactcagtgtaagaaaatatgtttagatttataaaccactaaattattaacaaattttagagtacaattaaccttctttggtgaaagttgattgtatttactgtgacctgatttctgggatccacttcttttgctaaaacacatgcttaaccagtgacatcatactaagcattgatgagagttttatgctggttccagtagaagttacagcccaaaactggatttctgctttacaaattaaataaatacagataggaaaatttggtggagattcaaacaaacagatactcttcaatggatatatttaagttactgataaccataattattcatgaaacctagagtatgactaagaagaaaatttgatttgataaatgtgcttgttataaaaattacactgatattcagcgtttttggtgtttttttgttttgttttgttttgtttttgagactctccgccacccaggctagagtgcagtggcactattttggctcactacaacctcagcgtcctaggttcaaatgattctcctgcctccacctcgaatagctgggattacaggcatgcgccaccatgtccggctgatttttgtgtttttagtggagacggggtttcaccatggtggccaggctggtctcgaactcctcacctcaaatgatccacccacctccgcctctgagtgctgggattacagctgtgagccactgcgcctggcctattttatttttatgatcaaattaatttcaagatagagactcttgctaaaatggtatttgaaattagtaggactgagtaaccagatggaatgctttcttgtcctcagtatgtataattatactccctagtacatgaagtaccctcttttgcctgcaagcattacataaaattatcagttaatcagttacatggaactggcacggtgtgagatgtagtactccctacctagtaacgaattagttttgcgcacactagtgttaaccctgaataaacattatgatttaggattagaagtactaatttcttcatacatgctgacatattttatttgaaagcctaacatagatgttaatataaatatattatttgccttctttttcacattgtttttaagtgaatgaaaggaatactctacaggaagaaaataaaaagctttctgaacaactccagcagaaaattgagtaagtattttcctccaaccttgttattttattttatttagctatacaaaccatgaagataactgtaagagttgcagatttcattttaaaaattatgaagtgttctgtagttaaaaaatacaaagaaaatcactacatttttgtgttttgagagtatagtgtgaatgcatctcttagattagtgcttgaagaaagtgtcaacattgtaattaaaacattttaatttttataatgatttattataaataatacattattaaaatacttatatttcaaacagatgtttgagttttgttagctcccttccagccctgtcccagaagcttcataagggcaaactgaataagtgtttcctcttatatagtactcaggcctgtagaacttcttccttcctctgtttttctcccttttctccccatttctcttaaagaataaaaccagtaacttttatcttgtgtgccacttcctcttgtgttttatgtttattatttctaattctcactgtgactttgcaaagtagttttattatccccactttacaaatggggaaaccaaaggtcacagtcaaataacttgcctgtcgtcttacagctggtaggtaataggactgtcactcagacccatattttttctgaaaagcctcttttctttccattatccaacactgtctcaaaagaagaatatttttctagatatgatctgactaatgcagagcagagcagagatatgactaacttttagttcccatttatataaagcttatatactatttttgaaaacttaggattcaggataatcctaatggcgttatagcgttcctaaagatcctgttgcgtttaagtagacatctacaaaaacttcagtaaaactatgtagatgtaacattattttggcttagaatagttatttttgtatgaacacatctcacaagtagaattatcattcttactggtatacttttaggataatggatatccaatagaattctgatattcctcccatgtgattggtctactgaatactgatagccaaagggaattttgaggagaaataatagtcagatgaggaaaggaacctatgagatcagactgatgttataaaatgtttgtaagaaaatgtcaacactttctaattttaataatgctgtataatgaagagagaacacaggacacagatccacaatctgttacatagaattccaaaacccaaaaggttatttttgaaatgttgttcacaacctaacctcactgcaatggcagaatgctgtttatagtctttatcccacttcatgtgagtattcatatgttttgctgtgaaaatatcaatgtgtttgattacaggatgatgcttcagactccactggagctgttatgtaattatgtatatatgttctgtattactgtattactttcattttttttaaaaaatatgaatttggaatcccgtctggttccaaggattttagataagtgattgttgacctacattaatttatgtgaagtgattatgtatgtacgtagcttatggtattttgaacacatcagccttgatctttatgagtaccaaagggatgagataccaagtgtgtagaagttaacacagaattagatagacgattgcctcaaaaaccaatgtgtataagttaggttgaaactatatcgtgtcatttgcttggtagaaatatgaattctaattagtttagaatttatttttagtgttctcaagcacatgcatttttcctgttgaaattcaaattttagaaaagaagtgaaggctaaagtttgaaattacaggaaagagtaatcatatagatgagcttaaggcatgtatgtttatttaggacatgcttagtcaaaagagtataggagatgatctgattgtgtcttttattctcttctgaaatataagatagttgtgattctcatgaaccaacttcttctgtagcttggtcgcaaagaaattgcattttgctcagcagttttgttttgttttgttttgtttttaaaaaagcaagtatcatcttgtaaaggcaacctaattttctctgatcacctaaaccactgtcatattatgctatttgtgcctgaaatttccctgaactttagaagaaaatattatttgacttctgcttgttaaatgcagtaactctaactcttctgagctagttttgatgttacaagatggcttatatgatagggcagttattagtgacaccaaaattattcagtaaaattttgccactataaagttaaaaatgtgtataaagctaggtattgaggtcatcattcttttcgttttagaaaatagatgtgatgggtcagtgaaagtcaagggagtctatacacgtaagagttcaaaggactgtagaactcattgcattcaaccctcttctaaattgaattccttatacagcttctttaacaaatagctattgtttgaacacgtctagtagaagtttactgtttcccaagcctatttaaatttagtgagacaaaattattagaaaattctaagtttatagaaattacactgcttataagttatatttcttgattatgactgccttccaggaccatcttaagcaagtctcttctcctgtgctacttgacgactcttttgatacatgaagacagctatcatggccctcctgagtcttgttttctctagagtaaatatcctctgttcattaactgtggcattaaatatcctctgttcattcatgtggcattacttcaactcttcaaactgtgaatttttaaaaatgttttagttcgtcaatatctgaattaagaaatcaatattctaggtatagcctgatcagtggagcagtactgccacctcccctacaatggctataatgttacttcgttaagtttaaattatgttttaactggaaatgtaagttcttcagagtagaaaaggaaaaaagctgaatatttaaaacttttttacagactcatgaagggaaaccccagatccataattataggtctttagggaagaaaccaactaaaacagttttgacaggagtttaagagggagcagaggtccataaatcaaacagctcaagccatcagaaggaaaagtgaaaggaggacaagtgtgcataattaatttaaccaaaagctgtgacgtgaactctttctctcagaaaatcagtgagactagtgttttaaaggatgaacttggttaacatatggagttttgttttttccttttatgacaaaggaagacaaagccagcactcatttacttagtttgggcacctctagttagagctagttttgtttgtttttttgttttttccttttgtgatcccagcttcttccacattgactctgccaggaaatcaattgcttctcgtgactcattcatgtttcaggtggaatttttatgactaataggcaagcaggctgtgacgtgattagttaaagctaggtcagatagatttcacactccattaatttataagcctttctcatatgactttaacttactgtttttccagaataagaaaattacaggaagagattaaaaaattagatatcagatctattgcacagaatggtgacttaataatgattgtatatttcagaactgccaagtagattttaaatgtttttactacaaaaaaaagataagtgtgtgaagtgatagatgttaattagcttgatttaatcattctacactgtaaacatgtatcaaaacattttgttgaacccagtaagtagatacaattattatttgtcaattaaaaataaaatttggctgggcacagtggctcatgcctgtagtctcagcactttgggaggccaaggtgggcagatcacttgaggtgaggagtttgagacagcctgggcaacatggtaaaaccctgtctccattaaaaatacaaaaactagccaggtatggttgcacgcgcagctgtagtcccagctactcgggaggctgagacacaagaatcacttgaacctggcagaggttgcagtgcgctgagatcgcaccactgcactccagcctgggcaacagaaggagactccgtctcaaaaacataaaataaaattttaaataattttatgtttattttattttatgtttatgtttattttatttaaaatttaaaaaattttaaataattagacattagctctaaagattgttccttggtataaaatgtaggattaaagcctacaaataatattggtatcattcaggaaattaaagtgtaaatcttttttgggaaaaattagtctttgtcttccaattaatgtttcttaaaaatctctgttggtcatagttcatacagttctcactatataagcttttatttggaaatagtattgcaagttgatacgagtctaataggacagactgatttggtcatgtaaagcctaaatgtctgacagactggtaacaattggttggcaaataaggtcagtaatggtttgacatgggaaagtcaattaactttatttttactcaacattcacaattcaattcaaacccaatctttcagttacagttgatcctgaattgagttgggcaagaacatatgcctagatccacacaaatttattctctagtggaatctgggaatgtctcctattcactcaacaaatgtttacgccatacctactgtatgtctactgtggtaggctcttgtgattcatcggttaaccaaagatcccatcctcttagaacttatattctaacaggtgagcaatagatacaataaataaattgcagctgggcgccgtggttcacgcctataatctcagcactttgggaggccgagacgggtggatcacttgaggtcaggagtttgggaccagcctggccaacgtggtgaaaccctgtctctactaaaaatacaaaaattagccaggcatggtgttgcacgcttgtaatcccacctactcaggaggctgaggcactagaatcactacaacccaggaggcagaggttgtagtgagccgagattggaccactgcactccagcctgggcaaaagagcaagactcagactcaaaaaaaaatctaaataaataaaaatgagtaaattgcatactatgttaaaaagcagtaaatgctgtggataaagtttatagagcagaataacagggaacaggagtactagggtgtgtgaagggaggttgcaattttaaacggtaaaattccagcagacttgaaggagattagagagataattaggtatgtaggtatctggggatgagcattccaagcaggtggaacaattggtgcaaagaacctaaggtgggagtatgcttggtgtgtttggggaacctcaaggaagagagtgtggcaggagtagagtataataggaaaaaaggtcagagaggaaaaatgggaggggcaccatcaggtcatgtaggatcttcatggatcaaaggactttggcttgtgttctcagtgaaatgagcagatgtgacagggttttcatgagatttcatccatatgacttaagtctttttggggtttttttttttttttttggagacagggtctcactgtgttgccgaggctggagtggagtggcatgatcatagctcactgcagcctcgacttcctgggctcaggcaaccctcccacctcaccctcccaagtagctgagactacaggtgtgtgccaccacgcctggcaaattttttaatatatttgtacgtagcaatagggttttgcctgggcctcccaaagtgctggaattgtaggtgtgagccacttatgtctttttttttttttttttttttttttgagacggagtctcgctctgttgcccaggctggagtgcagtggcacgatctcagctcactgcaagctccgactctgggttcacgccattctcctgcctcagtctcccgggagctgggactacaggcacctgccaccacacccagctaattttttgtatttttagtagagacagggtttcaccgtgttagccaggatggtctcgatctcctgaccttgtgatctgcccgtctcagcctcccaaagtgctgggattacacgtgtgagccaccgcgcccggccccaatttatctcttaataggactcttgtgactgttgttgagagtagactataagggggcctagataaaagcagtaacagaaactcaaattttgaagccttcttgtagactatggataacacatttggttaacaatgtgttattgttagggtctgactgctgagatttaaatcctgactctgttactattttagtaaatgacttctgtatcttcatttcctcatttgtaaaatgaaagtagtaatacctcacagagttgtgataattaaactcataatttaaatagtgccgggcagtgtaaacacataacaaaaattggttgttatcattgttagtgttctcatcctgtatttgtcaagcatgctaattctactaccatgatgtttaacgttctttcctttccatatgtacttaaaatattctagttcagaccgcagacagagcggcttgcctggactattatagccactaattgatttccttgcctcctgtccttctgtcccaatcttgcacaatactgttagattgtcacattatatccaagctctaaaaccttaatttctttcctcttgctttctacattatgtgcacattgagctcatggctctcgttcatgtaattccagctttcccttctccaacataagtacacagtactgcatgcctttcctcagactgtgggttctctcctgatcttgtctgcaatttgaaatacttttaatttcacctgaagtgctattgactatactttctacttcacttctcacatagtatttcccactgggtactgtaatcattcgtgtacttatctacttaggtttggaacattagatgcaagggattacatcccttagagcttcatgtttgtgttctactgtaactccatgccatgtagtaaatgttttaatactcattgaattgattttctttccattgtcattcttctctaggaatgatcaacagcatcaagcagctgagcttgaatgtgaggaagacgttattccagattcaccgataacagccttctcattttctggcgttaaccggctacgaagaaaggagaacccccatgtccgatacatagaacaaacacatactaaattggagcactctgtgtgtgcaaatggtaagagttggagttgtattttagttctctggttttgtaaaccagtgttcatctactagtttttatgttattcaatctagtgataagaagatagtcactattctggtatcccatggtacaactatgagtttaacttctatttgtaaagtgactgagaaggcgttttctgcccgtgttatgtatagatacgtgtcatctatatgacatgtaaatataccatattttataaatgtagtaaatagtttcttttttctttttattttaaaaatattcctatgtgtatatatccaagtgggatagaaggaaaaaggaaaggaacttaatgttaatttctacctcctgtgtaccaggtattatgctgagtgatttgcatgtattattgctatgttttaattctcgtaacaggcttgtgagataactatcagctcttttgttttatagatgaggaaagatatgtttagaaaggttaactcactcaaggtcagctattatgtagatgagtcaaaattcaaatacagatcttcttagctctgaactttcctactctccaggtcttgccacatgggtactcctgccattggagctgtctgtaactggctatttttatttgttgtaatttgtaggagttagtggtaatcaagaaatggtgttataatatgtacactttgtggcttttcagtgacatgtttctaattccagcctagtttatcatttctgctaaatgctttaaaactgtcttttcacatagtcccaaaatttgttatgtgccatgatacaagtattacttttagtattaatctaaagcaaacagtaaagactttaatttttaacctaaactatttgcaacaaggaaagcatgggggacgggggatatatatgtactactatatttgtataatacaaataaattgttgacagtaaatatgcctttaaacaaataagcagatcttattcttagatgttggaacattgacagttttcccccactttataagcgtttgtatcaccatctagtggaaaacaaaagaactgttaaaaatcctacacttaaataggagctaagttaaaatgtaaaatcatagatctaaaatgaatatccgttgaccttttagtttgctatcagacaggacatgaatcattaaagataatcactgcataatttacatcaggtttaaattcacaaataagaatatctagaaaacaattccatattaggaaagtcttttgtaaccaatataaatgcttctggtttatttcttctttgtatgaaagcagcatgtaactatttagaaatttaattcacttgctttaaccttgttctgatcattttttacttggaatctgaaatttggttttaagatgtacgataaccttgagccatacaaatgattttaaaataattttaaggccgggcacggtggctcacacctgtaatcccagcactttgggaggccaaggtgggtggatcacgaggtcaggagatcgagaccatcctggctaacatggtgaaaccctgtatgtactaaaaatataaaaaattagctgggcgtggtggcacacgcgtgcagtcccagctactcgagaggctgaagcaggagacttgcttgaaccctggaggtggaggttgcagtgagctgagatcatgccactgcactccagcctgggcaacagagcaagactccatctcaaaaataataataataataataattttaaatgctttaatgactaattagtcctgttctctaacttcccttgcttgcttattttaaggtttataatgctttttaatattactctcaagttataaatagtaaaaccatttcactttaccttgtccttattttggttttctttgaactaaatctttaaatattggagtgatttctgataaagcatgcttcagagtttccttcccgaaaatagaaactctaaaacaaagatcatggagataaatgatatagtatacattagattgattgatcatttgtttattgattgattatttgagatagggtctcactctgtcatccagggtggagtactgtggtgtgatctgtagcttactacagcctggaacttttaggctcaagagatcctcctgcctcagcctcccaaggtgctcagattacagtcatgagccactgtgcccagcccagtatacctttttaaattaacctgctgatttgtaacaaatataaaaagagaagtaacactaaaatgttactactctaggcaatttgggttagaagaagctgtctgttctagtcccctctctcccaatgtcttaacttaaacagctttgtttcttagtgaaattaaaggagcttacttcttagaatatgataattatgtcaataaaacagtacttatattggatttaaatacagataatacataaaaattttaaatatgaataaataaaaataatttgataatgcttttcatcatcattgtttattgtgtaatctcttatttttttctccccttagaaatgagaaaagtttccaagtcttcaactcatccacaacataatcctaatgaaaatgaaattctagtagctgacacttatgaccaaagtcaatctccaatggccagtaagcaagatactgagattactttacaagtttaaaattgtggttattggtgggtaacagtgacccacagtctaacttagacaatattttaaaggtattttccatataattttgtttatattactagtttactatctttttcatattggaaagtaatgttatcctattcatataaatatccctaatcatattaatataaattactaataattttaagtaaagaaggctttactgtgatttacttatttgttcaacaaatattgaagcatctgttgtataccaggcactgaataaaacaaagcccttgtcctcatggagcttatgatctagttgagggagaaataaaatttatgtcagatagaagcaagtgctctgaagaaaagtaaagcagggtaagaagggatattagaaagcctcacttgtaaagtgatgtttgcatagggactgagggagggaagtgagtcacgtggctatctgggagaagggcacccaggcagagaaattagcaagcccggaggctttgcagtgaagatgccatttggtttgtttgaggaacattaaggaaccctgtgtggctggagcagagtgagtaaaggggagattggtttggacaacaggaaaaatagagttaccatttactgagatggaagactgggagccgcaggtgtataggttggggcgggggtggttaaaattagaagtttggtttcggtaatattctgtttgaaatgcaaactcaacattcaggtagagtttggattcatgagtagatgtgagttagaatttagagaagttgaggatggagacacatatggaggtcatcagcaggtagatggcatctaagccatgaaactagatgagattaccaagcaagtgataatagatggggataagaagaagtccaagtattgagccttggggaacttcattatgtaaagtcatgattttcaacttttcttttgttgaacaacccccaccccagcatttttagacatttcccccctccccccagtcccttccctgctggaattttattactgcagatctactgtatatctgtttaggtgatacgtgtatgcatgtatgtctgtgctttatacatagtaaggttttttttgctcccccctgccccgaaccatttttcacccccttagagaaaatactgtagctgttgaggttgcgaaaatgagtaggaaccaacaaaacagagaaggagctgccaatgagataggaaaactaaaaatgatgtcctttaagccaagtggagagaggacgaagaggtgatcaactgtgtttaacaatgctaataagtcaagtaagatgaagacttcttagaattgaccatgagatttggttgcatgtagatcattgagtgttaaactagtaacatgataaaaattgttaaggtgtaatggtgaccatctgagatcggtctcatgttcaaaggaaactaaggacagagaaagtggaaagagcacacacaaacaagtactcccaagacattttgcagtaaagaggaggagagaacaggacagtggctaaagaagaacatgggtcaagggaggattttttttcaagatggaatattatagcatgatcggcatttatttatgttgataggatgatcaagtaaataggagaaaattaataattctggagaaagagggaacaattgctacatccttaaaaaggtcagaggagatgagatccagagcccagttgggagggttggtcaaggttaatcacttattcattttataatagtgtaaaagttacatactgaaagctacaaatcattttatattaacatgtgtgtctgtttgtctgtccatgagtatgtgtgcatgtgcatggaggctcagggtccagcaaagggtgctagggatacaacacagagggtggcagatccttgcttctcagctctctagaaccaattctgttctgctgctgccaggtctttgctccattatttgtcctatcttccttatacagtatctgcagcttctctgctggcttattcttaagtatatacacatatatgttatcttccatctttaaaaaataatcccccttttaataatctccacctttagctacagcttctcttcagaggtgaaaaagtattaatagtctatactcaatatctctactttactaattcccattcactccaactcactgtaatatggattctattccccaacccccacctgcaagagaggaggagagagcaagagagagggaagggggagggaaggaggaagggaggagagagaaaagtgctagaggagtggggtacaggggaaggtagggagggagacttacagggattgaagagaggagaatgcattcacaaaccctttcttactccttacactggaactgattctgactgtaaacgtcgtcagtgttgctcttctccaaaatatatggtactgtgcctgttctatttctgtctctctatttatttatttattttttgagacggggtctgtccctgtcacccaggctggagtgcagtggcacaaacacagctcactgcagcctcaacctcccaggctcaagtgatcctcccacctcagcccctcaagaagctgagactacaggcacacaccaccatgtctggctgatatttgtatttttgtagaacagtgtttcaccatgttgccaaggctggtcttgctctcctagtctcaagcaggctccacctgcttcagcctgccaaagtgttgggattacaggcgtgaaccactgtacccggcttcactttctctctcttcctggaggaatgtcacctgcagtcagtagtcttctctgactcatacactaataaatcccaaacctgtatctctgtccgacttttttcctggtttcccaaccaatgtatctacctgctgttggatacctctacagggatatccttcaacttcagcatgtctacagttgacagttaacctgtcaaaccaactcttcatccttgcatttgcaatctcagtgaatgacactatacatgcctctttgagtcatcctagatttctgcttcatctgtttttgctaaacagcctctaagtcttactgattccacctcctgcatatctgttttacatattcttctgtgcccctattatactagtttaggctactagcatctctcatcaagacaacatgttctagtaatctaattagtcctcttgcctattagtgattgcttcttgcctaatgagtgtgtcacagccactaataccttttcagcccacacattgcatttgttttatttaaaactcttagatatctcttcattgtctacaggataaatttgaaactccttagcataacctgacccctaaccaacctaactgggttcatgtcctactcccatcttctgtagtttgacttctagcagtcaaaccacgcgtagttccctgaacaagcaattttgtttcactttctagacccttaattatacctagaattctactttctgtccccagtccagttaacttgccatattcttccttctctcgagtcagcttaggcatcacttgtaactttccttgatttcccagaagagatttaggagtccttattctgtgtttaaatcaccccttttatgtacctttattataatgtttatcacattctattgcagttctctttttacctttcaactatataagctccttgagaacaagaactttttcttttcatctactgcttagcacaatacctggaacataataagtgctccataaatatttgagttaacctttataaaatactagaacataggtgatttatgaatatgtgttagcttaacctgaaacatgcagtgctgacaacctctcctacaaagtatgttttcatgaaagagagcgtaaatatagtttgatattcatgctgtaacataagtcacaataattccactgtaaatccattttaagatttttttccccagtggcaataagaaaaattatctacctattgcattcagttcatttaggaaaaacataaaatttacttgaaaaattttagcacgcatagacctgcaacttattgccatttatggtaggtattttggactttttgcacagaattttaaaatgtgtctagtgccatcttatgaagtgtgagccttttccttcatcttttgtcattttaatgtgtctagcttctacagttttgtaaaattggttttattatttattaaaatggtttattatttattcttagaagcacatggaacaagcagctatacccctgataagtcatcttttaatttagctacagttgttgctgaaacacttggacttggtgttcaagaagaatctgtaagtaattgtttagtttggcaataacatgaattaattttatgtctttttaggtcagttcttagagaattaagcaagagaattgttctatctaaagatcttgggtaaaggcctgaaacaaaacttacattgttagaaagtcctatttctgttgtccagcccagcagtctcagaaatgtagaatctagaattcttgggatatgggttgagtcaaaatttaggggagtaattatggcatagagattttgtcaactttcttcccttccccctctctcatgccccctccctgccctcatctaagagaagacctaaaccttcaggttgatttcagaattgttgttttgttttgttttgttttttagagataggatctcattgtgttgcccagggtggagtgcagtggctattcacagacacagtcatggagccctatagcttcaaactcctggcctcaagtgatcctcccatctcagcctcccaaatagctgggactacagacatataccattatgcctagctaattttttttgtagagatgggggtctcaactgtgttgcccaggctgatctcaaacacttggcctcaagagatcctcctgcttcagcctctcaaagtgttgagattacaggtgtgagtcaccacatccagctgtactcttattaagttgtcttgctgttgaatttctaaaaattgaattagtttttcattacatatagatttttttgtcctttctagttttaaattcattcttaaatgataatgggtagtttttaacctttgaactttgaatgtgttttaatagtttctaattcccccctacccataaacctggcaagtcacagcttagacaccaaatagattaagggagctgaaatctaatgacttgctgcttgacgtgtgatccatgggccaatagcatctgcatcagttttgaagtttggtagagatgcagaatctcagacctactgaacttgcattgtaacaaaatctccagttgacttgtatgcatgttaaagattgagaagcactgttctctaaaggattattttaaattcatctcctatcagtatgaatagttatctctattcccttcccctcatcttaatgttgttttttggaattggagttttatatacaaggagtagaatatacttgtgtaaaacattgaggcttttctctttaaacttaaaaagtgcttcatatttttcattgtggtgaaattaacataacataaattaattattttgaagtgtacaactcagtgatatttagtacattcataatattatgcagctatcacttctatccagttccaaagcatttttatcaccttcaaagaaaacctcatacccattaatcatgtatccccattctcctcccctcattcttccacctcccacttgcatcctctggcaacttccaatctgctttctgtccctagagatttacctattctgaatatttcatataaatggaatcatacattatgtggcctttgtctggcttcttagtatatttttgaggttcatctacatcataacatatatcagtacttcatccctttttaagaatgaacaaatcccattacatggatgtgcttcatattttactcttgaaggaaactcaaggtcccatgagcccccttggtgatgagctctaccactgtctggaaggaaatcacaagaaacagccttttgaggaatctacaagaaatactgaagatagtttaaggtaattaagggcacgttggtgaaaactgataagctattggtgagatcccattacaatgaatttcatataattaagccatttctctccttcaacatatagtttgttattgtggttatataaatgtttactttaaaaattgtctccctagtttctgaccaattgagagcttttttgcattacagtagaaaggtggatatcatttttagctactttctgtgtttctgtcaagcagtacttgttcccagtacttgtcactctgctcctttaaagagccagtcatcccttcggggtttatatttcccaaaactggatgttctacaaaatgcatctagaagcttggatgagcttccaagattgtgttgcatctcatttttactaatttcagaatacctattaactaataatacagccattccgtgatatcagtgggggattagttataggaccccctcccccatgggtaccaaaatccaaagatgctcaagtccgttacataaaatggccatcattattgcatataacctgtgcatatcctcctgtatattttatgtaatttccagattatttataatacctaatacaatgcctacatatcaatccatttgcaaagattcaacatagtacttggcacatggaaaattcaagttttgccttttggaatgttgtgaaatttggattttttacccaaattattttctagccacatggctgaatctacagatgcagaacccacagataaggagggccactgtacctgtatttatatagcattttgctttttaaaagagctttcagtttttagatatatagatatctatctatctatatatgtatatcacagtctgtcatcttagtaactgattaaagtagattttgttaccctaatttttgggtttattttacagattacaaaaatacagctccagaaaggttaaatgtcttgtttcaggccacatagctattaagtggtagagccagagatcttacccagcccacatcttcaaacttactgctctttctacgcatatttcctctgctagagacaggctgaatcttaatttatgttcaattctgtagtgtaagaattttgtttcttggagttactcatgatcaaatgtcgtaacaaaagaacttaggttctcagtggaatttattaaaatatgatttttgtttgtttgtttcttgagacagagtctcactctgtcacccaggcttagctcactgcaacctccacctcccaggttcaagtgattctcgtgccttagccaccagagtagctgggattactggcgtgtgccaccacacccggctaatttttgtatttttagtagagatggggtttcaccatgttagccaggctggcctcgaacttctggcctcaagtgatctgcccaccttggcctcccaaagtgctgggattacaggcatgagccactgcgcctggcaaaagatgattttttgtataataaagttatttaaagtacttaggaaaaatttttaaaatatgaatattatggtgttgagaaatacttcctatgtcattttcctctgcttttccccttctcttttgtcatctaaatgaagagaagccaaaagctgtaccttgtcttaaattttggttaatcatttgcttctaagaggtagataagaccttactattaattctgtattaaagaattgttatcactctttatttagattttcagattctacttcaaagactcctcctcaagaagaattacctactcgagtgtcatctcctgtatttggagctacctctagtatcaaaagtggtttagatttgaatacaagtttgtccccttctcttttacagcctgggaaaaaaaaacatctgaaaacactcccttttagcaacacttgtatatctagattagaaaaaactagatcaaaatctgaagatagtgcccttttcacacatcacagtcttgggtctgaagtgaacaagatcattatccagtcatctaataaacagatacttataaataaaaatataagtgaatccctaggtgaacagaataggactgagtacggtaaagattctaacactgataaacatttggagcccctgaaatcattgggaggccgaacatccaaaaggaagaaaactgaggaagaaagtgaacatgaagtaagctgcccccaagcttcttttgataaagaaaatgctttcccttttccaatggataatcagttttccatgaatggagactgtgtgatggataaacctctggatctgtctgatcgattttcagctattcagcgtcaagagaaaagccaaggaagtgagacttctaaaaacaaatttaggcaagtgactctttatgaggctttgaagaccattccaaagggcttttcctcaagccgtaaggcctcagatggcaactgcacgttgcccaaagattccccaggggagccctgttcacaggaatgcatcatccttcagcccttgaataaatgctctccagacaataaaccatcattacaaataaaagaagaaaatgctgtctttaaaattcctctacgtccacgtgaaagtttggagactgagaatgttttagatgacataaaggtttgtgttaaatgttcaaggattttgattaaaatgattgcttgtgatttcatttagagctaacaattatttctgttttagagtgctggttctcatgagccaataaaaatacaaaccaggtcagaccatggaggatgtgaacttgcatcagttcttcagttaaatccatgtagaactggtaaaataaagtctctacaaaacaaccaaggtgtgtacaccataaacaggatctccacttttttaatgacttcagattgaatgtcattatttacttttttaaatagattgaattgttttggaaaaaaacttatttcttccttcaggtgtctgtatttataggacgattctcacattttaccggtgatttttctgttcttttttttttttttttttttttttgagacggagtctcgctctgtcgcccaggctggagtgcagtggcgcgatctcggctcactgcaagctccgcctcccgggttcacaccattctcctgcctcagcctcccgagtagctgggactataggcgcccaccatgcccggctaattttttttttttgtatttttagtagagacggggtttcaccacattagccaggatggtctagatctcctgacatcgtgatccaccagcgtcggcctcccaaagtgctgggattacaggcgtgagtcactgcgcccggccacttatatacgtttttaaactcctttaaaaacattgttggcccggtacggtggctcacacctgtaatcccagcactttgggaggccgacgctggtggatcacgatgtcaggagatcgagaccatcctggctaacgtggtgaaaccccatctctactaaaaacacaaaaaataagccaggcatggtggcaggcgcctgtagtcccagctattcgggaggctgaggcaggagaatggtgtgaacccgggaggtggagcttgcagtgagccgagatcgtgccactgcactgcactccagcctgggtgacagagcaagactccgtctcaaaaaaaaaaaagaaaaaaaaaattgtttgccttaagatatataggcatcttttcataattttgctatattttattattattattattattatttgagacagggtcctactctgtcacccagactggagtgcagtggcatgatcacggctcacttgcagccttgacctcccaggctcaggtggatcctcccatctcagccccctggatagctgggactacaagcatgcaccaccacacccagctgatttttttattttttgaagtgactgggtttcgccttgttgcccaggttggtctcgaactactggactcaagccatctgcctgccttggcctcccaaagtgctgggattacaggtgtgaaccacccacgcccagcctgctatctttaaaaaagtaattttttttttcagccaccaaacatttctgtagttcaagtgcagtattttttcttgtattcttcattggcaagttattcctttattctgggtttattttccctttttcctgaagcacagtcattagttgtttttccagtgagtgttttagtctctatatgaaaacatttttttcactatcattcatgattttttttgagctttttgtttttatttttttcatggttgctctagggattacagtatctacctacttagccttttacaatctacttggagttaatgtactatttcatgttctgtaactacactttatgtagttcctgtgtattttatctacatatattgaaaaccccatcaatgttatagtttttaattttaaaaaattttaattgaaatataaatcacataccataaaaatcacccattaaaatgttcaattcagtggtttggtatacccacagagttgtacaaccatcactgtagtctaggtttacaacattttcatcactttccttccccatataccctctgcagtcctaggcaccttaaatctactttctctctttgtagatttgcctattctgggagttttcatataaatggaatcgtttaatatatgatcttttgttacttctttcacttggcataatgttttcagttatctgtgttacagcatatatcaatattttatttctttttattggataattttttattgcataagtataccatattttaggtatttattagctgacattcaagttgtcacttttttgctattatgaacaatgctgctatgaacatttgtatacaggtttttgtgtggatgtatgttttcatttttcttggattatacctaggagtggaattgttgggccatatgccaattctacattttaccttttgaaagactgcctgttttccaaagcagctacaccatttcacattcccaccagcagtatgtgagggtcccagtatctccacctcctcactagcacttgttatagctttttgatttttgccatctcgtggttttggtttgcatttccttgactgctgatgatgttgagcatcctttcatgtttattggcaatttgtatatcttctttggagaactgtctatttagatcctttgcccatctttaattgggatatttgtctttttattatggagctgtgagagttctttatatatcttagatataagtcctttaccagacatatgatttgcaaaaattttctattctttaggtcccataatattttaaagtgatgagaatttttgaaatcagttttttaattgcatgctctttccctttacctaagatgtatcctttgaaaatatccagtggagtatagatccgggagcagacctttctcagtataaaatggatgttactgtaatagatacaaaggtaagttaaaaagtaaaaccaaaactcatttgacttttattccaatgagttgttagtcaacctcctctcgtgactcactgtatcaccttaagataatcagatacgtcttaaaacctacatgtatttatgcagaaaattaagaaataaaaatgcttattcttctaactttatggtattttttaaagggtaatactttctgactttaaaggcctttactgaaaaatattaatatagtttttaaaagaatgcagtgggcaggcgcagtggctcatgcctgtaatcccaacactctgggaggtcgaagagagagaatcacttgaagccaggaattcgagaccagcctgggcaatatagcaaggccctgtctctataggaaattttaaagttagctgggcatggcagtgcatacctgtagtcctagctacttgggaggctgaggttgggaggataccttgaacccaggaattcgaggctgcagtgaggtatgatcacaccactgcacatccagcctaggcaaccagagcaagaccctgtctcataaattaaaataatgcaaaatgctgcatatcttatataattttatcattcattaaaataattcatcatgtcttcattacctttaaaataatgtaccataaaattcattttccaagttgactatttttaaaagttaaaattcatagtggaaatagttttttgtcttgtatttagcttctgtgtagtttcagaagttctctttcacttggtagcatattaataacaaagtatttaacatacgctgagtaatatatgcctatcaagaaatttaatttaatttttgaaagtgttcttagtgtacattgatgttcattactataaggcaaattggaaaataaaggcaggaaaagttcaggggtgtttagtggtaaataattctccctttccttggcagcagtccttcttttcctaggcttgattatattgaagctaaaatgttttataagcagtaaaacctaaatccttacctgttcgtaaagtataaaagcaaatatagcttaatgcttaaaagttgtaaaatgtatgttatgtatattttaccaaaatgttttgtaaaaattaaatataagaccataaaggaataattgttaaaatttttgatttttaaaatatttatttaggatggcagtcagtcaaaattaggaggagagacagtggacatggactgtacattggttagtgaaaccgttctcttaaaaatgaagaagcaagagcagaagggagaaaaaagttcaagtaagatctgtttttgttttgttattttttttaataacgttgtgtgaagtttgtagttgtaccattgcactgattagctcaagtgacctcttcaccataaagcaggttttttcctgctctgttaactttatgttcctcttaggaaagctcagtttcagtgcgtcagaaaaaaagtctttaaccaaactaatttcatttcagaaaagattcatatggcttccagggatttgcaaatgacagccagctaccagttttgtaaataaagttctaccagagcacagccttattcatttctttatgtattgcccatcgctgtttgttccatacagctgcagagttgagtagttgatgcagagaccttatagccccacaagcctaaaatagttattttctgaccctttaagaaaaagtttgctgatccctggtgtagacaattttttataagtggtataacagtaagtcttgagtcctgtgttagaattaacgttttctaaagaaatttgataaggaaagaaaggagaaatctaccgagaagtcttagtatagttttacaggttaacattcagaatgatagtgtatatgctgagttaatctgctgtattccacctctactgataaggcaatttggccaaattagtggtctacagccctttgtagtgagaaactattaattctttacccaaagtcttgattttccggaagagatgagaacaataggaggattttggttagcagtaccttagcaacattcctaactgtagaggcacatgacatgagaacagctagactatgaacagttgtcatttatcatccttatgtattgaagagcgagggcctgccacatggggaagcagtgctaaaagcagagacattccccagtgatcatttgttagaagccgaatacattgaggctgggtgtgcattccttatcttctgctgaattttctatagtctacctgctcagagcaaaaaataaaatagtcttgccctggcttcttttgaatctacttatctactgctgccttaaatgcagtaaatcaaagaaaactttagtagtctttgccttatttgttcttcaatgacaaatagcaaaccatatgatgaagcagatggttacctgggtagagaagccaatacctattaaaagaaaaaaccttcacagtagtttattgccattttatggcttgtatgacactaaataactcttcttaagaggatactttgcttttaagattattttgttcctgatactagcctctgatcatgtttttctcatttttgtagaaaagagaaaatctaaagtatgaccactttaaatctattcagaagacaatagtttctcaaatttatttgatgcaagtatcatgtgaaagagaaattagcacttggactaatgaggggaaattatagagataattttggctaataaagtgctatggatagtattgctacataatgaatgaatcacttgaataactcagaggattcaaacaataccattttcttatcttcatagttcctgtggctcaggaattcaggaaaggcttggctggtcagttctgtttcagggtctcatgcagttgtaggcagatggtggctggaactgaaacagcagagggctgggcagctggagagtgaattggcatctcctcatttactctcagggcttattcacttaggctcatttgagcttcctcttcacatggaggataagttcccagagttggcaccccaacagaacaaagcagaagcaggtgacatttttatgacctcagaggtaacatagtgtcacaaagatctgcacaggcataaagcgaaatgaacaggccctcagtgacactcagtgggaggagtgttgacatcatgttgtaagaaccgcacatggaataggagacattagtgaggttatattaaaaaaaaaaaaaattaccccataaggtaaaacttttccagcacttagaattggtttaaaatgaaatataccaataaaaattccatattactgccagtatttcaattcagaaaattttcatgcacctactctgttagattttctaggtgctgtgacagaaagatcaacaaggatatactctctgtcttcaggtatttcgcaatcacaaatcaaacaaaaataaatcatcaatttaacattttgctttacaaacagcatacacagaatgttccgaggatgcctagcacaatgcctggtgcatagaagttgtattttatttacatatttgaccttcagcatgcagaataaatgtttaattatcaataaatatcaagcaaaaattttgtagtaggaagtattttaggaactagagataatgaataaacagaacaaaagtacttaccttatggaacgtacattctaatgagagaaataagcaattgtatatataatagatgatggtaagtccaggagaaaggtaaagcaaggtaagagtgagagagtgctgtgcgttgggagaggtggtacttatatagaataatcttaggcctcttttctgtcatatttgttagccaactggatttaaactctagtgttttttaaatgtgattatataatgggaaatgtggttagatctgtgaagatgaatttttcattttccgtgtcaaatatggcattgaattcctaatttctagtaatactaaactaccagatgctaatgaagatgaaagaaaatacttttttgctacttcattacaaaaagtaagcatgaaaggtcgagcacagtgactcgcacctgtaatcccagtattttgggaggcctaggtgggcggatcacttgaggtcaggagtttgagaccagcctggccaacacggtgaaaccccatctctactaaaaatacaaacattagccgggtatggtggcgcacacctctaattccagctacttgggaggctgaagcagaaggattgcttgaacccaggaggcgaggttgcagtgagccaatatcgcctcactgcactccagcccgggtgacagagcaagactccgtctcaaaaaaaaaaaaaaagcatgagtaaagaacatttaaagccataacataaagcctttgtaaatgtacagtaactacccagagttgggagtttattcttacctcatacacagattacaagaattaaacctcattataagaatcatgatttaagaagtgtctttaaacacttcattacatacgttacagtttgctactcactgagagtaactgaattaacactcagccttacagcttgcaactaatattcttagaatcatgttagcatgtgtccacaaacacttcactacatgcattacatctgttcaccaaaagaacactcttcacagctaggcctgcagccctcatcataataatcatgcctttaaacactttattacatacattatagtttgttactcacttatattcactgaatttaacactcttaacaagacagcttgcaagtaacattcttagaactatcttttacatacgtgtctacaagcctttcactacctatattacatctattcactgaaagaatactctgcaaagtaaggcctgtaatccacatttttttaaaacattttttaaactatcaaatttttattttaggtttgtgggtacataagaaggtttgtaacatagataaacacgtgtcatgggaatttgttgcacatattattacattacacagttactaagctcagtacccaatatataatccatattttaacaaccgtattttaagaagtgtctttaaggactgcattctgttattgtgtggtagttactacagtttcatgatggtctacatattaagcaaaagcttgcttattgccctaagccagtgctcttttacatagatgaagaaagaaaaatgaatgatagcttggaagatatgtttgatcggacaacacatgaagagtatgaatcctgtttggcagacagtttctcccaagcagcagatgaagaggaggaattgtctactgccacaaagaaactacacagtaagatttttttctgtttaattatggcttctcagttgcagaattcagtaagttaagttatcaagctaattaacaaaggcttgatgacatatcaacaattgaagtttcatatttcttgtataaattttttcaggtttttaaaattttgagataattttacactgataagagttccagaaaatttttcagcattctcctgtacctttgacccaacctctccttatgttaatgtgttatatagctataaaatatttattagaactaagaaactaagattagtttggtattacaaatttctttctaaatacgcataaaattgataaaatttttgagaaatgtctattaattattaaattaattgtaatagagtagaaggagaaagttttgtacaacattcagatccagccaggcacagtggttcacacctgtaatcccagcactttggaaggccaaggcagacagattgcttgagctcaggagagttcaagaccagcctgggcaatgtgataaaacctcatttctacaaaaattagctcggcatgatggcacatacctgtagtcccagctacttgggggctggagcgagaagatcgcttgaacacccaggaggtcgtggctgcatcagtgaaccgctgactgtacttcagcctgggcgacagagtgagaccctgtctcaaaaaaataataattaattaattaaattcaaaaaaggaaaattcagatctgttttctgctgtgaatgctttatcttaccagacaaaatacctaatgtaactatgtgtattagtcttaatatctctttcattagaagcagtaactttataatgtaggatagcaatcagaaaaagaatactctaattgaaaatctaagtagataatctggattgaaaattgtaatttttgttaaatctctcatttttctccttgttttattaaattggtccgaatttttaatctagtgcaaagattgttttatgctggtttaaatgaacataccttctactgtggcacaatcttgattatgctcatgtttccatcaggtttttgaaacaacagcccttaactcaaaagtgagtgagacccaaaccaaagatagaggacagtaggcttttgcttgcttagtccatggcaaaaactccatcaagtaaattttgaaataaaaattcacagctgttcggtatcctttttccccccaagaaggaccttttgcaaataggtttcatttcaaagaaaaagactatttttcgcaaaggtgtacttattctgttccttcttttaagttacatttgacactgactatcccagaatttcttctcacttagcttttctgacgatgctgcctcgttcttttcatttgtcacagcttgtttcctagaatatccccaagactctttcttcctcacaacttttctctcacaacttttatcagccttacctctgaaaatgattccaaatctgcatctctaggtttgatttctctgatgaatcccagtcttgcatttctgagtactgtgagatacttttgcgtctcttcagcttaaacgtaatgtctaagccaatttccatttacttccaaccaaataatcttcaaacgtttttatttttcccagtcacccaggcatataatttaggatttgttacatatttattttattttctcaacccagttactaccttgtatgtgctttctcacataacccttagctgtctacctgcttaatgtttaactctctgcttgcttaatgtctattttcttcactgtaatgtaaactccatgaagacaggagacctgctctctcgttacacattgtatgtctggaacttagcacaatgctcagtaaattttgattctttgaatagatgctagcgtttagctatttgagtctagacatcttaggagtcaagtcccaagttctgagctctaggttttaatctttgtcaccaattttctgataaaatctttaatctgtttattccctagttataacttaccttaaagatgcattgtaaaaatcaacaggattggtgacaatgtaaattagtatagccattttagaaaatgatatgaagattcctcagaaaactaaaaatggccaaggcgggcggatcacgaggtcaggagatcgagaccatcctggctaacacgctgaaaccccgtctcctgaaaatacaaaaaaattaaccgggcatggtggcaggtgcctgtagtcccagctactcgggaggctcaggcaggagaatagcgtgaacccgggaggtggaacttgcagtgagccaagatcacgccactgtgctccagcctgggcaacagcgcaagaccccgtctcaaaaaaaaaaaaaaaaaaaaaaaaaaactaaaaatggaactgtcatagatccagcagtcccactactgggtgtatatccaaaggaaaggaaatcagtatgttaaagaggtatctgcactcacgtttattgcagcactgttcagaatagccaagatacggaatcagcctaagtgtctacttacagataaagaaaatgatatatagctagataggtgtatatatatatatacacacacacacacatatacatagacacacaaaaatactatttaaccactaaaaagaacaaaattctgtcatttgtgcaaacatcgatgagcttggagaacatcatattaagtgaaataagccaggcacagaaagataaataccacatgttcttattcatatgtggaatctaaaaaagttgatctcatagaagtagagagtagaatagcagttactagaggtggggaaggctgggatagccaaaggtgggttaattggtataaaaatatagctagccaagcaaggtggcaggcacccatagtcccagctacccaagaggctgaggcaggaggatagcttgagccttggagttcttggagtagtgctgtattggagttctgaggtatgatccatattaagtttggcatcaatatggtgacctcttagaagcaggagaccactaagttgctcaaggagcagtgaactggcccacttcaaaaatggagcaggtcaaaacttgcatgctgatcagtagtggtgcggtgcctatgaattgcccctgccctccagcctgggcaacatagcaacacctgatctctaagaaaaataaataagggagccgggcacagtggcttacgcctgtaatcccaacactttgggaggccgaggcaggcggatcacaaagtcaggagatcgagaccatcctggctaacacagtgaaaccccgtctctactaaagatacaaaacattagccgggtgtggtggcgtgcgcctagtagtcccagctacttgggaggctgaggcaagagaatctcttgaacctgggaggcagaagttgcagtgagcctagatcatgccactgcactccaacctaggcaacagagcaagactccatctcaagaaaacaaagaaaaataaaaagctaaatagaaggaataaattgtagtgttcaatagcactatatggtgactataattaacaacaatatatgttctcagatagctaaaagcacagattttgaatgttcccaacacaaagaaatgacaaatgtttgaggtgacagatatgctaattaccctaatttggtctttacacattgtgtacatatatcagagtatcacactgtataaagatgtatacttatgtgtaaattttttttatttttttgagacggagtcttgctctgttgccaggctggagtgcagtggcacaatctcagctcactgcaacctccaactccctggttcaagagattctcctgcctcagcctcccgagtagctgggattacaggcatgtgccaccatgcccagctaatttttgtattttgagtagagacagggtttcaccatgttggccaggctgatctcaaactcctgacctcaggtgatccacccacctcggcctcccaaagtgctgagattacaggtgtgagccaccacacccggccaaaattaatattgaaagctgtcttttgttgttctttcttgtcaaatgataatagtgggcatctgagtatttcttttatactctaaaatacttcctgagataatgacttttagctgtctagtaattttgagttgaatgaaacagcaccctcctcattatgcagatgcaaaagaaagaaaaaagtagttgcagaggcagggtgcagtggctcacgcctgtaatcccagcactttgggaggccgaggcgggcggatcatgaggtcaggagattgagaccatcctggctaacatggtgaaaccctgtctctactaaaaatacaaaagattagcccggcatggtggtgggcgcctgtagtcccaactactcaggaggctgaggcaagaggatggcgtgaacccgggaggtggagcttgcagtgagcagagattgtgccactgcactccagcctaagcaacagagcaagacaccggctcagaaaaaaaaaaaaatagttacaaagttgcagaaaatttaaatgagttgctcagaggcctggagcatgaaacccaataaaaatggaagtttgagtgcgtgtcattttcttccaagctagttaattatttctcattaagttctacatttagtttgtaatgtgcatgttttatttatagctcatggtgataaacaagacaaagtcaagcagaaagcgtttgtggagccgtattttaaaggtgatgaaaggtaagttggtttttatttataccagcaatgtgactggaagtacaatagagctgtcttttatttctctctcttttttctttttttttaaagacagagtcttgctctgtcacccaggctagagtgcaatggcgtaaactcagctcactgcaacctctgcctcctaggctcaagcaatactcccacctcagcctcctgagtatctgggactacaggcacatactaccacacctggctaacttttttattttttgtagagacagggtttcaccacgttgccaaggctaatcttgaactcctgggctcaagccatccatctgcctcggcctctcaaagtgctgggattacaggcttgagccaccacacctggccagtcgagctgtctttgtcagagtatctctaaactgttaaattgctactttggttaaattaaaattatttactttatggtcataaaaaagagactcaagcataaaaacgacaaattttacaaataaggaaatttttggcaccatcacctttttttggcagtggtaatagttattttctctgcttttgtgtgtgtgcgtgtgcatgtgtgtgtgtgtatttcttttttttttttttttggagacagagtttcactctgttgccccggctggagtacagtggcgcaatctcggctcactgcaacctctgtctcctgggttcaagttattctcctgcccccgcctcccgagtagctgggattacaggtgcccaccaccaggcctggataatttgtgtatttttattagagatgggatttcaccatgttggccaggctggtctcgaactcctgacctcaggtgatccacccgcctcagcctcccaaactgctgggattacaggcatgagccaccacacccagcctgtctgttttattattttttttaaatgtctttttattctatcttttcaacttggggcatttattaaattgtataagttttatgtagtataagactttaggtaggccaggcatggtggctcacgcttgtaatcccagcactttgggaggcccaggcggggggatcaaaaggtcaggaaattgagaccatcctggataacatggtgaaaccccgtctctactaaaaatacaaaaaattagccaggtgtggtggcaggcacctgtagtcaccgctactcaggaggcaggagaatggcgtgaactcgggaggtggagcttgcagtgtgccgagatcgcgccactgcactccagcctgggcaacagagcgagactccgtctcagaaaaaaaaaaaaaaaagactttaggtagtaagacttaggtttattatgcttcagaattattttataaggatttttgaatctttaaaaacaaaacctttaagcatgttttgtttttttggtttttttttttgaaatggagtttcgctctggttgcccaggctggagtgcaatggcatgatcttggctcactgcaacctctgcctcctgggttcaagcaattctccttcatcagcctcgcgagtagctgggattacaggtgcccaccacaacacctggctaattttttgtatttttagtagagacagggtttcaccatgttagccaatatggtctcgatctcctgacctcgtgatccacccgcctcggcctcccaaagtgctgggattacaggcgtgaaccaccacgcctggcgctaagcatcttgatttaaccataatgcgaccttctgcctttcacaaggactgcaaattctgttacttatagtcacctactatttgttcttaaagcaaattgaagacatagtaattcattcaaaaaaaattgttatttttttctttaagatgttggtaaattgagttactcagtaaagttactccttttatttttatttctgttgagaattttagaaatctaacaggccaagattttttttattcctctgaaactcttaaagagctgtcattttgtttaatgcttaattcttcttttttagttaccagttttccaaacaaatggtactctagcattccaaatgtgactaggttgttttttgtttaggtgtcattatatactcatcaatttaagtatatttgatgtgttgtaatccattgcagtcattatccttagagatacccagattgtcccatctttgcctaaaggaaaaggaagcttctttcataggtttcttgcttctgttatctggaatctgccatttttcttggagccctagttccttttagtgagaaatggtgtttaggccacagtctggctgctagggttgcactttagtcattgtttctcagccttttaggtggacagagttaggaaaaagattttttgtatgactttgattttttttttttttttttttttgagacagagtctcactctgtcacccaggctggagtgcagtggcacaatctcggctcactgcaagctctgcctcctgggttcacgccattctcctgcctcagcctcctgagtagctgggactacaggcgcccaccaccacacctggctaattttttgtatttttagtagagacagggtttcaccgtgttagccaggatggtctcgatctcctgacctcgtgatccacccgcttcggcctcccaaagtgctgggattacaggcgtgagccacctcacccggccatatcactttgattttttaaggtaaactatacttcatactgatcgctctaactcaaattcaggaccacaggatatttatgtaaactcctctatcttacatctttatttactttcccacctactgaaaatcccacttctcagtgccaccaacataattccttaatttattttattccacaatacacataaagcagtttcagaataataccaccaataatataattaatgaaaattgtttgaaaactttttgtatgctcttttgtccttaaaatatattctattagaaatgtacagtaaaatcactgcgttttttttttaaagtcatttgggataattattttttgcagttatgccaccaactcagtaccttattttgcttttgattttttaggaattgggtttttttcttttcatatttaattcttttaaaagtacataaagtataatgtattttatatatatatatataaaatgtatataatggacacaaagtatgtacattgtaccagactacaagtatattcagataaatctcacgtctattcttggcctctatatcttatagctccctatccctataggtaatcatttgtttaaaatttatgatttttcttctatcctaaaaaatagaagcaaatacatgtatatagtcatgctatccatgactcatatagaatattatatatactttgctctactttgcttttttagacggagtcttgctctgtcaccaggctagggtgcaggggcgccatctcagctcactgcaacctccacctcctgggttcaagcgattctcctgcctcagcctcccgagtagctaggactacaggcatgcgccaccacgcgcagctaatttttgtatttttagtggagatggggtttcaccatgttggccaggatggtctcgatctcttgaccttgtgatctgcctgccttggcctcccaaagtgctgggattacaggcatgagccactgcacctggcctgctttttttatttaactatagatcctggaaatcactcaagttgtatatagcgatattcctcatttctttttagctccatagtacttcattatgtgaccctactgtagtttataccctagcagtggacacttgggttgttgacagttatgcctagtgcacacagtgctgcagtgaataaccttgcacattctcttttcatatttttgcctgtagatcattgagatagattcctagaagtaggactgcagagtaacaactgtcattttccaggtggctcatgcctgtaatcccagcacttcaagaggctttggcggaagaatcgcttgagcccaggagtttgagaccagcctgggcaacacagtgagacctcgtctctacaaaaattaaaaattagctaggtgtgatggtgtgtgcctatagtcccaactactcaggaagctttgagaagatcgcttgagcccaggaagtcaaggctgcagtaagctatgatcacaccactgcactccagcctgggccaacagagtgagaccctgtctccaaaaaaaaaaagaactgtcattttaaatgtttcatgttaaaggttcactagttttttagaaaatatgtatgagtagttttatttattctgaagcaattagatagctggagaacaagaggtgaatggaagtgtggggatggaggcatggagatgctagaattctcagagttacattgttgctttttccactgagaatactaagactgcaaacctgggaagatggattgtgtagtatcagggacaagaagcttgtttaagtgatgctttgaggtctactacagatgctgttctgctaggagattccctacgtcacgataagacactatagaagtggagtagttaatattcagaagaaaggatatggccaaaatgtgatctgcataatcttaggagtccataaactctttgaaagaaaatatagttgtggcaatattttttgtgtgtacttttctggtttcccttttctaattcacagatcacaccagagctgagggttcttgagttgaaacaaaaaaggacttatacttagagtgactaaaacttttctttttgagggaaagtgcttgccaactagaggggcatgtatgtgatctttttattacacttctatttaaggtatactttctgtttcatggtgctttattgcactttgcagatactgttttttacaaattgaaggtatgtggcaaccctgtttgaacaaatctgtcagcggcatttttccaacaacatgtgcttacttcatgtttctgtgtcacattttagtaattctcacaatatttcaaactttttcattattatatctgttacagtgttctgtgatcagtgatctttgatgctatttttttttttttttcgagacagagtctcgctctgtcgccaggctggagtgcagtggtgccatcttgtctcactgcaagctctgcctcccgggttcatgccattctcctgcctcagcctcctgtgtagctgggactacaagtgcccgccaccacgcctggctaatttttttgtgtttttttagtagagatggggtttcaccatgttagccaggatggtctcgatctcctgacctcatgatccgcctgcctaggtctcccaaagtgctgggatcacaggcgtgagccaccgtgcccggcctgatgctgttattataagtgttttgggtcatcatgaacgatgcccgtgtaagacagcgaactcaatcaatgaatgtcgtgtgtgttctggctgctccaccaaccgaccattttcccatctctcctcctcttcttgggcctccctattccctgagacacaacaacattgaaattaggccagttaagaaccctgcaatggaagcaggcatggtggctcatgcctgtaattccagaactttgggaggctgtgatgagcaaatcgagaccagcctgggcaacatggaagaactccatctctacaaaaaatacaaaaaaaattagctgagcgtggtggcacacgcctgtagttccaactgttatactgcgggaggctgaggtgggaggattgcttgagcccaggaggtcgagactagtgagctgtgatcgcgccactgcactccagcctgggagacaaagtgagatgctgtctccaaaaaaaaaaaaaaaaaaaaaaaccaactatgatgccctttaagtatacaagtgaaaggaagagttgcacatctcttacttttaaatcaaatgctagaaatgattaagcttaatgaggaagatatttcaaaagccaagatgggtaaaaagctaggccttttacaccagtcagccaagttgcaaatgcaaaggaaagttcttgaagaaaatcacaagtgctactccagtgaacacatcaatggtaagaaagtgaaacagactcactgctgacatggaggaaatttcagtggtctagattgaagatcaaaccagccaccgcattcctttaagccagtgcctaatccagagcaagcctctaactctatttagtttgaggaagctgcagaagaaaagtttgaaactagcagaggttggttcatgaggtttaaggaaagaagccatgtccataatataaaagtgcaaagcaaatggcaagtactgatatagaagctgtagcagcaaatgatctagaatatctggctgagatcagtgatgaaggtggctgaactaaacaatagattttcagtgcagatgaaacagccttctattggaagaagatgccatctatgactttgataactagagaggagaaaccagtgcctggcttcagagcttcaaaggacaggttgactcttgtttgggttaatgcgctggtgacttcaagttgaagccagtgctcatttaccattctgaaaatcctaggaccctgaagaattatgctcaatctgctgtgcctgtgctttagaaatagaacaacaaagcctggatgacagcacatctgtttatggcatggtttactaaatattttaagcctattgatcagaaaaaaaaaaaagatatcctttcaaaatattgtaatcatccaacagttgttttttctttttttcccaccatacaaatagagctgattcactgagacagtgatattatagtagagaaagagtgtaataattgcagagttagtcaagtgggaggactggagttattatttaaatcaccttcccctaaaatgtggaagctatggttttttaaggatagtttggcagagagggagctgggaacggggaatggagattggttgggttggggatgaaattataggggtcaaaggtgtctttttgcagagtcggtttttgggtgggatcacaagatcaattgaaccagttttttggtatgagttaccagcgcaggtgagcccacctggtccgtcagaatgtagggtctgaaaaatacctcacaccccaaggttttataatagtaatatcatttgtatgtaggagcaattgaggttagaaatcccatgacctctgtctgcatgactccactactgagctataattttaacctcttgactgatttgctggttttacatagatggtttaagtctctgagcaagaaggaggagttagttttgggaaggagctgataatcatctttgttttaaaataacctcgtggctaatttgttagttttacaaaggtggtttcagtccctgagcaaggacagggctgatttccagaaggagctgttgtcatctttgttttaaagttaaactaaatttttctcatagttaatttggcctatgcccaaaaataaagacagcttaaaggttaaaagcaagataaagtcagctaggtcagattttttccactgtcataatttttgcaaaggtgacctcaatactactgttcattgacaaagcacgttgtcacccaagagctctgatggagatgtacaaggagatgaattttttatttatttatttatttagagacagagtctcactctgtcacccaggctggagtgaatggcgcgatcttggctcattgcaacctccgcctcccgagttcaagtgattctcgtgcctcagcctcccaagtagctgggattacaggcatgtgccaccacgcctggctaattttttttttttgtatttttagtagagacagtgtttcaccatgttggccaggctggatgaatgttgttttcatgcccgctaacacgtatcgttctgcagactggatcaagtagtagtttgactttcaagttctcttatttaagaaatacagtttgtaaggctatccctgccattgattcctgtgatgggcaaagtaaactgaaaaccttctggaaaggattcaccattccagatgacattgaaaacattcatgaggccaggacttcaagaccaacctgggcaacatagtaagacctcatctgtactaaaaagcaaaaattagctgggtcttgtggcttgcacctgtagtcctagctaactcaggaggctgaggcagggggattacttgagcccaggagttcaggctgcagtaagctatgctcatgccacttcactccagcctgggcaacaaagcaagaacctgtcttaaaacaaactaactaaataataatgaataaaataaaatgttgtgcttcttgattgctttttcttcccaacgtactccatagcatattaatccatacctagtggctttgaccctcctaggtttccgtgattcacagtaggatcttattcatttaaaaataacaacaaatgatagttatgcctaatattttgaagaattcatggtaggtggaagcagcataaggtaatttttctttttcttttttctggtttttttttgttttgttttgttttgagacaggatctcactttgttacctaggctgaagtgcaatggcacaatcattattcactgcagcctcaaactcctgggctcaggcagtcctctcacctcagcctcctgagtacctgggactataggtgtgtgccaccacagccagctaattttttatttttattttttgtagagacaggtggtttgatatgttgcccaggctggtctcaaacccctggtgttggtctcaagcaacccttttgccccagtctccctaagtgctgggattataggcatgagccaccacacctggccagtaatgtttctcataaataggatggcaaatggcatacaaacagatgaatctgttctctgggcagaagaagttagtcctgaaatctgggttcttagtactggaaaacaggcagtatttttttttaatgttatacaatgccaatttatgagtttcataatacagtattcatttttaaataggttattatattttacctcctaacctaattgttattttcagccagtgaaaggcagaaataagaagtaatagtaattgcctttcagtataatcccacttgtatatttttgcttttattgtctgttattttgaggtcttattcataaaatcttttcccagaccattgtcctgaaacatttcccgtattttttttttctagtagttttatagttttgggtcttacatttagttctttgactcattttgagttgatttttatattgagtgagaaataggggcctattttcattcttctgcagtggatatccagttttaccagcaccgtttattaaatagactatcctttccccaatgaaggtgcgtggctcctatgtaaaaaaaatcagttgactatagaggcattcattaatttctggtactctgttccattgctctatgtgtctgtttttatgccagtaccatgctgttttggtaactgtagcttcgtatattttcaagtctgatagtatgttgccgccagcttgtttttgtttttgtttttttgctttttttctttttttgagacagagtctcacccaggctagagtgcagtggcatagtctcagctcgctgcaacatttgcctcccgggttcaagcggttcttgtgcctcagcctcctgagtagctgggattacaggcctgtgccaccacacccaactaatttttgtatttttaacacagacatggttttgtcacgttggccaggctggtctcgaactcctgacctcaagtgagccactgcgcccatccagctttgttcttttttgctcaggattgctttggctattggtatgactttactggtttcagactaattttaggattttttttttatatttctgtgaaagcctgggcacagtggctcacgcctgtaatcctagcactttgggaggctgaggcgggcagatcacctgaggttaggagttcaagactagcctggccaacatggtgaaaccccatctctactaaaaataaaaaattagccaggcgtggtggtacaggcctgtaatcccagctacgcagaaggctgaggcacaagagtcgcttgaacctgggaggtggaggttgcagtgagccaagatcatgtcatgcactcaagcctggccaacagagcaagactctgtctctaaataaataaatatttctgtgaaggacattattggtattttgatggggattacactgaatttgcaggtcactttggatagtaaatagttttaatttttttagttagaaaaaaatacccataaaaatacttggtgtatatatagtaagcacttaataagtatttgacgaagcaatatttttctaacatactgaataaacatttcaaataaaaatgaatgaatgttttggggattatttctcctctgaactctaagctttgttaatttaattcatttttcccccagagagactagcttgcaaaattttcctcatattgaggtggttcggaaaaaagaggagagaagaaaactgcttgggcacacgtgtaaggaatgtgaaattgtaagtactaatgtagatactaatttttttttaagtacggctttatagataataaatgcatgattttaaaatcacgtatacaaaccatattggttatagaaacctcttatttgagccaggcgtaacagcaggaataaggagtattctgggtcgggtgcggtggctcatgcctctaatctcagcattttgggaggccaaggagggcggatcacttgaggccagaagatcgagactggcctggccaacatggcgaaaccccatctctactaaaaatacaaaagtaagctgggtgtggtggtgcacacctgtaattctagctactcagaaggctgaggcaggagaatcgcttgaacccgggaggtggaggttgcagtgagccgagattgtgccattgcgctccagcctgggcaacaagagtgaaacttggtctcaaaaaaaaaaaaaaaatgccaggtgcagtggctcacacctgtaatcccagcactttgggaggccaaggcgggcggatcacgaggtaaggagatctagaccatcctggctaacatggtgaaaccccgtctctactaaaaacacattaaaaaaagccaggcatggtggcgggcgcctgtagtcccagctactcgggaagctgaggcaggagaatggcgtgaacccgggaggcagagcttgtagtgagccgagattgcaccactgcactccagcctgggcgagagagcgagactccgtctcaaaaaaaaaaaaattatttttaccaacattctcaggaaattaggtatactcataattttttaaaaataattggtaccaatataagttctttttttttttttttttttttttgagacggagtcttgccctgttgcccaggctggaatgtagtggcgtgatcttggctcactgcaatctccacctcccaggttcaagcaattttcctgcctcagcttcccgggtagctgggattacaggcacctaccaccatgcatgactaatttttgtatttttagtagagacagggtttcactatttggccaggctggtctcgaactcctgacctcaattattccgcctgccttggcctcccaaagttctgggattacagacatgaaccaccatgctggccaagttcttttttgtttgtttgtttgacacagagttttgctcttgttgcctaggctggagcacaatagtgcaatctcagctcaccacaacctccatttcccgggttcagacgattctcctgcctctccctctgcctcccgagtagctgggattacaggcatgcgccaccatgcccggctaattttgtatttttagtagagacagggtttcaccatgttggtcaggctggcctcgaactcccgacctcaggtgatctgcccaccttggcctcccaaagtactgggattactggggtgagccactgcaccaaacatttttcttcctaaacaagatataatgaataaatacttaaacacttatatttttccttttatacattggctgtcttggatgttgaagtagatggtacagacattgctttgtatctgtgggaaactggcttcaggacctactgtggataccaaaatcacggatgctcaagtctctgatataaaatggcatagtacttgcctataacctatgcatattctttcatatgctttaaattacctctaattacttataatccctattacaatgtaaatgctttgtaaatagttgttatactgtattgtatagggaatgacaagaaaaatagtctgtacatgttaatacagatgaaggtttttttcctgaatatttttgatccacggctggttgaatccatgaatgtagaacccaaggatatgaagggccaactgtattgattgtccttttactgaatagtcccaggcaggttctgttttgacctggaacatgctgtttttatttcttcccttgttgtccattagctctcagatgcctgccctcagcaatttacttccccttttaaatttcatttttaacatacgggctagaaaatttaataaccaagcacattaaaattatatgtgaaagtatgactagattgtaatacaggtaagcattgggtaaaaatatgctcttatgtactaacaatgggaatataaattgggatcactattttgaaaagcagtttggcaatacaagcaaaagcctataatgtgagttcgtgagttttcattacacaaattgaatatatcacgatgtcttaaagaatatggtccacattgagtaaatctctggttttttagttataaccataattctatgatctagaattaatcctactagttagaaaaaagctattttgctagaaacactgttaagttacattcattctcaataatcatttcccgtgctttctgttatccaatctctgaaaaccattattgtatacattttagtttttctagttaatttacctaggaaggtaaatctgttctgttactccatcatgaccagaagtggaagtgccagtcccatgtacttaaatactaaccatatgcttacagttcttaaatttatcccattgcctattctgcaagtggagtgtgcaatactcatgtggatctgagatagtgatctcaaatttcacacatccaaaaacaaacatacaatatctgccctcaattcccaaacctcactgctgagtctcctatatgtcctgagatcttatagttattcactacttttttctttcacatctcaataacttttatatcaacaaaccccattgattcttccttcaaaatatatcccatatccatccacttactatcaccaccactaatgccctggaccaaggcaacattttataattttttttttttttttttgagttggagtctcactctgttgcccaggctgaagcacagtggcgcgatttcggctcactgcaagctccgcctcctgggttcacaccattctcccgcctcagcctcctgagtagctgggactacaggcgcctgccaccacgcctggctaatttttttgtattttcagtagagacggggtttcactgtgttagccaggatggtctcgatctcctgacctcgtgatccgcccgcttcagcctcccaaagtgctgggattacaggtgtgagccactgcacccggccaacattttataattgtaatagcttctaagtgctctcctggtcatttttttttttttttactctaaaacttgtattttggccaggcacagtagctcatgcctctaattccagcactttgggaggccgaggcgggtggatcacctgaggtcaggagttcaaggccagcctggccaacatggtaaaaccctgtccctactaataatacaaatattagctgagcgtggtggtgcatgcctgttatcccagctactctggaggctgaggcaggaaaatcacttgaacccaggaggcagaggttgcagtgagccgagattgctccattgcactccagcctgggtgacaagagcgaaactccatctcaataaataaataaataaataaataaaactttattttttagagcagttataggttcacagcaaagttgtacagaaagtacatacagttcccatgtacctctgtccccattctcttttacttttcattcttgtctcttaacaatgtactttcagctcagcaatgaatggcctttttttttttaaataatctttttagaataaaagttaaatcatgtcattcccagaatccttcattgtcttcccatcccactaagaaaaagaatctaaagtccttatcaaggacaacaaactctggctctgcacttcctctctgatttctgttcaaccactcacccatttgcttgctgtgttacaactgcactcaccgactactgtttctcaaatatgttttaattcagtggcagtgttttttccaataagccctgattctctaaggtcatctcatctcatcccaaagcccagactaaggtaacaaaggcttatacttagggcagtgagaatgatgaaaaagatacctgaatgaagttgtttcacagcttctttaaagcctttaatctgtgtaaaatagaaatgtattaaaagcttttacttcaaacttaaattctagttttaagtctgtcactttcaataggtgatatctttggcaaattaccactttcattttcagtttctcaagtgtaaagtgaaggaatcggctggattaaatatgtgattctgggtggctcacacctgtaatcccagcactttgggagtctgagacaggtggatcacttgaggtcaggaattcgagaccagcctggccaacatatagtaaaaccccgtccgtgtctactaaaaatacaaaattagctgagtgtggtggtgcatgcctatagtcccagctacttgggaagctgaggcaagagaatcacttgaacacaggagtgggaggttgcagtgagccaagatcgtgccactgcaccccagcctgggtgacagagcaggactctgtctctcaaaaaaaaagtgattctgtcatctatgttctattaaaccttaaactactgctttgttttcactaagtctaggccttaaaaacctgtacaatttttacgtataattttatccttgtgtgcatgaagttcaagttctttgttttcacagttgccaaaaaatagtaggcttttgatcctaactgaaatcttaaagggagaagtcatggagccttcaacattcagatctaaattattttttaaagccgtagagataagaaaattactttgaaacacacgttatattcaaataataattaagaaacatgtagacctctgaattttttttactggcctaataaggataaagactttgtaccagtgtataaatcagctgtatcactaagcacactgtcaagatcagctggctttttttttttttaattgcaacactttactgataaaggaagcactttattggtttacattgtgatacaagctccttttctcatcagtgaagcaggcacttcacagaccaacatcagcactgattactgttagtaattaatactgtctgtaagaattaattactaatagtatcatcaatgaggattaagtttccttagactgctgaatatcttagtaaatggcttttttagcttctagtttgtaatcaataagcataacactccatttattattctttagtgaaaaaacttaccagtttttattattagtattatgcagatatgccagcagaagaaagagaaaagaaattggcttcctgctcaagacaccgattccgctacattccacccaacacaccagagaatttttgggaagttggttttccttccactcagacttgtatggaaagaggtgagagtatagattgtaacattttataattattttttttaaatacttggccgggcacagtggctcacgcctataatcccaacactttgagaggccaaggtgggtggatcacctgaggtcaggagttcaagaccagcctggccaacatggtgaagccccatctctactaaaaatacaaaaaattagccaggcgtggtggcacatgcctgtagtcccagctactcaggaggctgaggcaagtgaatcacttgaacccaagagacagaggttgcagtgagccaagattgtgccattgcactccagcctgggcgacagaacaagactctgtctcaaaaataaaataaaataaaataaaataaaataaaataaataaaatacaatataaaataaaataaaataaataactgtatatgcccaaatgtgaacatgcacctttttttctgtgattctctttaccttttgctgcaggttgggtgctagttttgtgacataaaaacattcctaaagataaaaggactcttcagtaatttatttggaattagagattggtaatatcactttaatgtgattgtgcttatattattctggtttaccaaatttcaaaaagcaatttctcttttattctatcatcaaaatgatttttttttttatagggcttcactctgtcacccaggctggagtgtagtggcatgcataatcatggctcactgatgcctccgacttatgggctcaaactctacctcagccttccaagtagctaggactacagccttgtgccgccatacccagcacttttttttttttccccctagagacagggtctcactatgttgctcaggctggtcgtgaactcctggcctcaagtggtcctcctgccttgacctcccaaaacactgggattacagccatgagccactgcacccagccaaaatgactttaaataaaataaataacctaacaaaaattaccaggaaagttatatttaaaaagagagaatcttaaaatctactgctatgaattttggattttaaaacctcacttacccagaatgctggatgtttataagtggtatctgaataaataaaaaagatgtttatttgttaggttgttgacatgcaactagcttgtttagatatgacacttacatttaatataatttgagaatatattcagcttttaggctgttaataaaaggtcatgagtagtaatttttctatgttaccagcagcataatgctaaaaagtatagatccacatttttctggttttatattttctaccaaaattaagttagttgggtatgtgatctgaagtcttcatgtcatttaactgtctttggggtagcatactcccatttctgtgctcaagctaggactatcaatctggacattaccactattccaggcatatagtaattcatagtcactaaggtctaaactttattgtaatcattggtttaaatgaaatgaaatgctcgagtccttagccttaaaagagctatttaattaagcagggtccatttcacagaccctttgttgtgaaagtataattccagaggagctcataagagcatttaatagctagtttttatgaaggggcctttttttttttttttttttttgagatggagtctcactgtgaggcccaggctggagtgcaaatggcacaatctcggctcactgcaacctccacctcccaggttcaagcgattttcctgccccagcttcttgaatagctgggactacaggcacatgccaccatacccagcctattttttttttttttttttttttctagtagagacggggtttcaccatactggccaggctggtctcaaactcctgatctcaagtgatccacccgcctcagcctcccaaagtgctgggattacaggctcgagccaccacgcccggcctgaaggggcctctttaactgaagattttattctctacattattgtattcttagactttttttgtatgtggcacatatagttcaaaactcatttgttattaaatgaatgttggtacagacattcaatcaaacattcttttaataagacaacatactcttagttttatgaagaattttaattcaaaatcatcctaaaacatgagctaaatactgacattacatgtgtacagtttattacataccaagtgtacttgaatgaagctgttcagaaaaaaagccataagagaggaagaatattagctaagcagggacttttctgacctctttattattttttgctattttctccatggtccaaagaccatccagttacagactaagtcttaccttgtggtttaaaatactgagttttagctggtccagaggcaattagttatctcagttgatcattcaattacagattgaactgcttcttttactctttcccttcattctcactactgtacctgattcgtcttaagaaaaaaatactgagttttatgaaaacaagatatgttttctggtatgtgattgaaaagtatagtagtgtttagaatatttatgatttgactttttaattaattagtagccttcaggctttaggcctgtatttgtcagttacagataaatgtttaaaatttttacccacaagacgataaaatagcattaaataaatgtcaaatgataaaattataccacctagaatttcagttcagccttgccatcttatagaaactattctcagctgggcacagtatctcacacctataatcccagcactttgggaggccaagatgggaggatccattgagcccaggagttcgagaccagcctgggcaacagagtgagaccctggctctagacgaaataaataataaaattagccaggtatggtggtgcatgcctgtggtcccagcagtaactcaggaggctgagatgggaggattgcttgagccctggaggtggaggctgcagtgagccgttattgcaccactgcactccagcctgggcaacagagcaagaccctgtttcaaaaaaacaattaatttaatttaattttgaaaagaaactgttctcaatgaagagctctgatgatttagctgcacaacaaggagggagagaccttcttcacttttggagacgctccagatgtttaactgtaagatagtttttccaaaagatgcaaagtctctgacagctttcactgtatttctgctttccccattaataagccagattgagtcaactttgatgtgatatctcactgcctggtcaccagatagaatcagtctggatagagcctgtgattgcaccccatgcgtatggcagagcaaatacttcccctgaagattacatgcttagagacaccttaggagatctaatagtctgaagggtatagagggattgtcatctattgaaatagctactgtaaaaagtatttttgataagtacctgaaatttataatagtagagttcatgtttagcactttgtccccctttgcaactacctatgggaggcagaataggaaagtgtttaagagttctggttctggaataagaaagagcttgggccaggtcccagctcctctactttttagctttgtgaacttgaacaagtaatttaacttccttgggtctctattacctcatctgtcaaacaggtatagtagaaactacttcaaaggaatgtgagttatatgagatgatatatgtaaccatttggtaaatatttgctgtcattattataaatgaggaaactgatgctaaatagtgagatcaatcatcagcatcacacagctaataatcagaagaatcatgtaaacttacaaagcatcaaataagagaaatgtttactagatataagctgaaagaaatgcatgttgcacatacagtcttctaagtttatgatttgtttttaaggttatattaaggaagatcttgatccttgtcctcgtccaaaaagacgtcagccttacaacgcaatattttctccaaaaggcaaggagcagaagacatagacgttgaaacagaaacagaaggatgaaggacagttttttccttcttagttatttatagttaaagttggtactaaacattgatttttttgatcttctgtaaatggatttataaatcagttttctattgaaaatgtttgtgatattttgcttttgcacctttaaaacaataaggcgctttcattttgcactctaacttaagagtttttactttatgtagtgatacctaatacaattttgaaaatacaata

SEQ ID NO: 433 - DNA, 63004 bp, Homo sapiens
ggagttgcagtttgagagcagttccgggcagggaggcgcctttgctgccctcacagacttggcccctagcagtgcagaactacaagtcccagggatcctagcgaccgtccgtccgtagtcaagttgccggtggaattggcccaggatgacagctggagaatggagtcaggtacggggagcggctttgagtggaaccgtgtgaaagagccggggtgggtagtcgctggcgggtcgttgagtcggccatatgaaacaggttcgggggcagggcaagagttatgagagcctaaaggtcctgtcccccggggttcctgacctgcagtggcaggcggaagggacaagggttggagctgagtactacctactgagctcgaaccggtgactgtggctaccctccccctccctgccaccgcctagggagtggaaagaagtgggggttaattactctgacatctcggcggtgtggcatcaggacagggttctaccacagcagtgatagcatatggcaccgtactgaggtgatgtgccagggtgatgccaaaggcagggtgtgatgccgtgggagccacctgatatctaagagacctcggtgagtccatagcctggtgacatcacagcttgatgagggtcatcttaaggataccgggctgtggtgttggcattttaatatcacgatattaactatgttgtcaaggctttgctacaactattaagctaatagtgtttctttttatagaaatcccaaatagtgccatagcagaagcaatgcaagactgatcctttatagggcatatccagaggacattatgccacaactaggtaacgataagaatacattcaagaaagagactcatgatgtttatgtttatcctgttatagtgtagaacaggagttgggaaactttctgtaaagagccagatagtaaatattttaggctttgtaggccaaaaggcaaaatcaagaatattttgttggtacttttatgacaaaagagaaaacaaatttcaacaaatttttattgatgaaattcaaaatataatagtaattgagtactttttttgtaatacaggaagactaccaatgagaagaatagaattctttttaggggataatattttgcttaattggggctcagaattagtgttccctattgtcaaaattgattttaagtgttcatctgttaatgctgatctgttaggaaatttttacctatttaatctttgaaaatgtcattttacatagataggtactgccaaatactgatatcaattcataaacatatacttttttatttttatttttatttaatttttcaaaaatttcagaatagttgtagatttatagaaaagttgcaaggttagtagagttcctgtataacactcactcaaaatgaggcacattttacatatcataaaattcactgatttcaagtgcataattaaatgatttttggtaactttactgaagtggggcaaccatcaccataaatcagttttagaactttttgatccctccagtaaggtccctcatgcctatttatagttaatcaatcctctgtcccattcccagccccagacaaccactaatctacttttttgtttctataaatttgcctattctggacattttatataaatgaaatcatacaatatgcagtctttgtgtctgatttctttcacttagcataatatttttgagattcatccatattgtagtatgtatcagtacttccttacttttttattgctgaatagtattccattttatggatataacacatttttatctgtctactcactattagataggcacatcagtttccaatttttggctactatgactagtgctgctaagaagattagtatgtaagtcttcgtgcggacatatttttttcatttctctttgatagatacttaagggtggagttactggatcacagggaaaatttatgcttaacttcttaagaaactgcaaaactgttttccaaaatggcagcaacattttgcacttccactagcaatgtatgagagttcctgtttctccacatccttgccaacatttgttatttactgtgttttttgttatagccattctaagtgggtgtgaagtggtgtctcattgtggttttaatttataaattataatttataatacggtgagcatattttcatgtgcttattagccattcatatatcttcttcagtgaagtgtctgttatatcttttgtctgtttttaaattgagttatttgtttttttagtgttgagttgtaaggatggtttatatattctagatcaagtccctgagagatatatgatatgcacatatattctcccagtctgttgcttgcctttttctttttttgatggtgtcttttgaagtgaaaacgttttgaatttgggtgaggttcaatttatcatttttttttctttcatggaccattcttttggtgttgtacttaagaagtctttgcctaattgcaaggtctcagtgattttctccaatgttttcttctaaaagctttattacttcatctcttacatttaagtctatgattcattttgagttcattttttctctgtgatgtgaggtgagagtctaaattcatctttttgcatgtggatgtagaaattgtcctagcaccatttgctgaatctcttatcattaacgtcttacattgctatgctatctatgtcacaactaataagcccacagtggtatattgctattaactataccccatgcttttttttttcaagtttcactagtttatctctagagatgctgtcccatccaggataccacattacgtttagtcattgtatctccttagcctcttctggtttgtgacactttctcacacttttcttgttttggtgaccttgatagttttaaggagtactggtcaggtattttgtagaaaacccctcaattttatgcttagactggcattatgtgtttggaagaaagtctgcagaggtcaagtaccacattcttatcatacactatcctcaaacatgattttaattgagcatattcattgcgtggaatagaattctgttcttctcttaatagtgccttttagcattatgtggcaggttaatcacttccaattgaaagtttggtgaaagctgctcaattgcacagttaaagggattttggaatatggaatatcctttgcacttgcttcagggttcaaaaactgctgctggaactgtagtctgaattcagaaaatatatatgctgcaaattcttatggaaatagatatcttgcttcttgttttaacttttatttcattttattttgagacagagtctcactctgtcacccaggctggaatgcagtggcacgatcttggcacactgctatctttgcctcccaggctcaagcgattctcctgcctcagcctcctgaggcgcatgccaccacgcctggctaagttttgtatttttagtagagacagggtttcgccatattggccaggctggtctctaactcctgacctcaggtgatcctcccaaagtgctgggattacaggcatgagccactgtgcccagcctattttattttttattgagacagggtcttcttctgttgcccaggctggagtgcagtggcacgatcacggctcactgcagcctccacctccctagcacaagcaatcctgtcatctcagcctctggagcagctggaactacaggcatgcaccaacacactcagccaatttatgattttttatagatacagggtctcactatgttgcccaggctgatctcgaactcctgggttcaagtgatcctcccacctaggtctcagaaaatgctgggattacaggtgtgagccaccatgtccagctgagatttcatttatttcttctgggtacttaactaggagtggaattgctgggtcatatcgtaactctgtttaagtttttgagaaactttcagactctttacaagagtggccgtaccattttaccttcccatcagcaatgttcgagggttcagatttatccacattttttttcttattttcttttctttcttttttttttttttttggagacaaagtctcactctgtcgcccaggctgaagtgcagtggcatgatctcagcccactgcaacctctgcctcccaggttctagtgattcttgtgcctcagcctcctgagtagctgggattacaggcatgtacctccgtgccggctaatttttgtatttttagtagagacggggttttgccgtgttggccaggctggtctggaactcctgtcctcaagtgatctgctcaccttggccttccaaaatgctgggattataggcgtgagccaccacatccagccaaatttctccatatctttaccaatacttattaatatctatctttttgattataggcattctagtgggtataaagtggtatttaattgtggttttattgttttgacttgtgacagcatgggaagtggataaagcatcttgacattacttgtgattcaaataatattgtcaaaatgactttactacagtttttttcatatataagcattgttttgccttgtaattttaggttgaattaattaataaacattatccagcctgcatcaaaagttaatttccaaagccattcagtgttccctaacagtgtttgaaggtggttcttccaaccatttaaaattatgagaatcattcgtaccttgcttgccacacaaaaacatgagatgggctgaatttagcctgccagtcatagttggtatagagcagaagtgccctgcatattcaataaatacttctctagttgattatggaggtacagtatccctgtgttgtggtattcacaaagtattgggtatagtgacctttcaccataaaaatgcatcaagtacttggatctgattggtagaaaagctggaaaaacaattccaagtgcctttcctactgagtgacttgtttgggtagtcttcttttataaacagtatattttattttattttattttattattttattttattttattgtatgttatgttatgttatgttatgttatttatgtgacatggtaattaactttcaattctgagtcctttaaggctaaggggaagttatcctttgactttttgaaagctgcaagataaataggtcttagaggagaaggtctcttctcttttgtggctggccccaagttatggaggaatgatgtggttgctgtttatgtccattaagagacaaatggggccctgttagggtctgactccctttctgctcttatgattgaacgttccctattgccttttccactgatcacctggattctagatactaaaacaagctaagttcatcttctaggcttgaagaataatgccaataataactagcatttatagatgacattgtcagttactgagcttatcttatgcaatcctcacatcagctctgtgaggtaggtactattatcctgcagctcctaccttttttaaaatgagaaaacaggcacagaggagagaagttacatgcccaaggtcacacagtttagttggagctataatagaaatccaggcaattctactccaaagtcctactacttaaccactgcaacatgctgctaaatattgctgaaaatggaattatgtgtaaatgataatcctaaatattgcaatacaaaatgctgtcagagttctttgggttgtaactctacctgtgattttggtgaaatgacaagattttaatgctctagagcagtgctgtccagtagaactttctgtgatgatggtaaacttctatatctacgctgttctagtatggtaaccataaccacatgtagctcttaaagacttgcaatgtgtctaggaactgaatttttaatgtcatttaattgtaattgttttacatgtaaatagttttgtgtgactcattattaatcatcttggacagtgcagagagagatcatttccccccacttgttcctttttaattacactaaatattttacccaatgcaaatattctttccatagcacaacaggaagtgaatatattctatactgaaaaacaacttgagggtatacgcaaatcaattaactgcatgacagttgcaggaacaggttctgggttatccaccatgaaacttctccattcccagcacttactaaataaggttccataactggctcaaaaaccttttgcaattgatttttcactgcttacaaatgtaatttatgtggcttattgcactttacagttgccagttgcttggtttaagatgagacatcttaatctgtggctctaatttttttttatatacaagtttttttatataaaagttctggggtacatgtgcacaacgtgcaggtttgttacataggtatacatgtgccatgtgggtttgctgcacccatcaactcgtcatttacattaggtatttctcctaatgctatccctcccccaggccttcgccccctgacaggccctggtgtgtgctgtggctctaattttttttaatcccgtgttttgatcccacatgttaaatgtccttggtgttatatgtcactgggctatacaaaccttccccatttaaaagcgattccttcacaaaactggcaaactgttacaggctgttataataaagcactttatatttactccctgagttttagcttccacactcttgttttaagttgtttgctttataagtggtttctttttttaaaagggttttattatgaataagagactcgcaataatttgcaaagatagtacagaaaggccccatataatcttcatctgagttacttcaatcattgcattttacataattataatacaatatcaaaaccaggaaattgatactggaatgatacgtgtgtataattctatgttattttatgatgtgtagatttgtttaaccattatcgcaatcaagaaatattccatctctcctgtgctacctctttatagtcacacccaccacctacccccaccattgataacccctgaaaaatactaatttgttctccttttctataactgtcattttaagaattttatatataattaaaatgatttaatttttagaatcataaagtatgtgaccttttccactatttttcactcagcataatacatttgagactcattcaaattggtatcaatagttcattccctcttattgctgagaaatattacacgacatggaggtaccacagtttttttaaccattcatctattaagggacatttttaaatgtccagtttttggctattacgaagagaactcttattaacattgagtacagtgttttgtgtagatggaaattttcatctctctgagataaatgcccaggagagcaattacaaggtgggacggtaaatatatgtttaattttaaaagaatctgacaaactagttttccaaagtgactgtaccattttgtattctcaccagcaatggtatgagagatccagtatctccacatcctttccagcatttggtattctcactattttttttttaagttttagccattgtgataagtgtgtagtgatatattactgatttaatttgcatttatctgatggctaataaagttcaacatcttttcatgtgtttatttgtcatccccatatcttcttcatttaaatatctctttatatctttggcccattttctaattgtattgtattgtttgttttactgttgagttttcagagtgctttatgtattctagataccagttctttgtcagatatgtagcttgcaaatattctcttccagtctgtggcttgtcttttcatcttaataggattttccacagagaaagagcttttaattttgatgacattcaacttattgatttttttccctattatagattgtgcttttgttgttacatctaagaagtcttcaccaagtcgtaggtctcaaatattttctcctagattttcttctgaaaatgttatagttttacattttacattcaagtccatgatccattttaagttaatatttggcataaaatgtgaagtttaggtcaaggttaatttttttggattattgatatctagttacttcagctccattgaattgcttttgcactgttgtaaaatataagtatgccgtacttgtgtatatctatttctgagttttctaatctgattcattgatctacgtatgtgtccctctgccataccacacagtgttgaatactgtagctctataataaatcttaaaatttgatagagtgattcctcctagtttattgttttcaatattgcctgttcctttaactttccctataaattttagaataaacttgcctatatctgaaaaaagttagctgagatattgataggaattgtattagacctgtgtatcagtttggggaaaactgacatctttactatgctgagtcttccaatccatgagcaccatatgtctctccctttatttagatcttcttttatttattttatcagcactgttcaattttcagcatagaaatcttgtatgttttgttagaattatacataaccatttcatttttggagtgactattaatggtattttattttgaattttggtttccatgtattcattgctagtatatagaaatataaatgatttttgtatgatagttttgcatattgaaaccttgctgaattcactgattagttctagggggttaaaaggtatttttctaattttttttcttttgttttcattgttttttaggactttctatgtagaccatcttgtcatctgcagagagggacagtgatatttcttcctttccactctgtgttttatgttgaatagcagtggtgagagctaaattcttgtcttgttcccagtcttagggaagaagaggtcagtctttcagcatcaactataatgtagttttttttgaagtttagatcgttccctcttgatttctagttgtctgagtgtttttatcatgaataactattgaattttgccaaatactttttgcatcaattgatatgatcttgtgatttttcttcttcagtttgctaatgcagtggattacactaatttattttcaaatgttgagctagccttgcatccttggataaaacacatttggatgcgatgtataatttatatgttatatttgctcatatttgctggggatatttgcttctattcatgaatgatattggcttgcaatttaattttttggtactgtctttgtctgattttggtatcagtgcaatattggccttataataagagttgggaagtagtccctcctcttctattttctagaagacattgtgtaatatgagtgttaattcttctttaagtatttggtagaatgctgcagtgaaatcattcaggcccagatggtttcaatgaagaatttttttttttgagttttaaaattatatgttcaattttcttaatagttaccaagctattcaaattatctaatttctattgagttgtggtggtttgtgcttttcaaggaatttatccagcttatcaaaattatcaactttatacatgcatatttgtttgtagtaatcccttttggtgtctgcaaggtctataataatatctcctgtttcattcctgatattaatgatttgtggcctatcttttttatttgtcagttttgcttaaggtttgtgaattttatgaggcttttcagagaactacctctttgtttcattgatgttgtctgttgattttgagttttcaatttcattgacttctgctctttatctccttacttctgcttgctttcagtttaatttgctcttacttttctagttccttagggtgggaaattagattattaatttcagacatttcttcttccctaagttaagcctttagtgcaatgaatttccatctcagcactgctttagctgcatgtcatgtattttttttatcacagtaaaaaaccatagcaggagatttagttcttaacaaactttaaagtgtacagtacaatattgttaactataagcacaatgttgtacagcagatctctagaaatttttcatcttgaatgactgaaactctatgcttattgagcagcaactccccatttcccaccccccaccaaccccctggcaactactattttcctttctgtttctatgaacataactaatttagatatataagtggaatcatgcagtatttacccttctgtgtctggcttatttcatttaacataatgtcttcaaggttcatccatattgtagcatatgacagggtttctttttatggctgaataagattccgttatatgtatataccacagtttcttcatttatctgtggatggacattaggttgtttccacctcttggctattgtgaataatactgcaatgaacataggagtacaaatatctcttcaagattctgatttcaattcttttggatacatccctagaagtgggattgttagatcatatgggaaattttaattttttaaggaacctccatactcttttccataccaaccgcaccattctacacgcacaccagcagtgcacaaggttccaatttctccacattcttgccagcacttactgttttttttaataatggccatcctaacagttatgaagtgatacttcattatggttttgatttgcatttccctgacaattagtgatgttgagcatcttttcgtatacctgttggtcatttgtatgtcttatttggagaaatgtctattcaagttctttgttcatattttaattgaattatttggtgagattttttgttattgagctaaataatttagatattgaaccctatcagatggtttgcaaatattttctcccattctgtaggttgcctttcattctgttgtttcctttgctctactgaagctttttagtttgaggtagtaccacttgtctctttttacttttattgcctatacttttggtgtcatatacaagaaatcattgccaagaccaatgccatgatgctttccccctatgttttcttctaggacttttacagttgcaggtcttatgtttaagtctttaatatattttgagttgattttatatgtagtgtgaaataaacatccaatttaatttttttgcatgtgggtataaagttttactagcaccatttttttttttcttgcgggggagttgggctggatctttgccccctttttttttcaaaaacttttaagttcctggttacatgtggaggatgtgcaggtttgttacataggtaaacgtgtgtcatggtgatttgctgtacagatcaacccatcacctaggtattaagcccagcatccattagttattcttcctgatgctctccctcctcctccccctactcccctgacaggccccagtgtgtgttgttccccctacccatgtgtcctcatcgttcagctcccacttataagtgagaagatgtggtgttaggttttctgttcctatgttagttagttgaggatgatggcttccagctctatccatgtccctgcaaaggacatgatctctttcctttttatggctgcacagtattgcatggtgcagatgtaccacattttctttatccagtctatcattgatgggcctttgggttgattccatgtctttgctattgtaaatagtgctgaaatggacatatgtgtgctagcaccatttgttgaagagactacccttttccccattgtgtatttttggaactatcattggagattagatgactgtatatgtatggatttatgatcaagctctctgttctgttccattaatctatatgtctgtctttatgactgtaccgtactgtttaatccacttatatttaaagtaattattgatagggaaggacttattattgcaattttgttcattgttttctgtcttgtagcttttttgtccttccttttctttctttctcttttcctttgggtttcattgatttttttgtagagacatgctttgattctcttcacacattcttttgtgtatcatttaaagggattttctttgacattaccatggaacttacagaaaacatcttataacaacctatattaagctgaaacaaacttaaacttcaattacatataatactttactcttttatattatccaccccacactttatgttatcgatgtcacaaattacatttttatattgtgtatccattaacatgtttgtatagttataggtatttttatacttttttttgagacagagtttctcttgttgcataggctggagtgcaatggtgcgatcttagctcactgcaacctccacctcctgggttcaagaaattctcctgcctcagcctcccgagtagctgggattataggtgcccgacaccatggctggctaatttctgtatttttagtagagatgggatttcaccatgttggctaggctggtctcgaactcctgacctcaggggatgcctcccaaaatgctgggattacaggcatgagctgccgcacccagccaatttttatacttttgttttttaacttctatactaaaattaaaagtgatttacccaccactattacagtgttacagtattctgtatttttctacatatttacctttaccagtaagatttatgctttcaagttgctgttgagcatcttattatttcaactcaaatgtctctctttagcatttcttgtaaggcagttctagtggtgaagaaattcttcagcttttggtcatgtgggaacgtttttattcctccttcattttgaaggctaattttgctagatgtaatattcctggttggcaggttttttttttttctttcagcactttgattattccattcccttttgtcctgcaaggtttctgctgagaaactcacagataatcttatggtgatttccttgtacatgataagctgcttttcttttgctgctttcaaaattctttctttgtcttggacttttgacaatctgattacaatgtttctcagtgtggatttctttgggttcatcctacatggagtctgttgggcttcttgaatccagatgtccatttcctttcccagatttgacacatttagagatgttatttctttaaataaactttctgtccctttaccccttctccttcttggaatcccataatgcatatatttgtttgatggtgtcccataaatcccttaggttttcttcactgattttttgttcctctgactatatcatttcaaataacttgtctctgagttcaccaattctttcttctgccctatcaagcctgctgtttaatacctgtcatgttttttttttttttcagttcagctgttatattcttcagctctaaatttctgtttggttctcttttatgttttctaaatctttattgatatttgtcattttttgaactcatagatggcatctttatgatggttattttgacttctttttcaggttattgatatacctctctttctttaggattggtttctggagatttattttgcttctttggaccatgtttctctgtttcttcatatgtctctaacgtttttgttgggatctgcacatctgaaacattggtaacttctttcagtcatcatggactggctttgtacagggaaagacccttaccagtcagcccagctagagattctgggggcctttgaaacctttttggaggatacttgacttctctgggcatgtgtaggtaatttctcaactagaagcttaccagtttcttttacaggagcttataatcacttgctccctctgtgtctacaacactgcaagttttctggttctatatcagtaagcctcctctctctctttttgttctcagtggtcatcaggtatccagtgtgtgctagcttcctaagtcagtgccccaagtcaggtgagacctatactagtaccttaggcagcctggtgaaaagtcaaaatgctgatgaatattccacttgtttccctccctcctgaggaagaagccttaagttgtgtatctcctcccaactgtgctgaactgtgctggccacagcaagttacccaccactttcctttgttctcagcagcctcaaggcagccaaagtatgctggttttgttagtgcttccagtggggcaaaatagaaacctcttcctggttccttgagcagccctccaaaaacacagaacattgaaaactttgtacagtctttgttccccccaccctgaaattgaaggctgggatgttatttcctggtgctgagctgtgccagcttgggagaggggctgatgcagataaggtgagattgcccttcctacccattttaatgtggttattcttgactttgtgcttacctagggtatgcaacttcttaactgaattctggaattctcataaaattattttactcaatatatcattgttaaattggtcttcctgtaggggaacaagggctggaacttcctattctgccatcttgctcctatgtcacatatttcgatatgttgtattttcattttcattcagttcaaggtattttttttttttacttcccttgagacttcctctttgaccaacggattatttagaggtatgttgtttaatttccaattgtttcaaaaactttcttgtttcctttctgttattgagttctagtttgattccgttgtagttagagaaatactttgctatagaaaccttacttccctttaagtctctttactttctcccatctataatataattttaaaaatatttttcccatatatttttagaatcacatcagacaatgttatgacttttgctttaactgtcaaatataatttagaaaactgaaaaaagaagcaaagtctgttgtatttggtactattttttactcttatttttctttcttccttcctgatacctaaagattccttcttttatctttcctttccaattcacaaatttcctttagccatccgttcctttaggtatgtctgctggcaacaaattcttagtgtttcttcacctgagactgtcttgattttcccctaaaagatattttcactggatatgcaaatttagattgacagttcttttatctcagcatttgaaaaatgtgccatttccctttggactccatggttcctcttaataaatctactctcattaaaagtgtttttcttctataagtaaggtatttcttctctctcactactttcaagatttttttctttttctttagttttcaggagtttgattatgatatgtcttactgtggaattcattggatttatcctattgggtttgctcagcttcttgaatctgtaggcttacgtcttttgccaaattggggagattttcatattaattagcttgatttagctattccacatgtatacacatatcaaaacatcatgttgtataccatagatatatacaattttatttgtcaattaacaaaattaattgattgttaaatatttgggagattttcacctatttttttttaatactcctttagtcccacactgtttctcctctcctcctggaactctgatgatatgaatgtttaatgtatcattaaagtcccgtgtgtccctgaagctctgtttacctttttcaatttattttctctctattgttcaatcgcataatttctattgttctgtcactagtttcactgattcttttttcagtctcctttttgctattcagcccattcagtgagtatttcattttggtgattgtgttttacagttctaaagcttccatttgcttctcctttatgtcttttatttctttgctgagactttctttttataaaaaaatttgttttcagcatgttcgtaattgcttgttgaaacatttttaagatgactgatttaaaatccttgtgggattaattccaatctgtgtcatatcaatgttggtgtctgttgaatgtcttttctcattcaagttgagatgtacctggttctttttatcatgagtgattttctactgtatcttgggcattttatgagactctggattttattttaatcttctgtttagtaggcctactctgacaccattctggtgggggaatgggagcacagttttattattcagggaaaggtgggagtcaaggttcctcactcaccatccattgatacccagggtaggggtagggatgccattattactaggaaggagtggaatttcaggatcctcactaggcctccagtgacaccactgacacctccctaggcctccattgacaggcctctacaaccatcatatgccgggggactcattactgcctggcaaggatgaaagtcccagatctccattcggtcatttctgaaaccacctcagggagaaggggatgtgtgactatttaaaaccagttgaaggtagaaatctaggctccctacttgatttttgctgagggcagtggagggaggagtatagttttttctgctgtggtgtttgccttggatagggaagttattacctaaaagttttctgtctctctaggctaccccttttctgttcctttggctagagatagccagttttttgaggcacttttttttttttttttttttgcacccatggcattgctgggttgctggcttctccatcaccaggtccaggatacattactcaaaaacaaatccagggaactcactgccatattgttacttgggtcttgagattcctagccaccaggaatagaagaagccacctgcctccttctatttacctgtcagagatgtatgagttatgtatatatatatatttatttatttataatgtccagtgtttttagatatagagggataaataggggaaagtgcatctagtctatcttttcttggaaccagaatataaaagtgataacttaatgaaaatatggatattgtgttagttatagcctttctcccagtaaaaatttagttaggaatggggaaaatcaccacgatcactaccttcactggtatacttctttatttttagcttttttttaaattgtggtgaaaaatataaaccataaattttaccgtcttgatcgtttttaagtgtacaattcagtaggattaagtatattcacatagttgtgaaacagatctctagaacttttttatcttggaaatctgaaactctatacccattaagctacaactttccatttcctcttccttccagtccctggcaaccacccttctaatttctctttctatgaatttgactactttagatacctcatataagtggaattacacagtattagtcttttttgtgactgagatatacattttttctttatccatttatctatcaatggacatttgggtcacttctactttttggctattatagtgctgctatgagcatgggtgtgcaaatatctctttgagaccttgctttcagtacttttggatacatatctggaagtaggattgctggatcacatggtagttctatttttaatttctttaggaacctccagactgttttccacagcacttgtaccattttacaatctcaccagtggtgcacaggggttctaatttctccatatccttatcaacccttattattttctatagtcatcctaatgggtgtgaggtgaaatctgattatggttttgatttgcatttctctgaaagttgatgttgagcatctttttatatgctttttggccatttgtatatcatctttagataactattcaattctttgcccatttttaatcaggttatttgattttttgttgttctttatatattctggatattaaccccttatcagatatgtgatttgcacatattttctcccattctggaagttgccttttcactctgttggttgcatcctttgatgcacaaaagatcttaagtttgatgtagtcccatttgtctatttttgttcttgttgcctgtgcttttgatgtcatatccaagaaatcatcaccaaatccaatgtcttgaagcttttctcatatgtgttcttctaggcattttacagttttaggtcttatgtttaggtctttaatctatattgagttaatttttgtatatggtatatgctaagggtccaacttcatacttctgtatgtggatatccattgtccccaaaatcatttgttaaagagattgttctttacccattgaatggtcttggcaccctgttgaagatcatttgaatatgacagggtttatgtgtgagctttctattctatttccttgagctatgtgtctacctttatgccagtaccatacttttttgattactgtaactttataattcttttgaaattgggaagtttgagtcctctaacaatgttctttttcaaaattgttttagcatttcaggatctcttgagatttcatatgagttttaggatgaattttccttttcttaaattttggttttattaattgacacacagaataattgtacatgtttatgggatacatggtgatgttttttataaatatgtgtagtgatctgagaccaggtatgtggctcagagctgtaatcccagcactttgggaggccaaggcgggggcggatcacaagagtttgagactagtctgggcagcatgatgaaaccctgtctccacaaaaaaaaaaaaaaaaaaattagctgggcgtgttggtgggtgcctgtagtcccagctacttgggaagctgaggcaagaggatcccttaagcccagaaagaggagggtgcagtgaaccgagattgtgccaccgtactccagcctgggtaacacaatgagaacctgtctcaagaaaaaaaaaaaaatgtatagtgatcagatcagggtaattagcatatccatcatctgaaatatttatcattttttttctgttgggagcattcaatatcctccttctagctatttgaaactatgttattgttaactatagtcatcctacaatggtatagaacactagaacttatttctcctatttagctgtaattttgtatcctttaacacagctctccctctcccttaccactacactcattagcctctagtattctctgttctactttttacttctatgaaattaacttttttcaactttcacatataaatgagaacatgtggtatttaactttctgtttctggattatttagaatgcattttttctatttctgcaaaagtgttaggattttgatagggattgtgttgaatgtgcgtattgcttcaagtagtatggacatcataacaatattaagtcttccagtccttctgtctctttgtttatttttgtcttctttaatttctttcaggaatattttgtagtttctcattggtatacttgggttttttgagacaggatcttgctctgtcacccaggctggagttcagtggcaccatcacggctcactgcagccttacccttccaggctcaagtgatcctctcatttcagcctcccgagtagcttggatcacaggcacgtgctaccacacccagctaatttttaaatatcttgtagagacagggtctccctatgttgcccaaactggtctcaaactcctgggctcaagcactcccacctcagcttcccaaagtgttgggattacaggtgtgagccatcatgcctggctctcattgctatccttctatatattaaattaaagtcaactataaagtaaagattctttgctaaatcttgcttttccaataatttcaggttacagaactatgattggggtacttttcattggtcctacaaattatttgctgcttggcaaaattgctgcccatgccagaggctctgcttatttagacattaagccttggctggctcctttacactgcaatagaatgggaccagagtctgcttcccatctttttctttattcattattatgaaattttcctgaagactagtcaccttcagtgactcttaacctgaggccctggcagtactgcataagggttgcaatcaagaaagggagcaccaggctttggatgaagaaactcaaattaaacccaattctgggccctgcttcctccatgaagccttctctgactatgcttcccatgttcatctcccttttctggcctcctataacacttgcctctactgtgcaagctaacactcatcgtgtctcaccaagtagagtaaaaccttggttacttgactctttctgggaaaagggcttctaaaaatttttatttcttttagagttgcattttcactgagtatattttattaattctttattttttaaacattcttaagcaattatttaaaaaaaatagagacatggtcttgctttgttgctcagactggtctcaaactcctggcctcaagcagtcctcacaccttggcctcctacagtgctgggattacagtcatgagccactacacctggccctattcattttttaataattttttaatttttaatgtcttgtgggcacatactagggatatctatttatggggtacatgagatattttgatataggcacacaatgcataataatcacatcatggagaatggggtatccatcctctcaagcatttatcctctgtgttacaaacaatccaattataatttattttaaaatgtataattgaattattattaactatagtcaccctgttgtgctatcaaatagtagatcttactcattctaatttttttgtacccattaacctccccacaaggacatttttaataaccagtttttcccaaatggctcatgatttgatcaatttaagcactgtgagcttttaacattttaaccatcctgaatagtattttctaaaacacaatctacttccctgacttttttttttttttgagacggagtcttgctctgtcgccctggctggagtgcagtggcgcaatctcggctcactgcaagctccgcctcccgggttcacgccattctcctgcctcagcctcctcagtagctgggattacaggcgcccggcactacgcccggctaatttttttttgtattttttagtagagacggggtttcaccatgttagccaggatggtcttcatctcctgacctcgtgatccgcccgcctccgcctcccaaagtgctaggattacaggcgtgagccaccacgcccggcccttccctgacttcttaaacagtatatagaatataaatttgttttgtgtaaggatcattattgtgactgttacttgttgtattatcctataatacactgatattctgaggcctattgaaatgttttttggtgtcttcccctgtactaaatggtccccgaacatttagtctgtgtatgtgtgtgtgtgggaaaccatactaggtttttatgatttttttttatctcttttcttgtcttttagcccttcttgcttctgtcaacctacttttgtaaaattgactccccatctcctagctctgtaggcttgtagtcgatcaaggcttcttcattggacttgatgcctgaagggaatgcttttcaagggtcctgagaggttcagtatttaccttctctagtccatttttttttctttatctacaatcatgttctagtttgaagagctaatttgtgggactaataactaaatctacagaaacaaaaactactgcagactttgaaaccaggtcaccctactttttccttctttcaagctccttgcacactgcagcgctctccaattggaggtttcttgctggggatactagaaagaatagttggtgacaggaagcattttaggcaactctggtgcacatcatttctcatcagagaaacaggcttcagaaggtgacacaagaaaagacactgtccattggggggcactggcaaggagtatttggggcactgacaaggagttcagagtgaggagtattttaaaattttgttatggggctcatgatggatggcagagggtagaaaggggagagcagttttcaggggcagttattgtgaaattcagaattgggagttggggactatggcactatgcatgtgtattagtctgttttcatgctgctgataaagacatacccgagactgcgaagaaaaacaggtttaattggacttatagttccacatggctggggaggtctcagaatcatggcaggaggcaaaaggcacgtcttacatggcggtggcaagagaaaatgaggaagaagcaaaagcagaaacccctgataaacccatcagctctcatgagacttattcactatcacgagaatagcacgggaaagactggcccccatgattctattacctccctctgggtccctaccacaacatgtgggaattctgggagatacaattcaagttgagatttaggtggggacacagccaaaccatatcagtgtaccacatgggtgttgcagatgcagttcaaagttctagattagggaactaaatctagaactttggctagagatgcatctaaaagttgtaattgcgaaaagcaggaaggatgttattaattgtacttctctttacatgtctgtttttagtatttattataatggcattgttttgacttctcagagatgttagaatttgagtatacttgctgatcctgactctttgttgaaagctagatatgtggaacttgaatacaagctttgaaattaaagtactttttttattggctacaccgaggcacaagctcttattaaacgcttagtttggggcatattaacatttcttgaaagtttacaaagcattttcatattcattttctcatttgatcctcactacggccctgtggagaaggtattatctctattttatggctgagggaaagaaatcctaaagagcttaaaagtctggcccaaagtgactttgcagtaaaaggcagagcagaaatagaactcagctctcctaattcataggccagcattctggtattccgtggcattctagtctactatgccctctttcaataagatttggggaacaaacttgttacaaaataaacttaggcacattaaaattttaaagagtttatttgagcagacagtgatttataaattgggtagcaccaaaccacaagtggttttgctccacagcagggatgtgaagggaaaacttataagattcttgcagaaataagacaaagaaactatttgattggttaaagtggaaagtccctagttagaggttagttggtggtttttaattggtaaagtctctagttagaggttagttgttggtttctaattggttaaaattaagtgtcattttgctatttacagtgacttgggtattggttggctcaagtaggaaccaaaggcactggagccatctcagcctaatgacctctcaattaatttttttaacagacttaatgtatttatgtgatgaagatcatctaatgctatagtagaaaagaacaattaatgaatttataaatttgtagtcaaagcaagtctgtaaatataggtagcattctgcagtgctataaatggaaaaatctaataaattagccttatagataatatctgaggcccctaactgcttgcatttagatttgatgtgtatgtgtgcatgtgtgcatgtatgcgtgtgtgtgtgtgtgtgtgtgtgtgtgtgtgtgtactgaggggtgggataaattcagaactatgtttctgcttctgttaaataagagattgtggttagtataatttttacagtctataccagaaataaatctagtatagagacttaccattttcttttttctttaattaaggtattcttaccagcagtaaaatgcacaaattttaagtgcatagttcagtgaaattttatgtatgtgtaaactccacactggaaagttatagacatttctggtccctcagaaggttctgtcttgcctcctcccaggtaataccacctcccaaatgtaacacctgttctgaccactgtcatcatagattcgttttgcctggtttcaaactttatgtaaattgagtcatactgtatctactattttgcatctggcttcttttgtttaacatgatgtctgtgagattcagttccttttcattgctatgtagcattccaaagtatggtacaccacaaattttttaatccatttccctgttgatggacatttgggttgtttctaggtttttaaaatcatgaatagaagttgctatggacatctttgatcatatctcttggtgaacataagcactcatttttattggatataaatctaggagtagactcactagagtaggtatgataaaaaaaagttttaacttagaaaagtcttaatgaaggaactgatggctaaccatcttataagaaaacccactttatgaagagccactattagagattaaaaatgggttcgtattttgtttagcaggacatattccctgtcagacattagagactatttttgcttcacacagtgggctgggtctttcacacttgtgagtagatatttattttcctggtgtctgctacatacggtgcacatcagggatgaggagccctttaattgcaagctgtatcttttttggatggggtcaaattgtcttttcttgggcgatgtggctcaaatgatcataaaataacattggaaaatcaagttcacattacagaaatgtgccttaggattaatttggaatacatcttttgttttgaaagtgaaggtacgtgtgtaattttatgtaatcccaaaacttaactctggcagtatacttttacattacttctaaggtaaagaatttttaaacatcatatgtctgctggcaacatttactaatgaggtgcgatgttgaaagggtatggggaaaattcctgtggtatgggaagagggtgaggtggttgtaaactgaggagaaaactgggaaggtgctccaaagagtactgtttctggaaaagactctgtacttctcccccggtgttgtaacacttcacatgctgtgagacagggaacctccatcctcctcaacagagagaatcacttccggtctttgttttttttaacagaatttaatttgatgatgaatgttcaaagagctaggatttgctttctaggtgactacttggtgcaccacttctattctgcaaattgcaggatacccagactggattttgggtgtatccgaaaccctttaggggccccatgaagtctggcttaagtccagaattctgaccaaggctgccaaggccagcatctcctggctccaccttcctctccagcctcaacccttgccagtccccgtacagcatcactaattccacagtctcttagccttctgcatttggtacaagctttctttgtctggaatgtcctttccctgatgaatttgcttaactctcactcattttctaaggtcgagtgctgccatcagctttctttccacagcctcctttatgcctcggattgacttagatgtccctcttctattcttccttagcctcctatacagatactcatcacatactgcatcaaaattaactcttccttctctttcttcccattagactcagaattactaagatatgttgctactgctaaggcctagcacagtactggttacatggtaggtactcagtaaaggattgttaaattgacatttggatggacatataaaccagcttttaggctttttttttttctgtacccatccattcaacaaacgttaaaccttaggagaggacttattgcaaggcactatgaccagagctgtaggggatagagagatgaacattacatggactgagactttaaggagttcatttcaatagcagagagataacatgtccacaaataacaataatctaaagtagaaagtgctcagtgtcataaaggaggtataaattaaggactgtggatgtttagaagaaggagcaagtactccttgttgggaaaactgaagaagaatgattcatcaagaaaggagcatttgaggtgggatttaagggcaagtagaacatgaatgagcaaagatagaatctcctccgtatcatgtgttttattttgactgaaaagagtagatattatgaaggagtaatgagtaatgggaaacaactggaaatttacgaagtgggccttattagagagggctttaagtgccacgttgatgagtttatatttgattcctgtcaggtggaacagtcttggaagcccatggaagatgtttagcattttattgtcaacagcagagagatcctgtaacattagtctggcaatggcatatcttagtaaatcattattaactaattaattgctaagcctatagttttgctaagtagtgtggaaaaaccctaaggcctttagctcttttacatttttgcacctgtcttttctcactggaaatctagatgaggtaacagattatatgaccaattagttctgaaaaatgaaaatagaaattgacaggggaaagaaacactaccaagacagaagtgcctcataataatgtatagacatataaagtgttgtttgcttaggaaccgtgtccaaaacattgctttcagctgtctggaaaaatccagacacagtatgtgaattatattgttaatatttattcctctgggagtagtttagatcactttcagttaaacataactataatgttctaacctcagactgtctgctcttattgtcccttataaacagtgggtattgcattgtcagtttgttttatagtgtgttatataaccagagcatctggtttcttgctgccttaggccgggccttcaacactttatgcctggattgttgcaacgactttctcattggtctccttatctcctgtgcttagaatccagctttttttttcataacagcaatgtatagtgggaagaatactggatgaagagtaatattaactgggtttgaatcttgattatactgctcactagctatatgatcttgggcaagtcatatcacctctctgagactcagttccctcaactctaaaatggaggtaatggtccctgccctgtccctctcaaggggctgtcaccagaatcatgtgaaagtgctctgaaaactgtcaatagctttaccaagagttggactccactggctggctttataccttccagaatctagtcccatgccacctctttcatctcatttgtcaatatcccccagaacctaccccactctccaatgcatgtaaatgtatggtgctgtcatctggaatattctctcctcttgtctctgctcacccaaattcaaggaataatttaaagaccagtccaaattctactcgctccttaaaatcttccctgatgactccagtgctcaatttcctccttttgtgcattttgacagcacttagttattattaacacttgtctgtacattaccctttattattaactcttttacataaggttcctatctttaattcgattatgatattatgatgccttcactggttcatttaacatccagtgaatgtttatgaggatgcttcctttgtattcctcatagaaccaagtttggaacttaataaataattgttggttcatttatttagaagttcacatacagactctcttaagagagacaagtgaacacatcttctcttcctagggctcggggtattcctcctaacaccccatcctgcctccacgtactacagaaccataaaaaactccttataataaaactgtccagtaaatttttctgagattctgaaactgttctgtatctgtgctatccaatacggtaaccaccaaccacacatggctattgagtgcttgaaatgtggctagtgtgactgaggaactgcatttttgtctttaattttaattaaacagctgcatgtgactagtggctactgtattggacagtgtaggtgtggaccggtggctttctaacttttttttttatcataacaacacaatgagaaatacattttacattgcaacgtggtttttatacacacaaacaagtttcatgaaacaatacttcttatctgcagtatactgatcttttctattctattcaatttcattttttaaaaatgctgattgcaaccccctatatagatttcaccacccactgataaattaggatgtgctgtttgaaaacacactgctcattttatagatggagaatctgaggtccagagaagtgcagtagattttctaaggtcatatattaagtggcagggcaggactagaacacaaattttggggctcctagaatagagctatttctaacagggatgtaggaatttcctccttttccctttccttttcctccttctcctcaccatgctggatattaaagaaaaataagtcgacacactattcattttgattaaatattttcatggtgtcttgattcctaaatgagccatgagctcagtatttgagtattgttgctttttagtttggttattgtccaaaatcaaagatacagtaccatggaagctttcttttaacccactgcatggcttggcagcggcactaatgtgaaactgtcctccttgggaattcaatcatgctttcctccaatttcccagtaacaactgaccagcaggttgattctaaacaacaaaacctgttgaagaatcaaggtgattctcacctcagtttgtgaaaaaggtgcctctagtcttgaattatattgccaaccaaatatttttcttcatcagtacatccagtgtgctaccctttttgtatgccttatcaacaaaaacgatagcctttacaaaggcggcatcctctgagcagcaccttgttatcacagaggcatctagactctcctttcaaagctagtctttttatccttctggaaatggcatctatcaaaaaagagcagagctatcttagcaaaggcaaaaagaggcagcaattcagaggtgcagtggtctatgtgttagtacattcctgaccagtttgtgtatggaatctcatttccccatagacgtttccaaatgcatttcactcagcagacagcaggcagcaatttatccctaagtgaaaacaacaagaaaaatacacttaaaaagggaataagattttcaaaagcctcactttaaaggaaacacagaaatagcccaattttgcattacatttgtcagtgggattaccattatgtcagtaggatgaattaactgaaatctgtaagaaatgtcatattttctggggccaaattatctatggcctgattaatttttctagctgaaaaccagagtcttatagcttaacaattgtcccttgctaaccagactggttactttgctgacttgccctgaaatttatcaggtgtagcctcctctgctccaccactgctaacaccagtcagttaaatagaatcccataaagtcctctctagctgaaggataactctttggttaagattctctaatgtaagtttgaaaatttcactgttgtcttaggaagtcaaagtttataccagtctgtagagaaatcattcatgtcttttgcattatttgacaacctagcattgctaggatgtgacttgctgagtaaattcaagaaaacttgctgttttgattgtgaaaatccacttgaaatgctaagaatttttgcccaatcttctgttttctaagttcttggttgtcagaaaagcaggtcacagggtggaagacaaatgaagatggggcaaggcctgtgcacaggtgagcagaagctggggactaacaggggagtaagtgaacccaggaggaaggggatgaaagcatgttgcaggctgggccagagccttggtcttctggctgtcttcctgctttcccaggccctgctaattaacctgccatctatcatgcctgttttcaaaagccctgtgcaggttgactttcccttcactgttttttaaacccctgtccacaaatccactgagtccaacagattctggctagaccaagcttattatctccctacccacccccatggttttctgccaccgtttcatcaccaacacttgaaaactacaagttatttttgactctctctcactctcccctgccccaccctacactcagttgcttgccaagccctttcggtgttccctcaatcaggaattccctcccgtcccccttaccacttatatcttatttccattaaggctcagctctgatgccaccttttctaggttgtagaaagcctattcacccccagttggaattaattactgtatttatttccttttctttccctgtcttccacatcactttcctttcacttattgcacttctgttagttgtttccagacctagcctctccactaaaaagcttttggaaggtggagactgtatctcactgatgttttaccctctatacttaacacatagtaggtatactctataaagtttatggaatgaaatatgaatgaatattcagctgttaccctacctatcccctgtggatgttgtcccaagttctttaagatgtgatttgatgtatgcattgctgagaaggctgttttagcaccagcagtgtcctggcatgctgttagaattgaaagacctataaggaggttatcctatatctcagacccctcctggccctgagattctatggccttttaatttcactttagagagtttgtggtgcttctttctttagcacaagctccacagaatctaagatgaattgactgaaattcatgtcatgaggtataagtgtttttgttaagccctgtcagaaaatttgtttttcaaagtgattttctcatttacttgcaattttccaaataacccttagaaatgtagtcaattgccggaagccatattattaaagtaagacattggcaaaaatggcagagtaagtacctctgaaaattctctccataatagcaatgaaaaaactggcagaaatagcatcaaatttttcagaactctagaactaaaggcttgcagcaatccagggaacatttactcaagaaaaatggctgcatgttgataagaccagtgagctttgtggcattagtattttcattcaccctattcccatccctttctccctggcttcaaaatcaatagccttcactcacagggaaaaccagcagcctggcagccaccagaggagacagaatagggttgggactcctttacagcctcatttctagagaattgtcattattcgatctgtctggagttcccccagaagaccccccacttgtaagactttatttatttggcctgacacagagctacagaaagccttttccccagggcctttcttttggaaaatgattagaggcagtcaattaacttctcagctgcctgaagcaatggataacatttccagctaaccacaaagctttgaagaaaaagctggggaatgagattccttggggctttggaaagcttgggcatattcctgggaatctacaagattacacgcatgcatagggctgtgcacatgctccggaaagacctcaataggtcctaagctctcactctggctgatcttgagcttggcataagcagaaagtgaagacaaaggcagaagacattgtgtggctgagtgttgaagacatgccccaacatgtacacagagtcccttggccaaaactgggaggctttttgtttccaggaatttaaggaaatctttgtctaattatgagctggccactaaactaacccagcagagacttcagtacaataattattattaaagtacagtggaacagggtgaagcctgttgtccctgagaccttgtagaaactaattcttggtccaccaagttatagatttgtagctctgcctgtatagtccctatctctttaaacagacagaaaaggcagggaactcatatcagcctgatatctggtttgtttatttttaaaggcaagacaaaggtagtttgtgaaaaatttaaaacaaaaagcattgctgttaatcagaagtaattgtattggaaatgatattttacttctgtacctcatccacttcccagattgctttttcatatgagttctccctatgtaggacctgttcctctttcctccctagacccccatgtacataatcttcccatctcactgcttcttgcttctgttaatttcattttctgttctttcatttgttctatacatgtagcctcgattcaaggatggctgtggcctcacatactgcattcggggtgtctatcttttaagagaagaatcaagaagaatagagactgtaatgaccttcttgctggcctagctaggcctgagagggggtgaagtgcaagagtaaaattctttggctgccattttgatcagagccatcccaaatgaagcaaggcagttgtcacaagctttaaagggctttactaatttgacgagataactggccagtgactcactgagacagggttggcaatagagaaatggtatttctttggccagtactaaaaaaagacccaaggcttatatgcatacatgctgtacattcatccaatgccatccatcctcacccctaccaaggcaatgccagagaggttgcccttttcctacagtctactcaagttacttattttctgattttctttctctttttaggctacactatatgttcatttaaacctgatttcttctgcctgtgaggggtagagggtagggtggggaggtgcacagtgtgatttgccctgcctcagtccaccacctcctggggatggcctgacctggataatcatttttagcctggtatttcctgggcatgggccaggggctgaggccagcagcagagaggctaagatggcacaggctccctgtcagatttggtagtgatgaattttcactggggaacaaaatggctgtttctaacttctttagatttgaaacactgcagagactatcatcttaataattaaaatatattgaggagaagggctacttaaatccttgaatgactggaattctgtaagatattttaagaaaggtaatatccctggttaacagtgtttctttttctttttctttttttttctttttttttgagatggaatcttactgtgtcaccaggctggagtgtagtggcgcgatcttggctcactgcaacctcggcctcctgggttcaagcgactctcctgcttcagcctcccgagtagctgggactacaggcatgcaccaccatgcccagctaatttttgtatttttagtagagatggggtttcaccatgttggccaggatggtcttgatctcagctgtgtttctaaaagtacttgtacaaattataatttcaacttccaacaaaatatttatatgatcagaacagactcattttttttttatcagaacagactcatttatatttaggagcatttatttctatgaaaacaacatgccctggccttagaaaacaaaaaataaaataaaacaatttatcctttcaagggatttcttttagagaatctctgcagctacttgtagttgtacaaatggccccctactttctctgtgttcccttcctcacaggggctgaggagcccccatgagttgagaggtgtatgttgaatatcttagctttgaacttgaaatatattttctcatagatatagcaccataaactgtgaaataaactatcaatttaaattttctagttacagattaaaataggttttgtggactagcttggaaatatatttactgtttataatataatttctctcagaaaattattattatttatttatttatttaaagagatgggggttggcactgaaagttccaagcttctgatcatggcttagtctttctggtaaccagcctccatccagaagcccaccaagagatacttcattagaacggaagatgctcttatcacccaggaaattcactaggagctctatgtcaggaaccagggagaaaggccaaatttcagaagaaaagatgcacgtagcatccctgtcactcaccataacaaaggttttaggagctctgtgccagaaaacagtgatagaaactaaatatatatttcttattatatcttaatagtcatctgtgaattccaagaacaagttatgtttactgttaacttcaagatccttctttgcagaagccatatgtgaataaaatggcaaataaaaatactgtgaaaacatctggcctttcagctaaaatattaccatatacacaggtgtacaaacattcaggcttgtcacagcaccttccaagccactggccactagaaacctcacaatacaaacctcatgatattccctgtgacatgggcaggagttaggtatgcaggtattgtatcacctcaacacactcagagtaggggaagctcgataattggctatttacaaagaaggccccatggtataaaatgttttgaagtaactgtggccaaatgattgtttagagatggtgttaaatgggaccttgagaaagggaaggtcaaaagagatggtcaagaggaaatccttcaactaaaggatttagaggtcttgtgagtgtgtttgttcctcaaggaaaaggaattgtttccattagattcaagctgctgacctttcaccttcagggtaaaggtaataatcagtcaaccacaaagataagccccttctattaaattttacttgtttctttccttttctttcagttttatccaagtatgaagatcagattactattttcactgactacctagaagaatatccagatacagatgagctggtatggatcttagggaagcagcatctccttaaaacaggtaagatttggtagcatttgtctgtaagaacccagatgaggtaggcacctgtggttcagggtttgtactttttcttcttgggttggcagagcattgtcttgctcaatgttaatgctactctgaggtggatttaacttgtagtcaaaggagcttaagcctcaggacttttgcttggacaggccccttccaaggccctgaaaggccctagtagtgtgtttacatggttataggtttttgcacaatttgcacaagtaatatatttttattcttttccttaaaggagaatccccaaattctagaagccttgggtttcaaaaaacacggacccactcctggtatcactaatcagtctctagcctttcgtgactggtctacatatttattactctcacatgcttgtctggctagataaaaacacccaaggacttctagacaacccatggacctcagaaacaatatcagacctaagtttttcttaagttttagatcttttgctgaccgtagcactgtctcagtttattctgattttgtatagaacttttagccactgcagctagatggaaaggaggcttgaatttttcttccttaccattacattcttatagattgggaaagaaagaccttttaacctgaaactgctaacagcccagcacccagataaagccagagcttggaaagaggcagctctgagatttgtgtctttctgaggagacatcctcttcagaggccctcacttagcgtggaggaaggaacaggaagaggctgatgaaaaggcaggagaggaagttaggcattgtggagctcctcctgagcctggcttcattattttgattggagaattctgaacagtggaaagcctggagctagcaattaggagaccttttgtattcagactcttctaactcaggtaagtcactgtctctttctggatcttaacttccttcagtggtacttaaaatgaggggatttgaggggatctcttctaattctgcattccatgacaacaggaatccccaggttgccaaatctactcgtattcaaatgttaaattgggaaacgcctcttaaaatgaaatcattgctaaaatgtccatacaactttcccagcgtaaagccacacaggaaggcataaagactgtcagaggcaggagtgagggtgtggacatttaagaggacgagcacataacagctaacatctgttataggttcactgcatactagtcaccatccaagcactttaagtgtattatcttttgaatactcacaactcaatgaagtaggtactataattctccccatttatggatgaggaaactgaagctcagagaggttaagttaaccaggttacacagctggtaagtagcagagtcagggttcaaacccaagcaaagtatgacttcgggtgtcttactcttaaccattatacatctgcttccctgaatatgctaggcaccggggcatggaagggagggaaaatacagatagctcaactttccgatttgctccaaagaaaaggaagacagaaaatagaaactattggctaaaagtagatttccctttgttctttttaagtgcagtgactataagttttatacagaatataatacagacatgttgagaagagggagagaggtgactaagaaagacagccacatctaagtacagataaaaatgtggaagccatatttgtggcccatcaaagtaaatttatgtcataaaatacaagaaagcatgctttgaaaaaagacacaaaaacatttgtgatattatatatgcatttagattataagtgccagttgcactagttgctatacatttcttacacacctaatttgcttagtaagacatttcctttttatttaaacatgcatgtgtgcatgaacagacacacatgcatccacacaaacaagccaacccctagtttttgttttgttttattttattttgttttgcttgagacagggtctctctgttacttaggctagagtacagtggtgatcatagctcactgcaatctcgaactcctgggttcaagtgatcctcatacctcattttttttgtagagatggggtctcactatgttgcccaggctggtcttgaattcctggcctgaagcgatctccctgtctcagcttcccaaagcactgggattacaggtgtgagtcgctgggcccagccaaacctctagttttagataagggatgatgggtgctgatgcaagatccaaccaaccatcattcaggctggagctgatagtcttgttagtgggttctctaggatccttaattttcttattccttgtcttttggcaatgatcccagtgtttgtaactgccaggactgtggaactcagtgaaaagatgacaggagctacccaaggtcattataccagtcaaatagctctggtcaaactataggttgggagaaatactgaaattatttggctaaaataagaatgggtttcctgtgaatttacctagccccataataatggaattgactggttatttgaaattaagttagtagctggctcagaagtaaaggtgggtatttttagatatggtgatttaattttaattttacatttaattacagaaaaatctaagctgttgtctgatataagtgctcgtctatggtttacatacagaaggaaattttcaccaattggtaggtaaatcatttgttttactgtgctttattccttgtggatagcttgcctgaggttatcagtgacttcatagaaacctcagaattaacagttcactatagcaaagaatttgattgaggagactaggtaaatcttacacttcatccaaaagtttcattgctaaagtatcctttcacatatggctctatttcattgagggattatgacagtatacttttgacaccacctccaagtgttcaggcaccagatgatattacttgttatacttttgagattaagggggaaaatcacataatcttttaatttgtataatatctgttaaattacaatccactgctttgtggaactacatgattattaatgaaaattgtgtcttgaaagaaagaaaataatttatttgttttttttcccccttatgacatgaaagcaccttgccattgagagacaaattacagtagtttccttggaactaattctaggctgttaccagctgtcaactagaaaaaaggacagctcaataggtgaagtgaatatgctgtcttcataaaggatatacaacacatttgcaagtagggtggccacttcctagtatcatggccctgtaggaaaagggcctacaaatggtgaaatctactcttctaagaggaaactagaatgaaatcaacctttctgttcagtgccaaaaatgaaggtcacacagacttttcttttctttctttttttttttttttttttgagacggagtctcgcactgtcacccaggctgcagtgcagtggcgccatctcggctcattgcaagctccgcctcctgggttcacgccattctcctgcctcagcctcccgagtagctgggactacaggcgcccgccaacacgcccggctaattttttgtatttttagtagagacagggtttcactgtgttagccaggatggtctcgatctcctgacctcgtgatccgcccacctcggcctcccaaagtgctgggattataggcgtgagccaccgctcccggccctttttttttttttttttttattgctctccccagaaataccccagtcactaacaaacaaaagaacaatctttagtaaccagtggttctgaactgttaactttctctggctgaggagctctttgcaaggctggaaaatatttctaattttactctgccaatattttggcaatagatgatctcttctttatgtgggcctcattgcatcttttccatactaatctggccaataatcccagcattagcaagagccaaaaggcaccccttccaggtcataaattggctccctccttcccatcttcttgtagtaactctccttcagtccccacaactaaaagaaaggggtgaccaccttgacccacttgtcctacaaggttgatgaccccctttgaagttagtcttctgagatcatgtttagcatatttttccacttccacactgggaaaagaaaacaatgaaaacaaaatatcctctctgccatacaagttatctgatttcattggccccttggaaaaggatattgagctcaccctggcctcaaatgtgggattttctttgcataaggtgttcttaaaatggaacctattgtcttatttcgtttattaactaattttataccttttaaagatacatttctaatttattaatatgggtttaaattatgatcatactcaaaacatcaagtatttgcatcatcctctatgggttctagaacactttcacagatattctctcagttcttacaatacccactgatagtaggcagagtatgtactattatgctcagcctataggtgagatttagattagataactagagactggtcttctgatgcctcatctagggatctttcccctattttacaatgtccttcttgctgttcagatcttcatagtgtatattcagaatagtcatgagccttccaaatctctttgaccattttgatgattgcctttggtagtatttgttctttatctaagtaagactggcttccctgagaatttcagggccatgcaagtgagctatgcaaggcaaggtttgggtctggcagatgatgacatggaatggactaagggttggtattcatacatggcagtcacctaccaaaattgcatgtatacctagaagtcttcaagcagaaaacataagggacacatttagttcatttgcttgttttatgtttggccatagaacctgttttggttgactcagcactatgtttgcaagttccaaccatatacccaaatcttgtttgatctgtgggtgtatctgtcacctcacttttcagagtatatatatttacctgtcttgtgtgagtcccaaatatgctgatgtttcaggaaagggcaatttgaggaacccatattaattcccttccattttgccaacaggtggaacgggcccttcatcagatgctggttggggatgtatgctacgctgtggacagatgatgctggctcaagcccttatctgtagacacttgggaaggggtgagttaaatttgttttataaactttctcagagacctctgcagtatcacttgctgctgttgatttagcttgatgctgagccttgggaacactcagtaacaaacttgagggtcttaaaatgctctctgcaagctcaagtggtggggctgacaagtcaacaaagcccctcataagaaggaaacagctaatgtttccttgtgagtcaccaagccagggagttattttcctgggacagaactgaacatcgagggaggtatgtcatttatcctttccatctttgctattgtttgagtaagtccttagaaatgcaagataacaaagggagcaggaagaagggtgtggtgattaagtctgtttcttgacctcatttaagatatctgcctggtgaaggatgtaagtgacctaaaggaagtgcatagagggagctggcgctattttggttttggttcactaaggatgtccagctgatgatgaaggaatctttaaatttgcttccttgggaggacatttaattaagaaagccttctgataatggttgttggaactattttttttttttgagtcggagtttcgctctgtctcccaggctgcagtgcagtggtgcgatctcggctcactgcaacctctgacccccgggttcaagcaattctccgcctcagcctcctgagtagctgggattataagtgcctgctaccacgcctggctgatttttgaatttttagtagagatggtgttttgccatgttggccaggctgatctcgaactcctgacctcagaggatccacccgcctcggcctcccaaagtgctaggattacaggcatgagctaccgcgcctggctggttgttggaactcttgagtcttgctttcttaagacatgtacatacttccctatgggcatctgaaggatggggttggctggatgccagttcaggcacttgggtgaaggtccagttggacttggggatgagagagcgaaaggacactttggatgagattgggctgctgaactcattggctgttgctaattgaggttcagaagtatagaaacatcgttttccttttcccactgtgcaaactcacagattttgctacagctttcagagaggattggagaagggcctagggaggtttcagggcttgttaccttctcttcagggtttgggatatcctgcttcccctggatagtataataatttccattttacagatgaggaaaccgaggctcagggaagtgatgtgatttacccagggtaaaacgcaagaaatcaaagatttggggataaaataaagatattccaactccttgtccagtgatttcccttgtttatacatgcttcttggtgtagatccattcttactatttaatttttttttcatttataacacacttcaaaatgattattttggaagtgagttctggaagtagggagcaaactggaaaaaaaaaaaaaaaactccacagtcagcaatctcaattgtttcaatacaaaatcaagtagcaggaagaagttggaaatagatcttgtagctaagatgagttaaaagagtaattttgtaaagatgtcttttggattgtttcctattcagctattttaaaattaaggtagagtattcacttgccattgtcgtcagtgaatatttagtgctatttagcagccagctaattaggatttccccagacttggacaatttggtagctaatgaaaagaagttggatgtggttcaccctctgagggctgtgctggatccaaagttaaaaactttggttttagaaacactagaagcaaaagacaactgaagagtctggagataatggcctttggcttcaagtgtagttcagtctttatttcaaactctttaaaacctcaggagaaaaatttgtcttggacgcaaactaagcctcaaaaatctgtcccattagacagcgtttctagagctgagaggattgcagtgattacatagggtttttgcagttgtcctcagcaagttacgaatggcctctgtaggatttagggggctgtgctgaaggcacagatggtatccgtacagatgcagttattttggcattggtcttagggaaacattgaacacctgatagcaaaggtatttgttttcccaaagctcagcatggactttttaaaaggtggtgtaaaaacgacagcatgcaatttttttaagcttccttagttgtgagctatgtatattcccctgtgaactgtcgtatatcagaatagcacttcttacccgtgagatccttttgtcaatgctgccaaaatataagagcaaaagccattgctgtctatgtggagatgagatgctatggcatctggcttatataccgatgtactgccgggctttgtggtgacctcctgttcactgagtaactggccagaaaggcctttgtgacattgtttttatgtaatatttatccagctccagcccttgggttaagtcagttccttggtcaactttttgttttgcttttactttatacccactgagtccttgaaagcaatcactttccagatgtctttgtcatcaaaatgaaagatacttagaaatgttctaacttggtcatccctgccttctagatgtggtgcctttgtttttcttctaactttgtagttacaataaaagtgcagagaggaataaacagttataaaaatgtttctaacccatttttttttcttaaaaagactggagctgggagaaacaaaaagaacaacccaaagaataccaacgcatcctacagtgcttcttagatagaaaagattgttgctactctatccatcaaatgggtaaggtcataaatcaatagtttaaaggcagtgcctattcctgttccttctcttcccttgccttatatgtggctccattaagttgtccatctgcttaattatttatgcaaaaaattaagattttgtggcttattggaagatcttttgctaacatgttatttttttccacattaaaaacagcacaaatgggtgtaggagaagggaaatcaattggagaatggtttggaccaaatacagttgcacaggtgttaaagtaagtaaaagagtctggcatctgccttattctgctgtctcctatgcttccctccctagacaactaaacctcccatcaaccgaggtattcttgcaatcccgctaagctactcctcccactaaaccatcaaatatctgccattttgctcagatggctctttgaaatgtgtaagcatggatatctgtgttggtgtatcagagttatattcactggtagcagtatatgtggctgtatcctaggactcattcagtgtctcatgctacagattgatgctcatgtgcctgggagccattggcctgagggtccctttgaagccaaaagtttcatactaagtggtagaggctaagccagcctaagcaagaaatggacccccacagggctcccacatgcactacataatatttaaaaaccctgttcattcagcattttctgtgtacctttactgtgctaagttctgggggtgcagaaataaacttgacacagtccttgcctcaaggaactcaccacctgttgggggcgacaaaccccagggaagtcttggaatcagtttgtcatctcatagcagactcaaggtgtcccagtgtggtatttttccagttgtcttgttaaattccagaattcacctcccacagcaagaggcaaggtggagaggtcaggaccaactttttgaaagcaaacagggtgagtgatgttagtacttacacctgcagaccaccttacctgttgtcactctccttcctaacaacctatcactggatggaaactccatgagggcagagattgtatttatcttgttcactctgtaacactagcacatagaactgcctggcatgcataagtactcaataagtgctcgatgaatacatgaaaatggccgccagaatctgaggccagatttagggatcagaagattgaaaccttctggcctcctttggtgtagaatattaagctcctgggcattatgggggaacctgttccatgcaaagtacagacaggaccctgtttccattactaaccagtcttcagtgaactagaatgctttgggaatgtgtctgtgaggacagtggcctggattttttggggacccaaggaaaatctgtattgactttactccttcctaacaatgtaacctctctgaggctgctctcttgccatagtcagagtgccttctgggcatcgctgactctgctgagtgaaaatctggtaggatttcaggaatcactgtatgaacgtagtgtggaaagtataagatattagaatggctgtgctgagcccaaaactcggcttgaaatggttggtgttaaaataacatccctcagaatttgcttctttcttctaaattttaagattaccaacaacaaagtggaaacctagattttttttttttttttaggacagagtctcactctgtcgcccaggctggagtgcagtggcacaatctccgctcactgcaacctccacctcccagggtcaagcattctcctgtctcagcctcccgagtagctgggattacaggtggctgctaccacacccagctaatttttgtatttttagtagagatggagtttcaccatgttagccaggctggtctcgaacttctgacctcgtgatccacccgtctcaacctcccaaagtgctgggattacaggcgtgagccaccacgcctggtgtagatttttttaaagaatgtaaatgggttccaattcatcatgatcattagcattaacaacaacatattattattattattatattattgttattattctggggaaagataatacatcaaaatgaatgaaatacaagggtgatggtagttaacctctttctgggagctacctggtagagagaatgtgttttctttggtccagtgagactgggttttacccacacatcccagacgtagccgggttaaacatggccttacttaactggcaaggaaagaagaaggaaagggagaaataggcagggtactttacatagacttcagatcatctctcttttaaaggggttttctttctaatacaccataaagtcctacagttcagcatggtggctctcttcagctgctgaccagtaaagcttggcacccgagtcaatctgcagcctatgtcacttgagaggcactctcagggcagctggggaacagtggaagtaatctctctctctctttcccctccacccactgtctctatctctgggtttacctggaacatattctccatattatctatgatcccaaacaaatatctattttttacggacagcttcctttttaaaagtttttttacagtttcccttttgtaaaataaaaattcagtaagtcagaatgtcttttatttaagaaaacaaagtctcttgggactttgagagcagatgcatgggtaacttttcttttttccccagtaggtgtcccgtcattttgtgaagtagacttctccaggttgtaaagcagaaacttctttttgaggttcagatacagtgactctgtggcattctcaaggtctctagacatggagcatcccagagctctggcaaagaagccagagctgacctgaacaccagcttttctatggctcagtgtttggtgactttaggaacactgggcataaattgtactgttttctgctgatatttccatcttcccaaattgtgacttcattatacattgctttgcagaaaacttgctttatttgacgaatggaattccttggctgtttatgtttcaatggataacacagtggtcattgaagatatcagtgagttaccagcctgtttaacttcccagctgatgggtgatgagttcctccctcaccattcagtattctggggctcaagagagtctctctggtcttccccaccagggcaggggagcttaggggagcacagggctctgattctctttcttttcagctttctgagagggagaacaccattagaggggccttgctcctcctcagtgaggtaccacactccttccctgcagaaaacacaaagtgtgtataataatttattcaaccaccaacagatctttcatggaggctcacccttgtccaggcgtgtgattcctgcactgaggagtgagagcaacctaaagatacagtccctgtctcaaaggccctggcagacttgagaaatgagattcttccaataagcccagaatccctattgggagctaaacaagtacccagtggccagaatgaagagcatgagccctagaggaatggcctgggctttgtgcaggcggggagtcagctgagccctggtggcagaggagagggccttctaggcagggtggggggcatgtgaggttccccttagttttgatattggaatatcttctagggctgaagactccttacttatccaatattctgttcttccatttctagaaaaaatgtgccgtgtccttcccttgagtgctgacacagctggtgacaggcctcccgattctttaactgcttcaaaccagagtaagggcacctctgcctactgctcagcctggaaacccctgctgctcattgtgccccttcgcctgggcataaaccaaatcaatcctgtctatgttgatgcattcaaagtaagtcacttctttccctgagcccattgctgcctgcccatcacaccgccatctcagcacagagatccgtgagcagcagtccacaagtgagttgagaatcttgcattgtctttctctccaggagtgttttaagatgccacagtctttaggggcattaggaggaaaaccaaataacgcgtattatttcataggattcttaggtaagaaaggaggaatcacaagtaagtcatcgtgggctaggggagggcgtggggacaaggtttgcatgggagaccaggcaattccagttagtgggttcccgtctagcccaggaatgccgtggcctctggtcagctccttctgtctccggcctaactgatggagagtgatgtttctgtgtgcctgatggaaagcaggtccaatttcaatgccttccttgcttcttgataagatggttccattgctttcccactggatagccccaaggtcatagcattgctccagcatgtctctctcctgcctgtggggcccagggtggtggaatttcaatcccttggctttgccaatatctctcttattagggcctgctggctcattgttcagagctgtgacaggttgggaattggaggaggcaaagacagaagtacccctttcccgagaatgggggctaagccttaaaaccactaacctcttaatgtggacccgagcaagcaacccaacattccctgcataggaaggcacctctggaaacccagtctctttactcactagctgtgaccagagacatctgaggtccttggtacacaaggtaagctagcctagtgcttctgaagctttagcatgcacatgaatcaccttgagagcctattggagtgcaggttcagtaggtcttgggtgcggcctgagtttctgcatttctaactaggtggtgctgatgctgctggtccacagaccacactttgcatacccagggcctaaacacctggttagtgttgaagagcataagttagagagtgatgtggccaggaaaagttggtacaggacacctgttgcaggggtggaatggtctgagacttggcctcaggaaagttatgaggtcagattggttgacagacaaaggagagctacaggagttacaagggaatggcatgagggcacgtgcaaaggacagggtggagatggccttagttatcctccccaacacatctcctcttggacattcagggaggtgaggtgggatgggaacagacacacgtggctttgcatgccaatcccccacttgctagctgtgtgacttcaggaaaaagatatcaatattcagtctcaggttccttttatgtaaaatagggctaatgcctgactcgccctgttgtcatcttacagtaaagtgttcatcaaagagccaggcatataggacagtcactgaaaggtggctgcaccttgctttaccccaatacctatttcctttgccagccccttcttcctctctttaggttggggggtgtggagcggggcgtggggattgcacagctgcctctgctctctctaatgctgccatctattggttgagcccaagaattacagctaaatggaaaacgtggagcctgtaaaggcttttatttttctaagtataaaacctagtgtttggagttctgcaaaatcagatgccctctgttcctaagcatttgggttcaaagaaaatgttgcaaaaaatagatttccagttgctcatgcatgacttagtctcttcaggcggctataacagaatagtatagactaggtggctttataaacaacagaaatttatgtctcactgttctggaggctggaggtccaagatccaggcactggcagatttggtgtctggtgagagcccacttccaggttcatagatggctgttttcttgctgcgtcctcaaatggtagaagaggcaaaggagctttctggagtctcttttatgagggcactaatacattcataggggctccaccctcatgactaaatcacctcccaaagaccccacttcctaataccatcatactgggggttaggatttcaacatatgaattttagggagacataaacattcagtccacaacagtgtttgaggacagctttgaaacagattagaaaataactttggaggaatctcagtgaatagtgtgtgtgattcctgggtgccctggcctccctatcccaagttacctacagagaatttctccaagttgatgtagccctcctgtttcttgaggccactgggtcagagtagcttttgtgaagtttgactactcattaaaaagatgtgggcaatcctcagttctttaataccccaagacagaggttcacatagtgcccatttgcctgttaacttttataagtcctttgtgcaaacttcacttgagggctttaagtccctctgactccccttttctgactcacacccttactgtttgaggttgagtggtccagattggcagaatgtctgaagggagggaagagatgcaaattgccattttctaaatagttgtcctgttccagagacttcgcaaagtatattatctctctgtctacacatatatacacacacacacacacacatttatacatatatatacatatatatacattatatatataaaatatatatataaaatgtattacatatacgtacatatacatatacaaagtattatatacattttacaaatatataaaatgtataaatgtatatataaaatacattgtatatataaataaatgtatatataaaatacattgtatatataaatgtatatataaaataatatataaatatataacataaatgtatatataaaatatatataaaatgtattacatatacatacacaaagtattacatatacattttatatatataatgtattacatatacaaatacatacacaaagtattacatgtacatatacatatatacatatatatacatatatatacacatatatacatatatacacatatatacacatatatatacgtatatatatacatatatatacgtatatatacacatatatatacatatatacatatatatacatatatacgtgtatatatatacatatatatatatatatatatatatatatatatatatatcactaaggaatggtgccatattgagggctcagtgttggtctgtgctgctggcaaattgggcactcagcaggggctgtagccaggtcagccttggtgagtggaagtccatgttgctgaacccatgtgtaacctctatccctgccaccatggccactttgttcatgggcccattgggtgatgacacgggtggctgaggaaaaaggctgagtggtgtccacagaatgggtcatcctatctacttgattattaatcaagaatacacacaatatttctgtgaggtagagactgttatttctgttttacatgcagtgaaactaagagctaaaattaagagagattaaaaagttatttcttcaaggtgattctgttagaaagtggtgaagccaagagtcgatcccaatttgatcatctctacctaccaccttccattgctcccccagggccctcctgcccagtgggaagctgagagagctctaggtgtgggaggatatggccaggatgacactctggccttcaaattttgcctgcttagagagaaggagatgttggttccttgcacttgggtataggtttccacctggagatccatagcattagccctgtctctgcaggtggttggtcagcctgccttttcactccaggtctcactggagacctttgtttagtccccagatcatttctagagctttttacatctattgtatatctttttttaaaaaattttgttccagattcaggaggtacatgtgtttgtttgttacatggctattacatgtgtaatggtgtggattgggcttctagtatacctgtcgcccaaatattgagcattgtaccccaatggatgatgattagataaataaaatgtgttatatacaccatggaatactatgtggccataaaaagtaatgaaatcatgtcctctgaagcaacatggatggagctggaggccattatcctaagtgtactatatctcttataagcactctcagaaatgatgcagcttgtggcagcttgtggccaggcgcagtggctcacacttgtaatcccagcactttaggaggccaaggcaggtggatcgcctgagctcaggagttcgagaccagcctgggcaacatggtgaaatgccgtctataccaaaaatacaaaaaattcgctggatgtggtggcgcatgcctatagacccagctacttggaaggctgggatggggatcgcttccaagcagatcgcttgagcccaggaggtcaaggctgcagtgagccaagattgtgccactgcactccagcctgggagacagattgtattagtcagggttctctagagggccagaactaatggaatatatatacatatatatgtgtgaatatatatatgtgtgtgtgtgtatataacatacatacacacacacacacacacatatatatgtaaaggggagtttattaagtattaactcacatgatcacaaagtcccacaataggccatctgcaggctgaggagcaaggagagccagtctgagttccaaaactgaagaacttggagtctgatgtttgagggcaggaagcatccagcatggagaaagatgtaggctgggaggctaggcccatctctctttttcacatttttctgcctgccaccctggcagctggttagattgtgcccacctgattaagagtgggtctgcctttcccagcccactgattcaaatattaatctgctttggcaacaccctcacaggcacacccaggatcagtactttgtctccttcaatccaatcaagttgacactcagtattagccatcacaagtccaccccttgtcaacttgaacccatatacatatcctgagatcatacatcatcttcagataaagacaataataaggtcataatttgcctaacataatacaactatccttcgtacaactggaaacgcaccaatccccaacccaaatactattacatgaacttaataatacttaaatgctgatgtgaagtcaataaatcttatgtcacatgataaaggagaaaggaaataaaatgagaatattttcttagtacaagtgtatacatgcacaaacatatttttaacaaaagaaggaggaaatgttcatgacaattgcagtcctcgtttctgtagctggtcacgtggtcgtagctagtattgatgactacctacttttactacctattctgtattccctttgccgtcagtaaacacttcagcaggtcatgttttttttcctggtggagtgacccaaaccttcattcctgaagggtctgggccgtttgtagtcctgcctggattgggctgttgtagtttcccattgaccttaatcacagggcatggtaatactaagagacacccaaatggatctcctgtattccatgcatactttttcttacctccattgtggggtagtagactgatttcatcttgatagtccaagtcagtcaccccaaccaacactgtaactcccttattagcctgttgatgtaaagggaagaggagcccaaagtgtccaggtggcaatcttaacttccagtttaatggaactgttgtgtctcctgatggcagcattccttcctctggaactaagaactctaggccagcagaacgtaatgtcgggggaacaggaagcaaaaattttgctggtggatcactggggctgatggtgagtggtgccacttccacttccactccttgattcctggacctgtgaatcctggctatgagagaaagagtaccatatattgaatgctaattcagagcttacacagccttctggaaaactttgccccagccctacaaagtattgtcacctagttggcattgtaattgtaacttcaaaatgaaattccaccattctatcaatccagctgcttcaggctgatggggaacatggtaagaccagtgaattccatgagaatgagctcactgccacactttcttagccataaagtgagtgccttggtcagagtctgtgtgggataccatgatgttggataaggctgatggggaacatggtaagaccagtgaattccatgagaatgagcccactgccacactttcttagccataaagtgagtgccttggtcagagctgtgtggaataccatgaaggtggataaggcattctgtgagtccatggatgggagtcttggcagaagcattgcatacaggataggtaaacccatatgtggactaagtgtttattccagtgaggataaatctctgccctttccgtgatggaagaagcccagtataatcaacctgccaccaggtagctggctgatcaccctgaggaatggtgctatattgagggctcagtgttggtctctgctgctggcaaattgggcactcagcaggggctgtagccaggtcagccttggtgagtggaagtccatgttgctgaacccgtgtgtaacctccatccctgccaccatggccactttgttcatgggcccattgggtgatgacatgggtggctggggaaagaggctgagtggtatccacagaatgggtcatcctatctacttgattattaaaattctcctctcctgaggtcacccattggtgagtactcacatggcatacaaatatcttcacagtttttgaccactcagagaggtccatccacatacctcttccccaaatttggcaccaatttcccaatcatgcttcttccaagtccctgaccatccagtcaaaccattgactatagtctatgaattagtatataatcgcacatatggccgtttctccttccatgcaaagtgcacaaccaggtgcactgctcgaagttatgcccactggaaagatttcccttcaatgggtcagagtaacacacccaaatgaggaatgtgttgcctccaaaatccaaataggcccaaaaggcattgtgcctctttcttggttgtaggaggggccaattgcagcaacttatccttcaccttagaaagaatatcttgacaggccccacaccactgacccctagaaattttactgaagtagaaggtccctgaattttagtcagatttatttcccatcctctggcatgcaaatgtcttaccaataagtccagtgtgtttgctactttttgctcactggatccagtcagcataatgtcatcaatgtaatggaccagtgtggaagtgaaaagcgatcaaggtctctccaaataagattatgacacaaagacggagagttcatatgcccctgaggtaggacagtaaagatatattgctggccttgccggctgaaggcaaattgcttctggtgggcctcatggacaggaatggacaaaaaggcatttgccaagtcaatagctgcataccaggtaccaggagatgtgttaatttgctcgagcaatgaagccacatctggtacagcagctgcaattggagtcaccacttggttaagcttacaataatccactgtcattctccaagatccatctgtcttctgcacaggccaaatgggaaagttgaactgggatgtggtgggaatcaccacctctgtgtctttcaggtccttgatggtggcactaatctctgcaatccctccagggatgcaatattgttttttatttactattttcctaggtagaggaagctctaatggcttccatttggcctttctcactgtaatagccctcaccctaccagtcagggagccaatgtaggggttctaccagctgctaagtatgtctatgccaattatgcattctggcactggggaaatgaccacgggatgagtctggggacccactgggcccattgtaagttgcacctgaactaaaactccattaattacctgacttacataagcccctactttaactggaggaccacaatgatattttgggttccctggaatcaatgtcagctcagagccagtgtccagtaggccctgaaatgtctgatcatttcccttcccccaatgcacagttaccctgctaaaaggccggaggtctccttggggaaggatgggagagcgattcactgcataaattgtcagtaatatagtgaggtccttcctcaaggggacccggcctccccttcattcaaggggttctgggtctgtaaactggctcaagtctggaaattgattgatgggctgtgattctctgtttctgtaattcaaattagtcttttgtgcattcgacctagaagttttctgcttatataaattaagtaggaatgcagtaggcttcctatcaatttcacttctaggaacaccatgattaattagcaaatgccagagctctacacgagtcagactattctgattgcagtagtctgaaagcaatagtcagactattgctttgcctctgctgtccattacggtagctatgcccaccttgcctttgatggttgagtgctgccacttggcccctgccacctcaggatccaattattcccattatatttaaattttgtagttgagtgatacagttcccactgttagatctgacatacagagaagagcaattacagtactcttcgaagatgcatgttctgccctcacaaatctattttgcaaggcattggtcaagggtatatcttctggaccctcccagctgggatgaataggtctgaagtgactaatccactccaccatcccaatctccctaagcctttggatcccttcctctacataaaaccaagggagatcaggcatttccatctcgttcacagtgggccatcttttaatccatatttcagctaaccaagcaaataagctattagaaccttttttaactccccgagctgcaacattaaatgcagagtctctaacatagtgggcccaaatcaataaattcagcctgatccaactctgtgttctttccaccattatcccacacccttaatatccgttcccatgcctgttctccaggtttctgtttatataaattagaaaactcaagcagttatttttgagtatagtgcacctcctcatgggtcacactctcaacctcacctccaggagcccaccaggactttagtctagttgaagtctggaagcaaacaggggtgttgggggtggctcctgaggagaatcaacattatcttgcctggcaactgcctcagaggaggccatcactgttgcttcaggcagcacagggtttatctcctcagtcaaaggtggaaaggctgatgacagcatgggccggggaggggatattgccactactggagatggggaagctgtttcttctggcaaaaaaagttcatcagagtttacaaactcagtgtccccagcttcatcagggtcctcccacacgttcccattccaagttgcagggtcccattcttttccaatcaatgccctcactttaacagtagacacctggcgaggctgtgcatgcaccttttgttggaggccagtcactcgcatgataagagcttgtgtctgtttttccacaatttcagctctttctctacaggagataagactctcacttagggcaatcttagcagattttaggttcaatatctgcttctgaagcctggagctagaatccctgagttcatcattttctttcatgactttgtccactgaacttaggagcaaccaactagcttcattatgttccttggttttccacgtatggtcaattgtattatgtatagtcactgaactccttgcctctcacgagcgatgattcaggtgtgtcaaatgcatttattttgcataactctctaaacagttcacaccaaggactatcagtgttccctatactattagaagtacagtccttagcatttttgggtctaatcatattaaatagccaactccagaaaccccaaaaccaatgaaagaacttcatccttaatattctgttcctctagaacaactcctggtaccaaaatctgtatcagtcaggattctctagagggacagaactaatggaaaatatatatatatatatatatatatatatatatatatatatatatatatatatatatgagtttattaagtattaactcacatgatcacaaggtcccacaataggccatttgcaggctgaggagcaaggacagccagtctgagttctaaaactgaagaacttggagtccaatgtttgagggcaggaagcatccagcatgggagaaagacgtaggctgggaggctagggctgtctctctttttcacatttttctgcttgccaccctggcagctggttagattgtgcccacccagattaaggaccggtctgcctttcccagcccactgactcaatgttaatctcctttggcaacacccttgcagacacacctgggatcagtactttgcatctgtcaatccagtcaagttgacactcagtattaaccatcacacagagggagaccctgtctcaaaaaaaaaaaaaaaatgatgcagcttgtaaagctccactccatgcacatacacacacacacacacacacacacacacaccacccatgggaaaaggtcctggtcagagtcagagaagatgttattattctcaacaccttaactccaaacatcccattagatgactcagttctaaccctgttttggctttctgttttcttgcctacaacttcctttccctcagacctttctgtggtcttaggtaggcttccttctagccatcttggttgctctttagtgtaatctgaggctttttcagtatcactgatcttgcccacctgtggtctaggggaaaaacatctaccttgactttcataaagcaagtcatatggggggattgatttctatatactcttaaacatgcatttgtaggaaaatactgttgatttgcagtaaaatatttctctggccactttctatttgtattgtgttttaaggatttcacagaggtgaaatcttctggtccttgtaatataccatgaggcaactagaacaggcccgatgaccctagtttaaaaacaagaaaattaagacagagtgaattaagtggtttgtccttggtttatgacagaaaaatgttaaacttttcatgagacttcagaaatgaacatattctttgctgacagaaacatgtagatgtgcccaacacaatcctggataccattccagagggagtctttggggcatccctccctaccccagtctttggcagcaggtagatctctccttgctcgcctgatatagctgagcacacagagaaccagatggccctcaggcccggacagtgaggctggggtacctcttaggcacttttgcctcctcagcctgtggctgatgaacattagagggactgtcagccctttgaataccaggtcaaagcagaaattttattatcctaaactcctcccatgttattttggggctagactttttcaatttaatgaagcatagcttatatctcttgtgtcaaggtcagtcatctcaaagtgaattttccaagtgagctgtatctgtactgatgtcaatgtgacaaaggcagtgctttctgacaggaacttactaacttgctaataagtactaacttgctagctaatcaggaccagaagtcagctcactggtttctcatccataaagagtcagcattcccattccataaaaagtcagcatttcttttgaaggtcaggacctcctcccttaccagaggtgctttctgagcatggggctgagaaccagcagtctagcctgagatgctttccaatgtcaaaagaggcagaaagctccctaatggtacctgggcccacgacctggtgactccacctaccgcctctttgctactgctgctcacagagcctgccatgccatctgtggtctctcattcccacattttctcaaacctgtcactttccattttgggacttggactttgaggagatgtaaatgctagggcacatcttctcattgaatgataagatttgggcgcaagtggcttcctttaagcatgctcaccctggcttcaggctttctgtcattccattctcattgtcaccaagggaggggttaagagaaccagagtgcctcctcccaacaacagcagtgggccaggaccggtaatcctttgaaggttaagcatatctccttcaaaacaggtgacgagctcatcttcttggaccctcatacaacccagacctttgttgacactgaagagaatggaacggttaatgaccagactttccattgcctgcagtccccacagcgaatgaacatcctaaacctggatccttcagttgcattggtgggtattcgtaggttgggtgggccaggagatacgatgtgtacagattggttccctgggagttatccagattgctaggtaggaaggcaagagtatgtttgctcactatccccattagaggcagtagagtgtagtggggaaggaatggaccctggagccaaactgctccagttggaatcttggctctgccacttactaactgtattagtctgttctcccactgctgataaagacatacctgaggctgggtaatttataaaggaaagatgtttagttaactcacagttccacatggctggggaggactcccaatcatggtggaagatgaaggaagagcaaagggatgtcttacatggtggcaggcaagagagcttatgcaggggaactcccatttataaaaccatcagatctcataagacttattcactaccacaaggatggtatgggggaaaccacccccatgattcagttatctctacctggtcccacccttgacacgtggggattattacaattcaagatgagatttgggtgaggacaccaccaaaccgtatcactaactacgcacttaggaggagtcacttaatctttctgagcctcagtcttctcatctctaaaatgaggaaaacaatagttcgttccttatggggttgtatgaggtgcaatgcatgtaaggcacttagcactgggcctggcacattgtaagcattctataaatgttagttactctttcccctgtttccttcttgtcctcaaattattgctacccaggcacagggaggaagatgggatatcactagggagagataagggagcaagatgccctgggtgcacacaatctaggaagctgcaggattttcccccagaagtatggctggtgtctacacacactgaaggggcatctgcctgtgaagtagctggtggttctgaggcctgtctgcatcctctcctctagtttaatccaattgtcagtataccagtgaccaggagctgcaagtcctcctcttgtgaaccattctttcactactctgggatggatttgaggttgagaaagcacagactgatggttctctctattctgatagataatttcctgaaggtcaatgccatcttcttaagtattgcctctagctaaaagtaccatttggcttttgtttgttggcttaattgaatgttctttggagatgtgtgtatttgtacactgaaagtaatggaattaaccctacactttgaagatgatcttcaagttaaaatatctcgcagcatgaggaaagagggaaagggacagagagcaagggtgagaatgagagcaagactgagagagtgatatgtatgtctgagtaaggcaatgagttaggagagagagaagcccaggcagtcttccttctttattgctgagaagtcacatccacagagactggcccacatcctaattctgggccaacagctccattgtgcaataccaaaggtaattctaagttgtgttcttttgctttcccccaagggatttttctgcaaagaagaaaaagactttgataactggtgtagccttgttcagaaggtaaagctatatgtttttcttagtctgaaaaatgaagttacccaattttattccttttcaagattgtttttcatagtaaaaaaaaatcctactctgatacgactttactgcaagagaaagaaactaaggcaacaaagaaactatcaggtgtggggaattgtgcataacttcggggaaactgaacaaaaattttggtttgaaatatgcttagcatgtcaagggagtgatatttttagtgatgaaacctaatgttttatctcattaatagacaattattttctaaaggcaatacttacattttagaatgcagcaaaactgtatttatgtcacatttaaaggtggaatgagaattttctgataagactatgccttttattttattttattattttttgagacaaaggctcgctccgtcacccaggctggagtgcagtggcgggatctgggtgcactgcaacctccgtctccaggttcaagcgattctcctccctcagcctcccgagtagctgggattacaggcgcccaccaccacgcccagctaatttttgtatttttagtagagacagggtttcaccacattggccaggctggtcttgaactgaccacaggtgatctgcccacctcggcctcccaaagtgctgggattacaggcatgagtcaccgtgcccagctaagactatgccatgtaaattaggatatataccatacatgttggactgccactgaaaccatgccaatatgtagcaatagtctcttggggcagatttaatttcactaactgacatttctttggagccagtgcttcaggaacatgtcacccctaaagtgagctggacccatgcgtctggcacaggcactatgcctcatgatggagaataggcagtgagtgctggccttcatcagatactccccgcaaagtccttccttcctggctaaacagtatctagaattgaagatggctgagtcttcagatggttcaagtagaggatgcatgtattttctaggcccctgttttcacctggaaaccagcagaccactgtctcagggtttggggtcaaagattgccaattagaaatgttgtgactctgaagtatttaaaactgttttgtcatctccccaggaaattctaaaggagaatttaaggatgtttgaattagttcagaaacatccatcacactggcctccctttgtacctccagccaagccagaagtgacaaccactggggcaggtaagctgttgttcaatggctctcagctagcagacccacatatagcagttgttttatgagaaagaagaattgtggcccatgctttctgtggacagtaaaatttctactcagctggagtgataaaaaaatggcacttctggttattttaatcttctgatgagctgatatttaccaatttcaaagaatgataatagaagaaaatgagctcattgcaaaagttctatgcaaaatcaagatgactaggattgctttttcatggtctggttcagaatagcaaattgaggccatcgataattcaaaggtatcttgaagggctttcagagccttggccacatcaccgtcgttaggtttatgtaacaagtctggctattttgagtctttatagataatttctaatacttggcagtagttctaattgtaagtctcctccacacaagtctttctttagtacagcaattaaaaatgcttagtcttaactactgagtaaagtatttactgaccacttcaacccaagtgtcaagcttttcttctttctcatttccgtattctgatagaattcattgactctactgagcaactggaggagtttgatctggaggaagattttgagattctgagtgtgtagaatcctgggaactcaacttgaaggtctgtcttccatctggcaccataaaaacatgaacttattgcataaaacttttctagtcagcaagtgcctgatatgccaatagcatacaaactcaatagcaatcatgactgagccaatcactgtttctcagaaaaacaaaacaaaacaaaacaaatgacagtaacccttccccggaaagaaatagaacaatcatggagcctaggagcagagagatgaggaggagttcattgcttcccagcttgtgttatatggctacagcaagtcttcagctgctgcaatgaggaaatgggcatctggaagacaaacagcaactctcagcttgcttcaagaaccagcagataagagatggttaagctgttcttcaccctttcagatgtgacctcttttggactaagcagcaatctgttctcttgctcaaataataaagtgactgaatcagggaggaaaaggttcttgttaaattatttgattgtgtagttgaagtaattataatttatatcaaaacgtttgtcaaagaaacgatgtcaaatatacacttcttgatctcccttctgtttgcggggatcttactatttgatgggtcactgtccccattcttactgatacttttgtcagatatcaccctgtccttaaatcatgatcacttaaatcaggggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtatacccta

SEQ ID NO: 434 - DNA, 8414 bp, Homo sapiens
agtggcataaacatgggctttggcgtcagacagccctgagcggggccccattgccccacccccgaggaaggcgagggggggtggcagggggctgcggaaaggggctgggctgggttgggctgtctgcagctctagtccaggaggctgagacttcgagagggacttagagaaggcagacgcatcccgaactcgctggaggacaaggtgaggggcgttgatattggggttttatggaggtcagacagtggttccagacccctcgaacccatagccaggcagatgagcaattcttactgcaccactgcagctgaagcagaggtgacctggagtggggtgtaggcaatgaggacgactgagaaagtagtaggctgtacagactgggagcagagactagcggagggaggaggggagaaaaacggggaaccaggaatgttgggagggggacgaggaatacaaggagggaggggaacactgagggggagtgaagatccagagaagagaatcggggatgcagagagggattaaggaatactgaggggcagggtgtgcaaacgtaacacggaggaggatgtaagaaatgggaagaaggaattctggagtaaataggaaatgtgaggtaggaatagggagtagggagccaggctaagggaatacggaggggggcataaggaatgaggagcagggagcgggggaggggcagacaggctgggacggaggccccctagggaggcggaaaggggcgggaccacttccggcctagagaggggagggcagtctccgagtttcggaggggcttggagtgagtggacgcactcgggaattgtaggaggacgaggtgagcagccgggtcggcttttggatgagagccccgctaggggtcggccccaccctctgggatctggagaaaacctgccttaaggaccggatcgtaccggatccatccggctgggaagggaggggactggacccggtttggccgggcccaagatggaatcactagctcagtatttatttgaggagggggtgtaatagggaaggggcggaaccaagatgcgcctgtttggaggggggcgtgttaggaagaagggcggggccaagagacactggactctgtagggcgtgagtaggggaggggccgggtccaccagacactgcgacaattttggaggaaggcttgttgggcagggggcgggaccgaatggtactgcggacctggagaggggcgtgtgttggggcagagtgccagactgagaccacgaccattgcgcatgcgcactatgtttcgctagaaaggggcgtgttgagaagggccagcactgagaagagccagctgctgaatgcgcatgtgcacggtggacatcaaagaaagggctcgtgctgggaaagcgggcggggctgagagcggccctgcagccgacgcgcatgcgctctatcgacctgcggctgggtggggggtgcactgggaaaaggggcggggtcctcagagctgccgcgctggcacatcttcctggagaaggggagggtgcggctgcagagaattgagacttagaagctttgaattcctgtatctgagaacggagtcgttgggggtggtggagggggttggaattggggacctacggaaggtgaggatcagcctccaggcacaacaggggagaggacgttcagtgggcttcaacttgacccaggccttctccccttcaggctcagctcttgccaggccaaattgagacatgtctgacacaagcgagagtggtgcaggtctaactcgcttccaggtaaggcctctttctgtcctttccccagctgcttttcctctccagcccttgttgctgcccccaagtcccttggctcttcccctcccatccttgtccttctccacctactttcctgcctgggtgtccccctgcccagtggagggagggagagaaggtgggcgggcccctcttctgccatcagttcttgctcagaggaaagggaggccttgttgggctgaggtggtcagagcacaccgcaggtaggagtcagtacaggtcagagaagtgtggccttggaattttggagccatttgcttagttgggggtgaggagaaggtctatgaacttccctgcttcctcttgcaggctgaagcttcagaaaaggacagtagctcgatgatgcagactctgttgacagtgacccagaatgtggaggtcccagagacaccgaaggcctcaaaggcactggaggtctcagaggatgtgaaggtctcaaaagcctctggggtctcaaaggccacagaggtctcaaagaccccagaggctcgggaggcacctgccacccaggcctcatctactactcagctgactgatacccaggttctggcagctgaaaacaagagtctagcagctgacaccaagaaacagaatgctgacccgcaggctgtgacaatgcctgccactgagaccaaaaaggtcagccatgtggctgatacaaaggtcaatacaaaggctcaggagactgaggctgcaccctctcaggccccagcagatgaacctgagcctgagagtgcagctgcccagtctcaggagaatcaggatactcggcccaaggtcaaagccaagaaagcccgaaaggtaagacctctgcagtcaccacccttggttttctactcctctctcagttgattcatttgttctacaaacatttagaaagatccctgtgctcatcagggctgtggggggcactgagagtaatgtgatgtaattcctgtcttcagagagcttgcagactgatggggaggtgcaatctgaatgtaatgcagtttatgtttacatagtagctgccctgtattaggccttgagctaagcacatttatgcaggttatctcattaaatcttgaaagtaattctcatagccccaattttatggagaaggaagctgagttccagagaggtgaagcggcttgtctaggatggttcaagcagagccagtagtgggcacagaaagagaagaagactcagcctccacccacccttggtttgctcctggcctgctaggcagatgaaacacctgcttggaagtcagtgagaaacaaatccagggttcagcatggccaacatctattgagtcaggctgttactacaggggtgggattagcgggtgcttcctggaagagatagggagaggaaaaggaccacttgcttcatctggtgacgttgagcttcctctctgttgatgcaggtgaagcatctggatggggaagaggatggcagcagtgatcagagtcaggcttctggaaccacaggtggccgaagggtctcaaaggccctaatggcctcaatggcccgcagggcttcaaggggtcccatagccttttgggcccgcagggcatcaaggactcggttggctgcttgggcccggagagccttgctctccctgagatcacctaaagcccgtaggggcaaggctcgccgtagagctgccaagctccagtcatcccaagagcctgaagcaccaccacctcgggatgtggcccttttgcaagggagggtaagaactctgtcgtttttattctgccttttctactgccttggctgtccttttctttgccatcgtctcaagttttctgcaaacttgttttggtctttccatctttttctactctgccaggcaaatgatttggtgaagtaccttttggctaaagaccagacgaagattcccatcaagcgctcgggtaaagtcctaccaatcctccctctgccctgagctctgccctccattgcccttacaccattgtgctggggatatcccctgctcttatgcttatgtctctgtcctcccaaagttctgatttggcagtgctagcatctctgttgataagcacagaaccgggttatgccacccttggtgtggttggcaaagagtctatagcttgggcatcagggccacctggcatctcttcagtcaggtgctcacaacactctccccttgcagacatgctgaaggacatcatcaaagaatacactgatgtgtaccccgaaatcattgaacgagcaggctattccttggagaaggtgaaggggcagccctgggggatgggcacagtggggaagccttgaattgaacaaaaatgtacaagtcccttctcgggaaccaaagagacctgctaatccagctccatcgctatgctgaggggcagacagtggcctagggaggggtgtagattagcgatgggtcacacagcaagtcaatggtaaaagtgcagctaggacccaagacacccaacttaatcctggcttctgtccgtccatggcagctcctgccatgtatttgagatttcacctctccctttcattccccattctctgtctccctagagtcccactcaccacaaagatgatgatgacaatagtacatttgcagcgtgtttaccgggtgccaggcacttagctatgtactttgtgcgtattatctcactgatttctcacacatgcgaaactcctaggtacatagggagctgcagcatgccccggaagctgaattttgtcatctcacaagctgttctccccatccacaggtatttgggattcaattgaaggaaattgataagaatgaccacttgtacattcttctcagcaccttagagcccactgatgcaggcatactgggaacgtaagctgggaaagggctgaggtgtggggggcttctgctttggccatgtgctgctactcctcctttgtcctacttcccccatcctcttagagagtcaggaaagacagggtctcaaaagccccgtcccagttcctatgcatagttggagccctgcttacagtggtggcacctgattatgattgactggagggtgtaggagcctggagtgggacattcctgctgtcaggtttgctgtctctgtagaagcttcccaggaaagcaggcctgtcgttgcttgcctcttcctactgggtgcctggcctggctttggcagagtggttctcaaggagggcttcctggtgtgggtggatcaggatgcatgaagcgcaggagtgtcagtggggctgaaggttctgggacagaaagaagggactcacattgactgagtgcttgtgttgtaccaggttggcagccattcttccatcttcttggaaacccagggaagggaaaatatgattttttctattttactgaagagtagactgaggcttgcaagtctaagtgccttgccaagggtggcatagagctggaagcagagactgggtagaattctgtatctgaggaatctgggagaggctagcctagtgagttggctggtgtgtctgttgcagatggctgctgaacataaacctctctgtcctgttatttctctaggactaaggactcacccaagctgggtctgctcatggtgcttcttagcatcatcttcatgaatggaaatcggtccagtgagggtgagtggctgggcttgcagctgaatgggtggctgtggtctagattccatgtgttcaatttctgtccctgtctcctcttgcctcccctcgcagctgtcatctgggaggtgctgcgcaagttggggctgcgccctgggtatgattgggctctctcagcgcttgctgtccgtgttgtcctttggcaagagaggacggtcctaggattgcatcagtctggtggtctggtggagcgggtggggtgctggactgggtagagggcccagggttctgacctgggtggatgatgggtgaatggtcctgaactctctgctccctctctcagtgtctcttgggcttctatggagcttccctcttgtgctggaaacctcttttccatcttggaaatgcctctgcccacatctgggaagtgccatagccttgagtgaatttatttgtttatttatttttctttttcttctctcaggatacatcattcactctttggggacgtgaagaagctcatcactgatgagtttgtgaagcagaagtaagtatctctgtctggtgttcatgtgtcccatgcatttggcctatttcagaactgagtgataaagccgtggtgcatggatgcatgtgtctatgtgtgtatgtatttgcatatttgcatgtatgcaggtgggattattccttgggcggtgatgggaaacaggagcagcacatgtttcctgatctgttacatatacctcaacatttgtcttgagaccagttctgcaagggagggattatcattaccatcattgtacgtatgcagaaactgaggtttagagaggtgaagtcatttggtcagggttacacaggtagcaagtagaagagttatgtttagaacttggctccaaagccttagttctttttattctgctaactagagcttcatagaaattaatttccgtaaagaaatgacatagaatggtagcttcaggcaaccaggtaccatgctggggagttgacttgtacatctcatttcattttcataactaccctgcagctgtcatcccatccccgttttacagttgagggacctggggctccgagaagggagatctgagcatggcccacagctggtatgggcctggagcccagtcctcttgaatttctggccaaagctcacctatccttggtccttggaggacatgcaaacactcacacagccacacgcatgtgcacacagaaacacacacaaagggtcaggaattcagcatgtgtgaagcatgctgctattggctgttcttcctctgtagtctttctggtcattttctgtggtggacctttctgggcttggccaggctgaggccaagacacttgcagtggggtgtgctcagagcagggggcccaaagaatggctcctctgtttacaacacacccaacaggaatctggggtcattgtgatgagggcgtcaaacttgtggcttccctatgaacaaacgtcccccaacacctctatgtggcttctgggcaagaccagtgggacagggctcaatattggaagaaagactgtagtaattagtggatgatgttgccatctggagcctgtccagtctatgcatgggtaggccatgaatggtcttagaaataaaggctttgaacctctctttccaaggtacctggactatgccagagtccccaatagcaatccccctgaatatgagttcttctggggcctgcgctcttactatgagaccagcaagatgaaagtcctcaagtttgcctgcaaggtaattggagagctccttgagcttggcaagtcaagagcatggggtgcccctggctggggcaggctgtgtgcagagcagcctgcagttcaaatctgaatgttttggtgcttctgttaattgtcaaaacactgtaacaggcactttatctgaatcatttaagccttacaacctgatatgtcattgccctgttacagatgagaaaaccgaggcccagaaaggttggtaggtgacatgtccaaagtcatggggctaggaagtgtcagagcagggatggaatattaggtgcataattactggtaatactgtattattactattatctttttatactaagcatgtagcatagtgcctagcataaaggtagatgcttaatcctcttatgctccttctgatggttatttacatagtaatactgtattattactatggcttaatccctctatgctccttctgatggttatttttgtttcaggtacaaaagaaggatcccaaggaatgggcagctcagtaccgagaggcgatggaagcggatttgaaggctgcagctgaggctgcagctgaagccaaggctagggccgagattagagctcgaatgggcattgggctcggctcggagaatgctgccgggccctgcaactgggacgaagctgatatcggaccctgggccaaagcccggatccaggcgggagcagaagctaaagccaaagcccaagagagtggcagtgccagcactggtgccagtaccagtaccaataacagtgccagtgccagtgccagcaccagtggtggcttcagtgctggtgccagcctgaccgccactctcacatttgggctcttcgctggccttggtggagctggtgccagcaccagtggcagctctggtgcctgtggtttctcctacaagtgagattttaggtatctgccttggtttcagtggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgccatttc

SEQ ID NO: 435 - DNA, 54587 bp, Homo sapiens
ttcccatccgcaccagcaagaggggcccctgtgccccaaacgcgaaccgtacggctccagacagcaccgcggaactcggtggcttccagaaggccccgcgcctgcgcattccgctgcctgcgcctgcgcctgcgcctgcgccgttctcccggccgccgccttagcacctcctccggacggtgtcgccgaagtctcgcgagcccggagcgtggcacgtgggttggtaactgtggcgctgctccgcgtccaccaccacccctgtcctcctcaggccccctccgcctccacccctgccctcctcaggccccctccgcctccacccctgccctactcaggccccctccgcctccacccctgccctcctcaggccccctccgcctccacccctgccctcctcaggccccctccgcctccacccctgccctcctcaggccccctccgcctccacccctgccctcctcaggccccctgcgtccccgcctcgtcctcctcaggccccctccgcctccggctccgtcctcctcaggccccctccgcctccggctccgtcctcctctggccccctccgcccccggccccggccccacggcgggatgcgggacaacaccagccccatcagcgtgattctggtgagctcggggagcaggggcaataagctgctgttcaggtaccccttccagagaagccaggagcacccggcgtcccagacaagtaagtgagcgctgggcgggggcctggcgctcgcgggggccgcctcattccggggtcgcctcattccagggccgcctcgcggagcttagcttttgctgggcattcgagatctgctcgttgtagagtatttgaaaagtagaaaaaggaaaaaaaaaattaaaatcatgcattgttcaccacaccaaagcaactactgctgacatttcatcagtctccagcctttaaaaaataaagtaaaataaaataaaatgagtttgggatgtattcatcatgagaaaatacaaaattacacgaacaaggccggtggcggtaatcccagcactttgggaggccgaggcgggtggatcacctgaggtcaggagttcgagaccagcctggccaacatggttgaaactctgtctctactgaaaaaataaaaataaaaaaaaacaaattagccgagcgtggtggtgcgtgcccataatcctagctacttgggaggctgaggcaggagaattgcttgaacccgggaggcggaggtttcagtgaaccgagatcgcgccactggattccagcctgggcaacagagcaagactccgtctcaaaaaaaaaaaaaaaagttacgtgaacatctgaagttgtctttgccacccccagttctagcaagcacagggatcacccctggccgtgttgggagttgtctgccctgtgcatagatgcagatctatccacaggaaaagggaacgtcgcgtgaggtttttcatcgcacgaattgttctgtggcgcccttttcccatagtcggccttggagctccgtctgcctttgcaagcagggatcaacctcacccttggctgcaggctgctgccttcccctgtggacggcatgtaggttacttttgatttttcatcatcatgaatgttcagtttttgtttttattttatttattttttgagacggagtctcactctgtcgcccaggctggagttgagtggcgtgatctcggctcactgcagcctccacctcccgggctcaagggattctcctgcctcagcctcccaagtagctggggctacagggcatgtgcaccacaccctgcaattttttttttttttttttttttttttagtagagatggggttttgccatgttggccaggctgatctcgaactcctggcctcaaatgatctacctgcctcggcctcccaaagtactgggattacaggtgtgagccaccgcacccggactgttcagtttttattttgtattttgttttaaaattatttttaaacttgttgatatggcagaaagttttaaagatacaaaggagtttagattatgaaaagaaagttctttcctactattggcccccagccctcagtttccatcataggggtaactactgttcccatttttctgtgtctttccaggaccttctgtgtcaatacaggcgtatgtatttcttttttctttttttttttttttgagacgagtcttgcagtcttgccaggctggagtgcagtggcgtgatctcggctcaccgcaacctccgaccccctgtcaagcaattctcctgcctcagcctcccgagtagctgggactacaggcatgcgccaccatgcccagctaatttttttttttatttttagtagagatggggtttcaccatgttggccaggctggtctccaactcctgaccttgtgatccgcccgccttggcctcccaaagtgctgggattacaggcgtgagccaccgcgcccagcctgcacttgtgttttttttctaagcacaagcaaagtcacaccatacacactgttctgcccctgttttcgttttcacttcatgtctgcatctttgatgtagatcagaacctgtcgagcacccttgtccttcttaccggccacggtgaattccatgagatgaacatattgtgatttgtttatcgtgtccttttggttgatggacgcaaaattgttttcaatcttttgctaatacgaaaagttcaaacgttctttccaggtattgtcattttgcagaattcttgtaatattaaatccccaaagtagcatggttgggtctaagggataaagagcatatttatttttaataggttagatttttcaatctttgttaatctggtaggtgaaaaattatatctggtagtaattttaatgtttatttgccttttaattgagatagaaagcatattttcctgtttttggagccatttggatttccttttcagtgaatgacttatttataacctttgcctaatgttctcttgggttgtttgattttttttccttatagatttgaaggagttctttatatatttaatgtaaaaataggtcttgggacaaagctatagtcaccctgtttgcttctgtgtagttcttgccagagttttgatttttgtggagttttcagtctaatctcttgtggtttctgagttttgttttaaatggaaaggcgttttgctctccaaaattattaacaacaacaataaaaaactcccttattttcctccagactgtttatgtcttttttttttttttttttttttgagacagagtctcactctgttgcccaggctggagtgcaatggcctgatcttggctcactgcaacctctgcttcccgggttcaagcgattctcctgtcccagcctcccgagtagctgggtttacaggtgcgtgccaccacgcctggctaatttttgtatttttagtagagatggggtttcaccatatcagccaggctggtcttgaactcctgacctcgtgatctgccttcctcggcatcccaaagtatgtcttgtttttaaatgtgtttgtcttggcataaggtgaaggctaatcctaagagctgatattttctgggctcttgtgaagagttgcagatgaactgcatggttgcctttggagccctgtggaactggagttataacaggccacaacgtggccaaatgatgattgattgggccaacataattttcttttccatatggctatctggtcccaacataattttattgaataattcaccttatttccactaattgattctgctctctttatcgtgctaaattctcacgtttacttggatctattttttgtctttcttatctcctccaatgatctatgtgtaggttccataataattactgtgacttggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaataataataattactgtgactttatgttatactatccgtaaggttagtcacttgtcgttacttttctttttcagcgttatcctggctgtgctttattatttttccctgtaaactttcgcatcaagtgcattaggtcccactcccaagctcttggtgtaggtagctttgaatctgttgattaactgggaagaaaaagcatctttatgttgaatcttcccgttcaggaaaatgatatgtcttcaattcatttttttctcccttattagcttttccattgttttcatgggccttttgcactcttcttagattcatcactaggtttttaaatttttttactccgggaaagtattattgtttgtgtatatgaaggctcttggtgtatgtacatttaaattttttttattttgcctatgctttttccaacctaattgtcatcccacactgtgagggggtgtgtgtgtgtgtgtacatgtgcataggggcctacctcactttattgtgttttctacaaattgaaagttcatggcaaacctgtgtccagcaagtctgtcagcaccatttttccaacagtatatactcactttgtgtctctgggtggtgttttggtaattcttgcagtatttcaaactttttcattattattgtatctgttacggtgatacatgatctttatgttactattgtgattgttttggggtaccaagaaccatgtccacataagatagcaagtttcatcaataattgtgtgtattctggctgttcgcccatctgtttccatctccttggaccaccctgttcccttagacacaacaatattgaaattaagctggttatctacagtggcctctaagggttcaagtgaaataaagaatcacatgtttctcacattaaatcaaaagctagaaatgattaggcttcttgaggaaggcatgttgaaagctgaactaggccaaaagctagtctgcttgcacaaaacagccaaatggtaaatgcaaaggaaaagctcttgaaggaaatgggaagtgttactccaagccaggcctgcacctgtactcccagctacctgggaactgtaggcaggaaaattgcttgagcccaggagtttaaatctagcctgggcaacatagggagaccctgactcttaaaacaaacaaacaaacaaacaacgctaggcacagtggctcatgcctgtaatcctagcactttgggaagccgaggcgggcggatcacgaggtcagaagttcgagaccagcctggacaacatggtgaaaccccatctctgctaaaaaaaaaaatacaaaaattagctgggcgtgttggcccatgcctgtaatccccagctactcgggaggctgagacgggagaattgcttgagcctgggaggcagaggttgcagtgagctgagatccgacattgcactccagcctgggcaacaagagggagactctgtctcaaaacaaagcaaaacagaacagtgaatgcatgataaaaaggtaaatagctttgtttgttgctggtatggaaagttttagtggtctggatagatcaggccagccacaatattctcttaaaccaaagcctaatccagaaaaaggctctaactctctttaattctgagaaggctgagagaggtaaggaagctgcagaagaaaagttggaagctagcagaagttagttcatgagatttaaggaaagaaaccatctctataacgtaaaagtgcaaggtgggccgggtgcggtggctcacgcctgtaatcctagcactttgggaggccgaggtgggcggatcacgaggtcaggagatcaagaccatcctggctaacacagtgaaaccccatgtctactaaaaatacaaaaaattagccgggcatagtggcgggcgcctgtagtcccagctacttgggaggctgaggcaggagaatggcgtgaatccgggaggcggagcttgcagtgagccgagatcccgccactgcactccagcctgggcgacagagcgagactccgtctcaaaaaaaaaaaaaaaaaaagaaatacaatttgtaaggctatagctgccatagatagtgattccttggacagatcagggcaaaataaattgaaaaccttctggaaagcatgtgccattatagatgccattaagaacattggtgatcatgtcaaaatatcaacagtaacaggagtttggaaaaagttgattccagctctcatggatgactttgaaggagtcgaaacttcagtggaggaagtaactgcagatatggtggaaatagcaagagatctagaattagaagtagggcctaaagatgtgactgaaatgctgcagtctcacgataaaacttgaacggatgaggacttgattgttatggatgggcaaagaaagcagtttctgggctgagtgtggtgactcacgcctgtaatcccaacacttgggaggctgaggcaggtggatcacttgagcccgggagttcgagaccaacctgtgcaacatgacaaaaattcatctctattaaaaatacaaaaactagccggacatgggtgtcatatgcctgtagtcccagctactcaggggactgaggtaggaggatcacctgagccttgggaggtcaagactgtagtgaacggtgatcacaccaccgcactccagtctggatgacagagtgataccctgtctcaaaaaaaaaaaaaaagaaagaaagaaagtagcttctggaaatggaatgtattcctggtaaagatgttgtaaacattgttaaaatgacaacagagatttcgaatattatataaacttagttgataaagcagtggtacagtttgagagcattgcttccaattctgaaagaagttctgtggtggataaagtgctgtcaacgtcccgtacgacagagaaatctttcatgaaaggaagagtaaattgatagatgtagcagaggtcattgttgtcttattttaagaaattgctacagcaccccagccttcagcaagtaccactctaatcagtcaacagccatcaacattgaggcaatacctttctccagcaaaacgattgttttgctgaaggctgagctgattgttagcgttttttttttttttttttttttgagactgagtctcactctgtcacccaggctcaagtgcagtagcacaatcctcatcctcctgagtagctgggattacaggtgcccaccaccatgcccggctaatttttttttttttttttgagacggagtcttgccgtgtctcccaggctggagtacagtggcgcgatcttggctcactgcaagctctgcttcccgggttcacaccattctcttgcctcaccctccagagtagctgggactacaggcacccaccaccacgcccggctaattttttgtatttttagtagagacggggtttcaccgtgttagccaggatggtcttgatctcctgatttcgtgatccacccgcctcggcctcccaaagtgctgggattacaggcgtgaaccaccgcgctcagccatgcccggctaatttttgtatttttagtagagacggggtttcgccatgttggccaggctggtttcgaactcctgacctcaggtgatccacccaccttggcctcctaaagggttgggattacaggcacgggccaccgtgccttatcactgtttttgaagataacataagatttgtcattttaatgatttgtaagtgtataattaagtggcattaattacattcattatagtgtgcagccattaccgctatctgtttctaaagctttttcagcacgtaaactgaaactctgtaaccactgaccaataactcttcatttcccctgctcccagcctgtgctaacctctaatctactttctgtcttgatgcatttgcctgttctagacatttcatatactgtaagtgcaccatttgttcttttgtctctggcttattcagcatgatgttgtcaaggttcacccatgttcattcctttttatgtctgagtaatattccatggtatggacagagcatgttttggaaaacatggctgttaacggttccataaccctcctgtgtgtggaaggaccctgttttcttagcccttcccctcttttcgccccgactcaggtaagccgcgtagcagatacgctgccagcaacacgggcgaccatgctgatgagcaggacggcgattccaggtaaaggctctgcggccacttcagggcggggcgtgtcctggtcccaggcctgggcaaagccccaccctcctattcacccagatgttttctccctgagaagtctggtgtttgtttttttccgtttagtgggtgctctcaggtagtgtagagtggaggactgcgtagacagtctggggcttgctgaataatttgggcacctgttccagcttcaggcttgtctggtgggtgaagcaggtcagagcacagatgaggccatgtccacgtgagatgtttatctcctatgaaagaaacatagaggaaagcagacccctatgttgttgtctttggatctaattccttgagcatgtacccagaggtcaaatgcaggtgcttgggtttagcacagcctggtcaagtcccttcttggtgtccaggctcaggtggtgatatgggcagtggggcttagagctgggatggtgtgaaccttgatgttctttgatgttcttttaggcacagatgaaaggtggatccggttccttcctgtgtttgtgcccctgctctctctgggaggcactaccagggtagaaactttagaaatgaccacttctgccttctgttcattttgaagcatagtaaatggtaacataggcccaggtgagggagggaagattgtgagttacctgccctgggttcccttaaacacagacaaggcctgtgtggagtaaaggacttggcttccactgtcccgggaaaaaatagctaagatccctatgctgggcctttgctgtgcagtgaggtagtgctgtttctctgcagttctctgacaaggcagcaccacacctgccatggcaatttgcaagtctttttaaaaaaattttattgattgattgtagagatggggtcttgctttgttgcccaggctggtcctgagctcctggcctcaagtgattttccttccttggcctcccaaatttttgggattacgtacataagccaccatgcctgaccacaatttgtggttccaagagtgtgatttttatcatcatttgggaggatgttggggcctctggcatgactgatgactgtctctgagtggagtgggctttggaagggcgatggggcttgctggacaccccattggaccgtcattttgatgtagaggcctgtggttgtcttgccctttaaatgtggtggtggaacaaactctggtttgtcacaggcatatagaatgcttttgcccctgcacagtgggtaggtatttcctgttctccctccacctgtgccacagatcagcttagagcagggctggctgctggccaccccccacattagccttactccaagctgcagtggatgtgaggcccaggctgctgaagactcagaaggaaggctggcagtacctaattcctgcagttaattttcagacttataatgacatgaccatgaggatattttctagggaattaatttaatatttaacgtaatgaagaggtaaaactgtgggaggggcatgcttctctctagaatcttttattgaagaattgcttcattcagtaattttagcacatcatatatctgtaaatctcactggtgccacccatgttttccagatacagggttcatacccttaggggctcagttcccctcctggtttattttgtcacgtaggcccgcaagcccctgctctgccttgtcatagctcagagcatgttcctggagcaaggcagtgaaagtgcatcaaatccactctctgtgtctttgatttttttttttttgagacggagtctcgctctgtcacccaggctggagtgcagtggcgcgatctcagctcactgcaggctccgcctcccgggttcacaccattctcctgcctcagcctccggagtagctgggactacaggcgactgccaccacgcccggctaattttttctatttttagtagagatggggtttcaccgtgttagccaggacggtctcgatctcctgaccttgtgatccaccagcctcggcctcccaaagtgctgggattacaggcgtgagccaccgcgcccggcccgtgtctttgactgttgttcccaaaagtgcttttctttctgaaaccagagcttcagtttaccagactgaaacagtattaacaggctacacagtgacttgtgagtggtcgtggcctgccttagaaaagtgaggacacagccgtgctgctcactattacaaacactggccagtgtggccatttaaattgaagttaactgaaataggccagatgtcgtggcttatgcctgtaatccaagcactttgggagtcccaggcagatggatcacctgaggtcaggagacagcctggccaacatggcaaaaccctacctctactaaaaatacaaaaatttgtcgggcatgggagcacatgcctgtaatcctagctactccggaggctaaggcaggagaatcacttgaacttgggaggcggaggttgcagtgagctgagatcacgccactgcactccagtttgggcaacagaacgagagtctgtctcaaaaaaaaaaaaaaagaagaagatggaaattaactgaaataaaaaattcacttgcggccgggcgcagtggctcaagcctgtaatcccagccctttgggaggccaaggcgggcggatcatgaggtcaggagatcgagactcatcctggctaacacggtgaaaccccatctctactaaaaatacaaaaagttatccgggcatggtggcgggcgcctgtagtcccagctacttgggaggctgaggcaggagaatggcgtgaacccgggaggcggagcttgcagtgagccaagattgtgccactgcactccagcctgggcaacagagtgagactccgtctcaaaaaaaaaaaaaaaaaattcacttgctcagttgcactggtcacatttcaggtgctcaatgtctatatggaaatagtgtctaccatattaaatggttcagatttggaatattcccatcacagtagaaagttcttttggggccgggagcggtagctcatgcctgtaatcccaccactttgggtgtccaaggcggggggatcacttgaggccagatgtttgagaacagtctggacagcatgacgaaaccccatctctacaaaaaatacaaaaattagctgggttggtgacctgcgcccttagtcccagccactgcggaggctgagggagcccaggacatggagcttgcagtgagccgagatcatgccgctgtactccagcctgagccttgagtgacagagtgagaccctgtctcaaaaaaaaaaaaaaaaaaaaaaaaattggacagtgctgtcttagagagggggctagttttttgaggtgcatcatcaagatatggttcagggctgggcgcattggcccatgcctgtaatcccagcactttgggagactgaggtaggcagatcgcttgagctccggagttcgagaccagcatgggtaatatgacgaagtcctgtctctaccaaaaatacaaaaaattagcctggcatggtggcacacgcctgtggtctctgctactcaggaggctgaggtgagaggattgcttgagcctgggaggcagagattgccacaagccaagatcacattgctgcactccaacttgggtgacagagtgagacccccctctcagaaacaatttaagatatgattcaggttatagagattaactcttacttattttttataatccttttctataattcaattatgagaaaagaaaatggatattgtccagtgtctctaagacttgaaaccaaggtcagaaaagatgtagtgttccctgggtattaggggccatggtgctcatgtttaaatgtaccgtgtgtccccaccactggtaggggcagaagccatcaagccaggtctgagagatagcctggtgtccctcagaaaggctggtgtgggcatgtccctctctgtgtggacaccgtcttcctgctcccttctttgaaactgcgagcagtgcttaggccactacctcagagaatggggagctagaggtttagagaagaactgatttctttcattttcaaaatgctctgaaatcatattattattattattattaattattattattattattattattttgagacgtagtttcattcttgttgcccaggctggggtgcaatggcgcaatctcggctcactgcaacctctgcctcccaggttcaagcaattctcctgcctcagcctcccaaagtgctgggattacaggcgtgaaccactgcacccggcctaattttttttttttttttaacagagggtttctccatgttggccaggctggtctcgaactcagcttggtcaacatggagaaccctgacctcaggtgattgaactcctgggcttaagtgatcctcccaccttggcctcccaatgttctgggattacacgcatgagccccctcacccagctaccagctctgcctttaattctcaggtgacatcttggggaatcaggtggcactgctactgtcctcaggcttggccacttttgtagcagtgtacccaacttgtggctgcacttgggcctaggccagatggggtccttggccaggcaggcactctctagctcacaacatacaggtcctcccaccaggcacacatgaggctctgccagggcctctcttgttaggtttgcctctattagcttgtgtttttagagccctacactgatgtgttagaaagatgccctctcctttctgtagctgaggttgacacacaagaaagcaggtaggcatttttgtccccaggcttgggcacttccctctgcccagccatcgcatccatgctgcagggcagtgtaaagggacaagtgcaggttcagggttccaagtttgactctcgctttgcagccttcggtgtgtgatcttgggcacattctttagaatgagccttagttccactgttttctgttaagatgcctgagggtggtgagttgccttcacctcttcctcccagatcaggatgttgtaggaccatccttgtctctgagtgttagctgatggccctgcctccctcagaggggcagacgcaagtctgtaaaatgctcctgtcaggaaatggagcattgccggactcagaagccctctgtgcttactccttttcctctggagcaaaggggttgcattgtgacttgtctagttgtaggaggcagagcttacagtcaggcttcagcttcgaggattctgacttcttgggtgatcttgggaaaatccatgaaacatcttaatgctttcatactgtacaacctgaggagcttggcagctgctgaggaaagagatcccttctgtggatctttggcagagctcccacaatgtttccactcctggattcaggtctcctttctctttccagaatacatggaaagcagtgtgtcccagaactcaaatatctgcagaggaaaataaaggtttttttttttttttttttttgagacaaagtttcactctgtcgcccaaggctggagtgcagtggtgtgatctcggcttgctgcaacctcacctctagggttcaagcgattctcctgcctcagcctcccgagtagctgggattacaggcatccaccaccaaggtgagctaattttttctttttaagtagagacagggtttcgccatgttggccaggctggtctcgaactcctgacctcaagcgatccacccacctcggcctcccaaagtgctaggattacaggcgtgagccatcgtgcctagccagaaagtaaactcctaaactgtttctaaaaatctcaactcaggtagtgcaaaagcccagatgttttctgacaaatatatatggatccaccatgaccactttattgctccaggcagaggcttagggaagtcaggtgtgctggcagtcacagtatctcaagaattggagctggtgaaattcatatgacacgctatagttttcagaaggcttttgcctctgggagtcttatgtgatcctcggtaggcgatttcttgtcatgcagatgagaaaacttttaccacaaagattagttttaggctgggtgcagtggctcacgcctgtaatcccagtactttgggaggccgaggcaggaggattgcttgaccccaggagtatgagaccagcttgagtagcattgtgagaccctgtctcttttgaagaaaaaaaagaaaaaaggaaaaaaaaaaagaaaagaaaagatgagatacttctgcacaggcatccggctaatacatatggtgctgggtctgacccagctctgccagccttgtgcttacttctgaaaaatgacttttgttcctgcccagcctgtacttctgtgtgagaatttgacttttagtgagaaaaccccatggtaagcgttgagcgtggggagcgtgtgaccctgtttctcagcgtggggagtgtgtgaccctgtttctcacatgttgggagtgtgtgatctgtttctcagcgtggggagtgtgtgatcctgtttctcagcgtggggagtgtgtgatctgtttctcagcgtggggagggtgtgaccctgtttctcagcgtggggagtgtgtgatcctgtttctcagcggtggggagtgtgtgatcctgtttctcaacgtggggagtgtgtgaccctgtttctcagcgtggggagtgtgtgaccctgtttctcagcgtggggagtgtgtgaccctctttctcagcgtggggagtgtgtgatcctgtttctcagcgtggggagtgtgtgatcctgtttctcagcgtggggagtgtgtgaccctgtttctcagcgtggggagtgtgtgaccctgtttctcagcgtggggagtgtgtgatcctgtttcttgtctggtaagttgcttagtcgtgatggtcaacagttaatgcttaatggtggcacttctgctagacttttgtgcagtttttataaaatagccttgtaacttttcatggtttttaaaaaagtgatatgtttttgtttggtcttgatggtcctgttcccatttcagcgagccatgtcctccaaccgatgagcaattggttgcagggtaagaccgagacctctccaccgtctttctgtcttgattccggctgccttctcttcttgtaattgtgcttaattcctgatttccctccatgttgaagagtgactgatgaggcacacaggcgtggacctcactgccccagttcccccatgaatgcccagacttcccaccaccccggctttttctctacccagtcatttagctatttcacattacctgagaggccaaggcatggctggctggcacccgggagacttctgggaccaggcatgtcacacaaacctcctcttcctccaggtaggcacaagtagtcctgtgagggtggcgggcaagcaggagtggactctgtcatctccctagtccactgccgccctagagagacctgtgactgttgctccttgtttttattttttgaggggttttgtgggggcctctcccaagggttgggcattaagtgtgatgctcaggcctagatgctattgagtgtgcttaatagaggcagaaatgttctcatggaattgatatggtgcttgtccaggagggcacggatgacgggcgactcttccattccccttgacagtgcatctcctctgggccttggaggtacacacagtgtctgtgagcttccagcaaggaggtgggtggggcgagcagagttgagctcccctccaggatgtctttccatccctttaggtgggtggggggagcagaactgagctcccttccaggatgtctttccatccctttttttgtccaagctagagagcaaaccctactccagaatagctcggcagtgatagaaggtcctggcctgttttctggctgggctggttcatcttcctaaatgtgtttttcttgaatttccaagttattccaggaatcttcagtttttgtaacagatgttttattgtgctgcagtacatttattaggcctttcaccatcaaaatgagggaaaaggattttcataaatgttggaagccaataaaacaaaacaacacttgtttatggttcagtttgctgtttataagttttgccccacccccaatctcatgaatataactctgtctttatgtgtattacattaccagacagactatataaagtataaagccagatgggtgcagtggctcatgcctgtcatcccagcactttgggaggccgaggtgggcagatcatgaggtcaggaggtcgagaccagcctggccaacgtggtgaaaccttgtctctactaaaaaatatgaaaaattagccgggcttggtggcacgcgcctgtaatcccagatatttgggaggctgaggcagtagaatcgcttgaacccaagaggcggaggtttcagtgagccgagattgcgccattacactccagcctgggcgacagagcaagactccatctcaagggggaaaagaaaaagccgctcaattgttttgtcatggggccgggcgtggtggctcacgcctgtcatcccagcactttgggaggccgaggcgggcggatcacctgaggtcaggagttcgagaccagcctgaccaacatggtgaaaccccgtctctactaaaaatacaaaaattagctgggcgtggtggcgggtgcctctaatcgcagctactcgggaggctgaggcaggagaattgcttgaactcgggaggcggaggttgcagtgagccgagattacgtcattgcactccagcctgggggacaagagcaagacttcgtctcaaaaagaaaaaaaagcgttttgtcattatatgtttgtaatattaaggtgtggggagtagatttctctgtgggccagatttgctcagataaacaatggctaactaccaccctgctggctgcctcagagggctccatgaacagccactaagtcaatgtgactgtttttttttttgagacggagtttcgctctgtcacccaggctggagtgcagtggcacgatctccgctcactgcaacctctgccgcccaggttcaagcgattctcctgcctcagcctcccgactagctgggactacaggcttcactgcgcccggctaatttttgtatttttagtagagacgggggtttcattatgttggccatgctggtctcgaactcctgacctcgggtgatccacccacttcagcctcccaaagtgctgggatgacaggtgtgagccaccacgcctggcccagtgtgcctttttacttcagctcacagatttccagttggccgtctctgcagaccctggcctctagcagggaaagagccttttatttggctgttgtgagggcgccttgaagtttaggtatttataaacgcgaactgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtgaggcgttggccctgggtcagttgctagagcagaagtgtttggtggcgttttaatacctcaaaccctccttcaacattaccatgtcccacagatgggagttatagaacagagtgagccatttagggtttttgaagaaagcatattatgcctgtggtgtaaggcacttgaatcctccatctctgcaggagagacctgcagtgggctgctgaggacttggctgtgggtcctgcgtttcccaggataactctaacaagattgatttcagaaggtccaactgcaacctgactgggttgagaggctatttccaaatggcacaaataggtttgaccaaaccctcgtatgtggtttgtttgtgagcctagggtgacttcggatggttagagggtcgtgccagttcaggaggaaggctggaaaacagtctgagccccacagcccatgatagacttggaaagaatcatgtagctacttgccatttgctattacagagctgagctacagtgcagttcaaagcaggccttcctttttcatcacaacatggaggagttatgtcagtctctcccatcccttcaccaagagggcctctggggaagaagcatgaccaggtttgcaccctagaatgtctgtcctcagtggtctcttctaggaccttaggggtctccctgcccaggggcagagtatggccctgcggaggctagagcttccccaagagagtgcaccctcctgacctagatattagatatatttttcctgggtggagagatatgtatgggacttctctctcttctgggtccagatcagaggtagtacatttgtgtttctagagcggaggccctcagagccctggactctgagataagagtcagcaccacccacagcacccctgcaggtgacactcccttatccagatctccccaggcaggaggcatcagcattgccagtaaggagacagaagggcacagatgaccttgaaaaggggaaaagggatgccctccctcccacaccacagctgcacccacttctccgtggcacccagttgtgtgcaacctggtatttctgccatttggaaatagctgtgatcacagtgggcttgcacatcttgcacaaagcttcttccctgataaaaaccggaaagtttaagtgtttgggataagggaacggatgggcagccatgctatgaggaaggaagtcagcgctctgcacgcatccctgtgcactgtccccttgccctccacgcggctctttgggtgaagggccgctctgtgggtgaagggcctgggtcctgggagttgaaggtgcagcacagcaaacctgagtgtaactgggagaggcccctctgcctgtgaactttaaagagcagctccgcagggcagtgccggctccagctgatcctccctttgaaagcaaactgcaactgtttctctcctgaatttaatagagcatgccaaaaaatgacagcatgtgccttcagtctgtgcttctcatgccttttaccttgtaattctggtgatcttacatccataacctctgggattgctacagaagggcaactgttagtagcttccaccagcagtcggggcagagcaactccatgaaggtgcagtttactgagacccttccgctctggggccagcagggcatggtgctgtggtattttgttaacttatttttattctacctctcttaaattttaaggttttcagatgttattctggcaacaattttggcaaccaagtctgaaatgtgtggccaaaaatttgaactgaagattgataatgtgcgatttgttgggcacccaacactgctacagcatgctctggggcaggtatggctctccctgggcaggtggggctctccctgggcagatgtggctctccttgggcaggtgtggctctccttgggcaggtgtggctctccttgggcaggtgtggcttcccctgggcaggtgtggctctccttgggcaggtggggctccccctgggtagatttggcttcccctgggcagatgtggcttcccctgggcaggtacagaccctctgggaaggtgtggctccccctgggcaggtgtggcttcccctgggcagatgcgtctgtccttgggcaggtggggttctccctgggcatgcacagaccctctgggcagatgtggctctccctgggccggcaggcctggtccattctggctctggggggctcagaactgaggctgacaccagctctggtgaaggtactgggcaggagacctgattagacacttggtatgaactgtgcatcttcataaacccagagagtccagtagaaaaagagacaggtgttcttgcccctgaagacaggtgcttcagtccctgtccctagcttttacagtctgcattctaggtctctactgactgtggccctccccttcatatgtaggatgtctgtttccaggggaggccaagatagtgagttaactagcatcgtgaaacccttgaattttctacagtgtggtgcaagcatttcctcttatttattacaagacactctagtagctaatattagtattatttagcacttatttttctgctaaaccctctctatatgttctcttgatgaataggtgtcatagcactgaggaactcatcttgttagcaggatgaagggaacttgtacaccagagcctgccagtcagctctctgcatacaggcaggatcagtgatggcattactaagattctgaagggtcgaacacagtaacgtaggatttagctacatttatacagatccagcaattctgggaggttctgtggtgttattcgtgaacctccatggaaggagtttctgaggcggttgatgagcctggtcccctgtaccgcaccctcccttctcatcacagcctccacagctggggcacagtcccctacctgtaggcaatgaaggggagagttggcagcctgcccgcggtcacaccctgtagacaggagtggcagtcaggggtaggggatgggtgccagggcagcctggggccccaactccccctggtggcagaacttgtagttggctttgaagagttcccccgtgccccttggaatgcttcccttgagcgccctggtccttgtgaagctggctggatgccagaaccgggagcacagaaattaggacttgctggcctgcctcacctgggccctgctcagggcttggctgtccctgaacatcgtcctgtccctcaattgttctgagtatgcgtcatacttagcagatacagcctggtggatgcaggcgggcacgggaaggcagtgggggtgtgggtctgggtcctccacccatttatgcccctctccatctcgtcccctgtgggcattgtcagctcacttctgttagcgggggggcgagggggtcagagcactgaccttcccactcttgtcatagttgtgactttgcccatgcagtaggcacgcctccagagcaaaggcattcattgcttttccaagaccttggtgctgtattctggggacttttgccatgcctgaagtagaatagctctaaacagctttccttagaaagtcgtctcaattaattagaattatgcatcttttacagatctccaaaacagatccttccccgaagagggaagcacctactatgattctttttaatgtggtgtttgcactgagggtgagtgtttatataaatggttaagatcagggagtggggccagtggagaagcagctctttttttccaacgagcgtgtcattgactcggagcttggactgcagcgggctggcccctcctggggtgcaggcagactgcacttcattgtttacccctttttgttttggtaaaatacacataacactatttgtcattttgaagtctatgcttcagtggcatctggtacattcatgttgtataaccatcaccactatctagatccagaacactttcaccaccccagaaggaaaccccatacccattagcagttattctcttttttttttttgagacagaatctcgctgtgtcacccaggctggagtgtagtagcgcaatcttggctcaatgcaacccctgcctcccaagctcaagtgagtctcctgcctcagcctcccgagtagctgggattacaggtgtgcgccaccacgcccagctaatttttgtatttttagtagagatcggtggggggggggggtctcgccatgttggccatgctggtcttgaactcgtgaccttaggtgatccacccaccttggcctcccagactgctgggattacaggcgtgagccactgtgccctgcccctgctaatttttgtattttttgtagagatgagttttcaccttattgccctggctgatcttgaactcctggtctcaaatggtcttccctccttggccacccaaagtgctgggattccaggtgtgagccactatgcccagctggagcttaatttttaagacaggcctgccttgttgataaataaggaactacaaattaaaacaaaatgatttgttaatggctcctggggtacagggttctgggagaagttcttcactttctgcttgatacacttttgtagtatttgcattttcatagcatctttgtatttcttacataattacataatataaagcgccacaaagaaaaatgaattaagtaaaaaaacaagcaaaggagtaaacaaaatccatgacgaatgttgtccacctgtcaacaccgataacccctgtgggacagttgatgaaacgcagccacagccccacccaggatgctgtaggcaggccctcacctcggggaacagtgtttgcaggatgctgtaagcaggccctcacctcggggaatagtgtttccaggatgctgtaggcaggccctcacctcggggagtagtgtttgacagcatagcatatgatgcccttagatctagcagtcccactgttaggagtattatcaagaaaaacaagcaacttttacaactgcgtaaagatttcccccaggcttgttctcagcaagaataaagatttttataacaataattaaactggagataatcatagtgtgtagtagttggggagtgattaaacaatgtggtgattattatacactggcccatcctcttgccatcaagggtgagaaatggagatcagaccagaacctggagaagtatagattgattacggacaggtaaaagcaaccggagccgagcacaaatgcttacgcctgtaataccagcactttgggaggctgaagcgggcggatcacctgagatcaggagtttgagagcaggctgaccagcatggagataccccgtctctactaaaaaatacaaaattagccaggtgtggtggtggacacctgtaattccagctactcaggaggctgaggcagtagaatcggttgaatccgggaggcggaggttgcagtgagcagagatcgcaccattgcactccaatctgggcaacaagagcgaaactccagctcaaaaaaaaaaaagcaacaggaaacaagatagtctaggacttcagctggccgtgatattgacgagtaggagaaattttgataatgtaaagagtttgtattttttgggtggacaagtctttctttttaaaatatatacttttgtcattttaaatatatattctttctttttaaaatatacacttttgtcattttaaatatatattctttctttttaaaatatacacttttgtccaggcacagtggctcactcctgtattcctagcacttcgggaggccaaggtgggtggatcacttgagcccaggagtttgacaccagcctgggcaacatagcgaaaccccatctctacaaaaaatacaaaaattagccaggcatgatgatgtgcgcctgtagtcccagctacctgggaggctgaggtgggaggatcacctgagcctggaaggtcaaggtggcagtgagcagtgatcatctgctgcactccagcttgggcaagagagtgagaccctatcttaaaaaaaaaaagaaatacacttttttttttttactctgaaaaattttaaaccctgaaatagagagagcagactgacaaaccttatatgcctgtctcaggtgcctttaaaccctggctccatatatttccttccctctctctatttcaaggcaagtcccagaccttatgtctgttcatccctacatacttcagaagatatctgtataaaatatgggcacttaattttcggccatgataccctttgtacatctgaaaaaatttgctgtaataagttggcatcacctagtacctggtccattgaagcttctcctgattgctaaagccttttcacagctggactgtctgaaccaggatgcaaacccagcccagctagtgcatgtggtgtctttatgtctctgccaatccagaggtctcccctccctttgttccatcaaatgttccacatttggattaatctcattgtgcagtcagacttgctctctgtccctgtgtttccttcaaactacaagttaactctgaaggcttggttctatttgggtacaagttttggggatgagaaagtctcatgcgtgatgccttaaacttcctgccactttatgtcgtgtatggtgaaaatatggtgtttctaaaagttcccattagtgctggcacaccctaggtgttagctttctcagcatgtccctcactccatgtcaggcctttgcaaaccggacatgctgggacaccccatgagtgcaggtcactgagcgtcactggggactgcaccactttgtatgtctggaaaggtcaagcatatgggccctggacatccaactcatggacactgttgtgcctcagctgaataatcacatatccaggatcattgtcctcctccttgctttgctcgtggaagtatttgtacacagattcttcttctaggtgggtattttgttttgaggcaattgtatacaccccatatgtcagccctctggtcccaaggacactgttgaggcaatgcccttgacatggaggagcaggtctgctgcccagtggtgggcacagcatgggagcaacagtcctttctctggcaagggatgctgccttgttgtaagtccatccaggtgtgagttctgtttgtgaacatgggatctgatgagaatatagagaatttcttcagctccagatgaagaacgtatttactgtctgggtcaggctttgcccctgaagcctggctgtgaacactttgggcatggccttccctctcagataaacaggagggggaggcagcaccagaggttgtaatcagcagtaccattcacccctttcccttgtcccacctccacccccacaggatgactcagcagtcctgttggcctccagaagcactgagtcatggttggcccagttatctgctccctcaagtgttttcacagacccccacagctgcatgcctccacccttggcttgggcagatgtgcttgcctggctgactgtggtccctgataggttccagagggtcgagggcccctcttgttcctgagagcctcctgcactgtcctttgacccagtcatcatggttgcagaaggagctcttgggcagagatatgggcctggagcctgctggttttcttgttaaccagtgtgacttctgctgggaagagcttctcatccttcaggaccaaaagtattcagtgaacaattggcctggtgcctctctttttgtaccgtgcatccctgtagtaacgtggcctgtcgtgactgaattcttacaaattgtagactggttctgcctaccagtagtcagcagtacagtggtgaccacagacactagcagggtctttgctcagggcaggttctgttcttagtttgttacatggctcgctaatttcttccattcagtccttggtgagggaggcaccattgttgttcttccttaagaacaacagtgcctccttagggcacccaggcatttccagagccatctctgttactattcaggcagccactcccaagaacagagcatgggggctgacagcccacatgtctatggatgggccctggaggggactcaggaaatgagcagcagtggcctctgcaaaggagcctgggggaaaggagtagagacgctttctttcatggtttgagtttttgctgtgtacctgtgttagctccatttaaactgtgtccagctgtgtccctgtgcacacgtttgagtctgtgtatggtctctctcctgcaggccaacgcagacccgtcagtgataaactgtctgcataacctgtcccgtcgtatcgccaccgtgctgcagcacgaggagcgccgctgccagtacctcacccgggaggccaagctgatcctggcgctccaggatgaggtgtccgccatggctgatggtgagtgcagcagggcgtgatgggcatgggtctgggctggctggtggcctctctgcagcgcagacctctgtggaggggctgtcattcagtgttaatgatacagatgttggcggggcctcacccaccccaacaccagcagagcagtcaggagcttgcaagcatcggcttttggtgagctgtgcattgaaaatgaagtcctcacaacagcttcgctaggcagtgtccatgatcatccccattttgcagatgtggaaactaaggctcagagaagttacatgatcttcacacggggctgattgtgcctggggggcacaggaagactcccaaggggcacatttgtagatgaattttcctggctggatgtgttgaaatagatttcccgaccagaaatgttctttcttcccacacactgctgcatgatcaccgttcacataggtgaggcagctctgcctagccctggtcctgttggagatgttgaagaaactattactccctggggcaggagagggcgttggaaatatccagctggtgaggtggacagtttccagttctttgctttcagccagattgaaggaggacctaattgggttatcaactaaccaattattaaaaataatttttgcagacagaacattgagtgttttttggcctactgtaaagatttcaaaacataaagagacacctgtaacaaactctccatctccattttctttggccagcacctctataacaaaagagagaattaggaacaaaactaaagtcagacctagttgttgtagcaataagtaaaattagttattgacatgaatgaacaataataaaggaacagcctctctgactcaggtgcattttcagtacaaatttacctgtggctggctgcggtggctcatgcctgtaatcccagcacttagggaggctgaggcaggtagattgcttgagctcgggaattcaggatcagtgtgggcaacatggtgaaatcctgcctctaccgaaaaaaacccaaaaattagccgggcatggtcatatgtgcccgtagttccagctactcgggatgctgaggtgggagaatcacctgagccttgggaggtggaggttggggtgagctgagattgcaccactgcactccagcaagggtgacagagtgagaccctgtctcaaaaaaaaaataaataaataaaaataaaataaattttgacaggtaattgtcaaatatataaagtttttcttttgttttttcctctgtcacccaggctggagtgcagtggtgtgatctctgctcactgcaagctccatctcctgggttcacgccattcttctgcctcagcctcccgagtagctgggactacaggcgcccgccaccacgcccggctaattttttgtatttttagtagggacggggttttcaccgtgttagccaggatggtcttgatctcctgaccttgtgatccgcctgcctcggcctcccaaagtgctgggattacaggtgtgagccaccgcgcccggttacctgtcaaaatttataatatgtttctgttttggccaattatatactaattataattgtgataataacaatccaaaagttttgtttttttaaacgttatctttttagagtctgtgactttatcacaggaagtaaaaagaaattttattttaagtctatgtatatatttttagaaatttatgaaaaaggatgaataaaagactttttggctggatgtggtagctcacacctgtaatcccagacaaaaaattttaaaattagcaggtctaggccaggcgtggtggctcatgcttataatcccagcagtttgggaggccaaggtggatggatcacttgaggacaggagttcgagaccagcctggccaacatggtgaatacctgtctctaccaaaaatacaaaaaaattagccagacatggtggcgggcgcctgtaatcccagctacttggaaggctgaggcaggagaatcgcttgaacccgggagctgtaaatcttgtgttgtgattcttgtaggaaatgaaggtcctcagtccccattccatcacatcctgcccaagtgcaagctggccagggacctcaaggaagcttatgacaggtaagacaggtgggtgtgcttattaacctccttcttatgggccagcctgcctgggcctgaggagcagcgtcaacaggtagggctccccggtactgaccactgttctcctggggtgtgagcatcagggttccctgaggttagggccggagaggactgggaagggatggtcatgtggctgctcttgaaagaagtgaccttggtggccgtttttttttgtttattttttatttctatttctatttatttcttttttttgagatggagttttgcttttgttgcccaggctagagtgcagcggcacgatctcggctcacagcaacctctgcctcctgggtttaagagattctcctgcctcagcctcccgagtagctgggattacaggcatgcgccaccacacccggctagttgtgtatttttagtagagacggggtttctgcatgttggtcagggtggtctcccgacttcaggtgatccacccgcctcggcctcccaaagtgttgggattactggcgtgagcaccgcgcccggccagtggctgttttttaaatggtttgctgagtagggtgcactctgctggaacttacatcacaaaagacaaatcactctcctatgtttaaggacttatatttcccaatagaagaatgaacaagggatctgagcagtgagctcacagaaaagacaggtggttcaaacatgtgaagagatgcatcagtgcatcacaataaagctacacagagatcccattccccacctgttatactggttaagatccacaatttcacgagactcgatgttggcaaagctcgggggaagaggcatctcgtgtgttgctggtgggacagaggtacaaacccctgagtacctttgcttttttaaacccctttgctgagtagcatgcactctgctggaaccaccacctccagactcctcttaaaacagaaaacgagcccgaagttatacatgagagtccgaaagtgtttttaaatcaaacagatgcaaaatgccattttactgagcatgacgcaacaccaagtgctgggccaccttcactaggtgggtgtcactgactccagtcactcaagaggaaattgaggctcagtgggtgaggctggggccagctgtctcctctcagtctgagagagttggggtttgcgacactgactgtgtgagggcagcaagccttgaggataccatgaaaacctcacagttgttctgattgtattggctgagcatcacctttattaaatgtggacaagcaggccgggcgtggtgactcacgcctgtaatcccagcactttgggaggctgaggggcggatttcttgaggtcagaagtgcaagatcagcctgaacaacaatgtgagatcgcatttctacaaaaaatttttaaaaaatatctgagtgtggtggcacaagtgtagtctcagctactcaggaggctgaggtgggagggtcacttaagcctaggaaatcaagattatggtgagccatggttgtaccattgtactctggccccagcaacagagccagaccgcgtatcaaaaatgaaaaaaaaaaggccgggcgcggtggctcacacctgtgatcccaacactttgccaggctgaggcgggtggagcacgaggtcaggagttcgagaccagcctggctaacatggtgaaacccgctgtctactaaaaatacaaaaaattagccgggcgtggtggtgcatgcctgtagtcccagctactcaggaggctgaggcagaagaatcacttaaatctaggaggcagaggttgcagtgagctgagatggcgccactgcactccagcctgggtgacagaactagatgtcatctcaaaaataataataaaaattaaaaaacaaaagtaaaataaaaaataaataaaatttaaaaaatactttttaattctttttttggctgcctagtgagccgcaactgcccccaccattgagtttgttccagccttccagtgctaaccatttacctgtgttattttgtatgtgcgcctctgtatctataagataaattcctaaaggcattactaatagggaaaatggcatttgtaatgttgtgtttccttctcaggggtttgtacctctgtcccaccagcaacacacgagatgcctcttcccccgagctttgccaacatcgagtctcgtgaaattgtggatcttaaccagtataacaagtggggaatgggatctctgtgtagctttattgtgatgcactgatgcatctcttcacatgtttgaaccacctgtcttttctgtgagctcgctgctcagatcccttgttcattcttctatcgggagatataagtccttaaacatgggagagtgatttgtcttttgtgatataagttgcaactagcatttgtttgtctcttggtgaccctggggactgagcctccccaggtgtgagagaacatcagcccttgccaggtgattgctttgttttctggccccttctgtgttgcagaatgggacctttgtggtcatgtagtctgaccctgtctttgattcattgttatcacactaatgttttctctgtgttgagagaattactaccctctggctttgaattgcctggtatccagtctcttccttggacattgttcccttattctgagtgtatgcctcaactcggattagattacaaacaaaaatcaggctaacttggaattaaaataaaaaccaagctggtgcggtggtgtgctcctgtagtcccatctcacaggcgaggccaaggttgggggatcacttgagcccaggagttcgagcttgtagtgctctatgctggtgtctgagtagccactgtactccagccccagcaacatggtgagaccctgtctcttaaaaatttgtttaaataaaaaccaaaccattgactttatatttctttttcttcttcttttttttttttttttttgagatggaatatccttctgttgcccaggctggagtgcattcttctgcctcagcctcccgagtagctgggactacaggtgcacatcaccatgcctggctaatttttgtatttttagtagagatggggtttcaccatattggccaggctggtctcgaactcctgaccttgtagatccgcccggctcggcctcccaaaatgctgggatgacaggcgtgagcaccgtgcccggctcgttgactttatatttctaaaggaagaatggactatgatttcttaggtttgaatcgtgctggaaagttgaaaggagacaaaaccttggactgcctgttgtgtgatctgcaggctgcggaggagctcagaacttgaggcaacccagcgccacctagtggatattaaaggaggacaggaatctgagttttgctgaaaaaggctcctaagctgttgttcagcatgtagcattctttcctgacctacgcattctgtttgttagtgcccaggatcacatttcctccatccaaactcccaccctaacagtcttgggtcctggagcttgccccagggatgctggcagctatgtttctctggcaggagtccaggcagtagtaccctccctgtacccatccttgtctggcactggcatggctctgcagccacccaggagcccctctgggctgtggcctctcgtctgtcctcatcccatcaggtccatggttggcctcaagggtctggtctgctgctgctcactcttctgcactgagaggaggagactgagtttccattactgatcaggtgacctaggacagagcgcctttctcctgatggtgactgactgccagatctgggggaatctcagaacagaactgaaagaccagaagctgtgagattaatgaggttggagattggggtgggatttttcaaaggaattgttcctggttctttttttttttttttttttttttttttttaatttaaggcagggtctcactctattgccaggctggagcgcaatcttggctcactgcaacatctgtctcccaggctcaggtgatccttccatctcggcctcccgagtagctgggactataggcacccgcccccacgcctgaatagtttttgtatttttttgtggaaatgggattttgccatgttaccctggctgatcttgaattcctggactcaagcaatctacccaccttagcctcccaaagtgctgggattataggcgtgagccaccatgccctgcccccagttgctattttatttatttatttatttatttgtttgtttgagacggagtcttgcttcgtcacccaggctggagtgcaatggcacaatctcagttcactgcaacctccgtctcccgggcttaagtgattctcctgcctcagcctcctgagcagctgggattacggcgcctgccaccaggcctggctaatttttgtatttttagtagagatggagtttcaccatgttggccagcctggtcttgaactcctgacctcgtgatctgccaacctcgacctcccaaagtgctaggactacaggcgtgagccaccacgtccggtccccagttgctattttaattaaagctagggttatggtgtggctgaatagcctggtggccctgtcctgcaggacctaacatctgtgaatataggctgggaatgtgaatcgctcaggaggccaccccaacacttgtgccatacctagcacttgtgtctccctgtggatcccagtggccctcagtgacagcatgtcactcattcatatgaccattgaattgtgtctcccaggagggcagggatgtctcttcactttctgcaacacagcccctacactcagcctgtggaggagcacagctcatccgctaggggtcgacggaatgtgtgggtgggaataacagcagtgtagattccatggagtgtgaagaagtgatttgctgaatggttctccgagttaacaggacctgtggtggggagtgatgtccagggtctggctgggtaggtggtacttggtgcggagccttgcactgcaaactgtcgagagcagggttggtcccatggaccctctgtgaatatcctgagttgtagtacccatttccataaaaatgcacctatatataaactttcgtttgaaatttcaaggtaggctgtttggaacccacatagatcttttgggttatgcagcatcccactacttatggtaggaagccaggcccatccgtgggaccagaggatgcagaggtttgcaggatagcttcacaggtcctgtctagttctaaggttaggaatggatgctttctcagatgctaaaagctgaggggactagactaagcttgtgcacatttctgtcttggagatgaacggcgagagtgtgtttgaagccagccattcccttttgcatagtcattgtcaggatgcagggctttggctggggcacctatctcctgtcacagactgggctgggccctcttggctggcccagagctgtgtgaggggctggataagtcttgaggaggacagtgttttcctccagagtgttttcagaccaaaccattaaacaccttgcaaatagaagtgcaagctcggcaggaaacctttcagggcccaaaccctgcttgtgctaagggctcttgtcttaaagctgcagacttaaaaacagtgacaaacctttctctttccccttgttaacagacctcagtgcagctcctggcttaccctcttactgtgggggatttacaggctggaggttgggccggcacctttccagagcagtcatccctctgacatgttcagggaatttgcccaggtctgccatggcctttggggcactcctggtggcagcacttgtcaccgctctagggagctgggttagttcataaagaagcaccagcctcagtgcagagtgctctgagggagaaagcagcaggtgggtgagctgatgcttgggaaaatggagtaaagtccacgtggaagttagaggaaccaacatggcgtgtctctgccagaggagagggccccatgccagtgtacaaaccagaccacatgactgcggctccaaggacagctgacacggtgagggcagcagagatgaccaagctgggaagtcactagaagaaccttcatgtgaccctcctgccctcatttctccatacccatagctggaacttgttcctggctttccatgaggtgtgttccaagcccctgttcctttccctataactctctccagtttctaatgctccatacaatttgattacaattaggtgtctttttttttaaacgttaatttcaattttttttgagacagggtcttgctctgtcacccaggctggagtgcaatggcgcgatctcggctcactgcaacctccgcctcctgggttcaagtgattctcctgcctcagcctaccaagtagctgggattacaggcacctgccaccacacctggctaatttttttttttttttttgagatggagtttcacttttgttgcccaggctggagtgcaatggcacgatctcagctcagtgcaacctccgcctccgcctctacctcccaggttcaagtgattttcctgcctcagccttccaagtagctgggattacaggcatgcaccaccacgcccagctaattttgtacttttaatagagacggggtttctccctgttggtcagtctggtctcaaacttctgacctcaggtgatctgcccatctcagcctcccaaagtgctgggattacaggtgtgagccacggcacccggcctaatatttgtatttttagtagagacagggtttcaccatgttggccaggctggtctcgaactcctgacctcaagtgatcggcctgcctcggcctcccaggttttgggattacaggcgtgagccgccacgcccggccaattatgtgtctgtctagatgccgctgagtgaagcccccagcgtgcagagcagccaagttattttcttccctgctgcactccaagtacctaaactggtgctgggagccacagcacatgtcataaggcctcactgtgctcctagatggagcaaagacagctacatttgaaacaataggagcctccgtattctgattctgtggtgtcccaacagccactttgagctgcatcctaaataggacagaaacagaaaggccttgggtgggtgcggtggctcacgcctgtaatcctagcactttgaaaagccaaggtgggaggatcgcttgagcccaggagtttgagaccagcctaggcaacatagaccctgtctctacaaaaaaaaaaaaaaaaaaaaaaaaaaaaatcaccccaggcgtgatgttgcacgtctgtagtcccagttacttgggaggttgtcttgagcctgggagatcaaggctgcagtgagcggagatggcgccactgcactccagcctgagcaacagtgagaccttgtctcagaaaaaagaaaaaaaaaatagaccttttatttccagtggccctcctttctgacccagatggtgacagcacagtgcatggggccacctctcgcttgccctttcttccctgtcgcatacggatgccaagatcctaactattgcttactcaagttgagtaacctggatcccctggacaaatctctcctggtgtgatctttaattccttagcggctgggacatttctcagggtttgatacgagtttttcaccctgcaaagaccctgaccaaagagaggtaaggttctgggagcctctgtctgccccgacatacttggttagcatgcagttctggaagaagctgagactgctgccctcctctgggaccttggggccatggtgttctctgagcaccccgtattgacgtgtcctaagagacgtccgaggggccgtttgtaccttctggcctggggcagccagaagtctggccaagtctcccggacttagccggatgtgggtgtgttggcctgtcccgccaactgggagctgagaatagcagaatagggtcagggggtgatgggaaaagcactagttggctgctctcctgggcagtggggcagtgaacagaggaaacatgatgcggggaggtgctgtagaaatgggcagtttggagaagaacttgtgtgtgttttgctcctattttagaactggtgtcattgtgaggcttcacaggctgcgttccctgtgcaggacacaaggaaggtgccggccactttgagtagccaggccttgacaagagtaggtggagatcccccctgttgcctggagcctccggggatgcggtgaaggccagctgcagacagctttgcttgagcagttgcatctcctctgtgtcatagaacaagtgctgttggctcttacttaaggcaagggcgctttgtggtgagcggtggagttgggtggcgccctggcttctccatcagggagttttagaagctcctggtgaaaacaactccttccttgttttgtgtggttccccgaggggatgacgtgggctgcatccccactgtggagcctgttcttggggcagggcttcctaggaaagacagtgcatgcagggagggcggtgtgttccttggcttcattcaggaaatgcagctccgtgcctatgtgcctgacacgttttacaatgtgtagagagcagagaatgaaacccacaagcccccctcctcaggagtgagttctggttggggagacagcattaggcagcgggtcaggggttggagtgtcaatggggctggggtcaggggtgcttcactgagaatgtgacacttgagtggagaccgatggagtaaaggagccttggggcgtctgcagagagtttgtgggcaagggcaaatgccagggccctgagcacagcgggacctgagtgactgggcacagggagtgaggccacaggaacgtgggtgttgcaggcccatggctgggactgcccaggtgggagtgtggggagcggtagtcagaggggccagtgctctgggtggcttgggcctggtgatgctgaaaaggcctggattttggacatccctgcaggtggagcagatgggatttgctgatggtttaaagtggactgtgaaagaaataaggaaactgggatggtgttgctatgtttggcctgagcaagctttgggacccgaaagaaccaagttacccttactgatagaatgtggagtgaaaggttttccgtcgtagtgaagtgttggggctggctagcacggctggcttgtggtgaccacttggtatccacatgcactgcaactgaggtgctgtgggcatctgcagactgcagggaggtgggcactgtgtgcttctcaccactggaacactctgggggacttggcattccttccctgccctcctcgccctctgagacagccactgttctgcctggacgtgcacctgtgatgggtcttcatgaggtgtgcagggcaggcccattcacagggaggatgtactctgggtgttgggtgtctgccaggggtctggacgggcaggggcctgagttagagtgcctctagtgcactgagtccccaggacagggtacggcttctctcaagccctggcagtctggttggactacagattccagggctagccagaaatatgtttctctttttctttcttcttcttcttccttttttttttttttttttttgagacagagtcttgccttgttgcccaggctggagtgcagtggcgtgatgttagctcactgcaacctccacctcctgggttcaagtgattctcctgcctcagcctcccgagtagctgggactacaggcgcccgccaccacacctggctaatttttgtatttttagtagagacggggtttcaccgtgttattagccaggctggtctcgaactgctgacctcgtgatccgcccaccttggcctcccaaagtgctgggattacaggcatgagccaccgtgcccggcccccatattttcttttcttaaacataatgtgatcttaagagatgctctcctgcccgggtctccacctgcagtttcccctaagcagcaggggaatcagcaccattgagcagggtgttttctgatctgtgtgcatggttagaaagtttatgtgaacgggtaacagcgcccactctctgcagcctgtgcacgtcgggcgtagttcggcttcacatcaacagctggctggaggtgagcttctgcctgccccacaagatccactatgcggcctccagtctgatccccccagaggccatcgaacggagcctgaaagccatccggtaagtgcccagccccacgtgctcactccctgccagggcccttccctttagcttctgcctgagattttaccacttactttgttccaaaatttctctttttcttcttcccactgcggaagcttgcaggtggggctctgccgtttatagaagttaaaacacataattttgtatccagttgtgtccagaaatgaccaatcccaggtttctcctgggcccttctggcaccaccttaggcttgggcagggcagcctggatgtggggctgagtgtccttggggaggccggagggctggagggacttcatcttaatggtgttgccctaccccagtcttttgcatttcagtcagcactcatgggatctcagttattttctttttcttttttttttctttttcttttttttttttttttttgcgggggtgtgtgtgtgtgtgagagagagacagagttttgatcttatcgcccaggctggatttcagtagtgcgatcccggctcaccactacgtccacctcccaagttcaagtgattctcctgcctcaggctcccgagtagttgggattacaggcgcccactgccatgcctggctaatttttttggtacttttagtagagacagggtttcaccatgttggccagactggtctcgaactcctgacctcaggtgatccactcatcgctcatctcagcctcccaaaatatactttcttaatttaattgacttttttttttttttttttgagatgtagtcttgctcggggctcaagtgcagtggcacagtctccactcagtgaagcctctgtctcccgggttcaagcgattctcctgcctcagccccctgagtagctgggattatgggtgcacaccactacacctggctaatttttgtatttttagtagagatggggtttcaccatgttggccaggctcgtcttgaactcctgacctcgtgatccacccgcctcggcctgccaaagtgctgggttacaggtgttagccaccatgccctggcaatttaattgattttctgcaaggaaagaactgagcccagtcttctggcaccacctgttcccaagtcccccaataccttgaacattttttaattataaaaatatatctgggcacattgctgaaaatttggaaatgacagaaagcaaagcgctgcctagttccaccctccccagtccgtgctctttgctttcaatcctagctaagcatattttaatgtactttggtccctagtctgtgaggaggattttgcttttcccatatttgggacaatttccttaggaaagattcattcatgtcttcaatcaacagatgtttgctgggcgtctctgaggtgggatacagagtccagtcttcgagccttccccacttttgtcgtgtttttttccgagggtgacataatccttgcaggttttgtttttgttgtttttgagacagagtctcactctgtcgccaggctggagtgcaatggcgcaatctcggctcactgcaagctccgcctcccaggctcaagtgattctcctgcctcagcctgccgagtagctgggaccccaggtgggtgcaaccacacccggataatttttttatttttagtagagatggggtttcaccatgttggccaggctggcctcgaactcctgacctcacgtgacctgcctgccttggcctcccagagtgccgggattataggcatgagccagtccttggcagattttgtgaaggcctccaaacagaccactgcccttttctcaaatcccgctcttggcccttctctccgcagttaagggccaggaggctccagctgcctgtttgtgtcccaggtgcatacctgatgcacacccggtgcaggacctcgtgcaggacctggtgcatacctggtgcagggttccctgcacttcgtatgttccgtgtgtttgagtcccaggtgcatacctggtgcatacccggtgcatacctggtgcaggacctggtgcatacccggtgcatacctggtgcaggacctggtgcatacccggtgcagggttcctgcacttcgtgtgttccgtgacaggtgattgttttgcagcccctaccatgccctgctgctgctcagtgatgagaagtccttgctgggtgagcttcctattgactgctcccctgccctagtgcgggtgatcaagaccacatctgctgtgaagaacctgcagcagctagcccaagatgcggacctggccttgctgcaggtatagctctggaggcccagatgggtggcatgtggcggtgctggggcatcaggaaaggcaggccgcctgccacagtacatccacaggggctgtgtccagctgagagccgcggcacagcccaccatggggtggggccagtccctgggatggctggaggttttggcatctgagtcagacctgggttcagggctggctttgtgagtgagccacgggactgacttgttcttctgtctcagagaggtaaggcgagtctgtgagagaaaggactggggtgcttgcagtcctggaggttgaggcaccagagctagggggtgggcagggcagcagcgggcagggccatgggggtctcacagtggtgcatgaacaacatacgggaactaagggcaggaagcttggatgcggggccctcccatgtgcagaacagagacctaacctggtggccttacgcccctgtgtgtgcacatgtgttggcctgtgcactctgtacaagatgccacgtccttgctgagccacatgcttatgggcctgtccatgcagagggctgccctttctgattagatggagggcccctcagcctcgtctgcggatctggttggagtgtgggaggaaaagcgcaggcaaggctgggcacggtggctcatgcctgtcatcctagcccaggactttgagaccagcctgagcaacatggcaaaaccccgtctctacaaaaaatacaaaaaaaaaaaaaaaaaaaatagctgggtgtggtggcgtgcacctgtagtcccagctacttgggggtatgaggtgtgaggatcaattgagcctgggaggcagaggttgcagttagctgagattgtgccactgtactccagcctgggcgactctgtttccaaaaaaaaaaaaagcacggggagaaatcagaagcaggggctgctgatggggtggccaacaggccatgggatcagctgtggctgctagtcatgtgggcgtggcccagagccacgggaccattgaaatactgcctgagggtgggagcaggtggtgcctgtgggtggcgccctcgtctggtggcggtgtgcacagcatggccaccagggggcagcagaggctgccgaggaacacaggcgtgaggtgggcccgcctgggtccctctggctgagcttccatgctcttttggcctgtgaaacaggtctctgcttagcacgttaggggaacttgtccaacaaggcctgactctcaggccacttttccccgaaagcagcctttttggattctgtctttgagagtaagtctcccgcctctgtatctcaggaccctttatctatcctctgtgagagcacttaccaaattgtgcccttgtatttcttttttcttttctgagacaggttcttgctctgtctcccaggctggcatgtggtggtgccatcatgatccacccaggctcaagcatcctcccaagtagctgggactacaggtgtgcgcctggctaatattttttttttttttttttttttggtagagacggggtttccctatgttgccctggctggcctcatactcctgggctcaagtgatcatcgcaccttggcctcctaaagggctggtattacaggcatgagccaccatgcccagctgtgcctttggacttcatgggctggacaggactcagtaaacaccatgtcctgcccaccttcatagcattcaggagacagagaattttaaaagaactcaccactccatacaaccctgcagagtgagggaggcagtgaccctccgtgtcctgatgagcaccgaccacatggtaaatgcctgtggctgttcactggtcctgtgttgagcttttgaaaggagctgggcctggctttcctgaggctgtctggcaggagtttgtgctggacactgtgcctctcatccttgctgtcagagtctccttggacaaagctttgatgccctcttctgaggttgtctggcaggagtttgtgtggacagtgtgcctctcacccttgctctcagagtctccttggacaaagctttggtctccttttgatgtccccttcacttccctgccgtggccttgactggggagagggaaggctgtttgtcattgttttcttctgtctgtaccccttccctgctgtccctgctgcaggtcagcagggcgttgctgctggtgtggcggtgcggaagcccctggggcccagccctggtgggtcactctgtttccggagatagccccctggggagcacctgcctcaggtgtgaatgtcaccagatagtttaaagtccctcatgtggctgggtgcagtggctcatgcctgtaatcccagcactttgggaggatgaggcaggaggattgcctaagcccaggaggtcacgaccagcctaggcaacataggaagaccctgtctttacagaaaattaaataattagctgggcatggtggtgtgtgcccatggtcccagctactcaggaggctgaggtgggaggatcacttgagccctggtgttcgaggctgcagtgaattgtgattttacacactgcagtctgggcaacagagcaagacccagtctcaaaaaataaaataaaataaaattcttcatgtttatatcaatccagagagaatctacaagtaaattttgggtgtgtcatgataaaattagtatgttacaagacttcaaacactacacaaattatagacacagaaagttcccacagtcccatatcccacaggtaacctagatccctccaggttttttatctgtatatatacattttattgtgtgtgtgtgtgtgtgtgtgtgtgtgtgtgtgtatatatatatatatatatatatatacacacacaaacattttattttgtattatgaaaattaggatcgtgctgtatattcgttgtgattggctgaataatggcccccacagatatacacatcctaatccccaaaatctatgaatgtgaactcatgtgggactttggagatgttactaagtagaagatcttgagatgggaagatcatcctgttgagctctaaatgtaatctctaaggcccttatcagagggaggcagaggaagatctgataaaaagaggcagcgatgtggccacagagacagagtggagtgacgtgaccgcaagccaagagacactggccgttgaagaggcaggacgaattctcttctggagcttccagagggagcctggtcctgctggcaccttatgcttgcccttaagtactgattttggattttcaatttccagaatggacagcatcttggagaggctgctgcagggagaggcaggaggtggagaccactatgctgagcagagctgggggaaagtgggggtgtctttttgagagagacatgcgagtggcacgtggggtgagggaacagggcggtgatggagctgaaacctgccatgtcggggttggcggagccattgggggcactactcgcacaatcttggctcactgcaacccccacctcccaggtgcaagcaatcctcctgtctcagcctccaagtagctgggactacaggcatgtgccgcagtgcctggctaattaaataaaaatttttggcagagatgagggtctcactatattgcccaggttggtctcgaactccgaggttcaggcgatcctcctgccttgccctcccaaaatgctgggactacaggcatgagccactcactcagtctggaggccctgttttctgagctgaggtataagtgtcctcagcagcagggcagcacggtgtccaggcaggggtgactcacctccacagaggcctacccgccaagagggtggagtggtgtcctgggctgatgcagaggcagaagtgcgagagcttaggatttcacacaccttttcgtgaagtgctggggtgctgtgctctcagacctcaggcctgagctttcctctggaaggggtttgggttgtgtttgtgtttcctgatgttcaagggtccacaagagcaaagctgggaggggggtctctgtgggagtcggggcacatggggcagacctggggcctttgggtatgtaggggtggcatgctgagtgactccacacccatcatcgggcaaggccatgctggagttttagggggtataagagggctgtgcccctgccaggacatccagctaagccccctgcccagctgggccagcactgtgttcccagcaccccagacattcccatgcttgtggcctgagaccaccattcttcagtgggagtcaagacagcataggatgggaaaacagtgccaccaaacagcacagggagcagtgacaaaaaggccattgtggccgggtgcggtggctcatgcctgtaatcccagcactttggaaggccaaggtgggtggatcacgaggtcagatcgagaccatcctggccaacatggtgaaaccctgtctctactaaaaatacaaaaattagctgggcgtggtggcatgtgcctgtaatcccagctactcaggaggctgaggcaggagaatcgcttgaacctgggaggcaagaggttgcagtgagctgagattgtgccactgcactccagcctgggcgacagagcaagactgtctccaaaaaaaaaaaaaaaaaaaccattgctcacagaaagtgctgtgtgctggctgtgccccacatcctagtgagaggttgcgaaggtgctattccacgttagggaggaagtctcgggccatagccaccaggtgtgttctgcatgaggctggggccagcttctccaggctggtaggccatggccacccaggctgagagctgctgacagctcccggtgggccagcctcaggcatggtccttgcagcttcccttttgcctgcaggttttccagcttgcagctcatctggtgtactggggcaaggccatcatcatctacccgctgtgtgagaacaacgtctacatgctgtctcccaatgccagcgtatgtctgtgagtgctgctggctgccagagcctggagccccgagtgggaaggggtgaggctggcagggccctccagatgctgttctctgtgttggccaggcaccaaaggctgtggaagccccaaggccaggctctcacttcagcctaactcctggccactagcatacccaggtcccaattctggtctggctctgtgctctgtggctctcctgtgtcccccatatgcctggccccctcctccaggctggctcttctaatccaccttgagggatcagaggtgagatgcaggatgaactgtgcccatggctcctgctgctgctcaaggggaagtgcccaggctctgtccacctggaggcctgcctggcctcataccgttctgccctcatcgcactgtcctgacccacctgccacactttgcttctctgctgcccactgaggccagtgttgagaacacggtgggggggtctgctgcactcactggcatgctcacctgcctgcaggtactccccgctggccgagcagttctcccaccagttcccatctcatgacctgccgtccgttcttgccaagttctccttgccggtctccttgtcagaatttaggaatcccctggcccccgctgtgcaggaggtgagtcacagaagctcaaggagcccagagtggcaggtgtgtagtggataggcactacctgcctggctgttggttctgatctgagagccctcagcactgccacctgcttctccttggttttgggggcttgccgtgcaagtgctacgtgcccagcaggacccaaaagtcagctgccgggccacctgcagatgcttggccagtgacccaacacttgagcagttgttccctccccatagagcccaccctggctgtggcaggcagtttttagtgttagaaccgagttaagcaggagagtgcttaccttttctgggcctacagacctgccttgtacccctttgggactggggactgcctacagatgagggtgcaaaggcagttttgttctcactgggccaggcctgaccctctgagagttctgcttctgtcttcactccctgccatggttcaggtggccacagggtctgtgggtatgagttctggggtcactggtccccagaatctcctcattcaagagagcctagagaggaccctagtgggcctggatcagggcaacgggcaggcaggttgggagctaggagtggctgggggataggaggcctcctgcaggtctgtgggatgaactggtgcacctgcatctgtggcagggccagtggcttcccctgtgggctgcaggtgtcatagccttgtgctgaggtggctttgccatcctcccctccactgagttctgggcagagactcagagcagggccagataggatacggtgttggagacagacgagctgggtgttctcaagtctttgtctccagaagtatctgagtaagtgccagatctattaggcaaaaccagtccttaaagttaaaccctttccgttctcaaattacgaatgagaacgattctggcttttcagctccgttagacgctaaacctgacagagctctcagtgcggtctttcacagagcccttggtttctgggagctgagccaggttgtaccagctgaataaaaggcactctctgcacccctgctcttggggcagtgcttagggaggagctgctggtgctcccttctcagaggcctcctgtggtctagataacggagtggcttttccaggccatgactgagtggttgctccaggccttgtcaaggggcctaggtcagccaggttctgcctgggctccagtgctgggaagcccctctgttttatttttggtttattgattttatttaattttgattgcacgtcaggctggagtgcaatggcatgatctcggctcactgcaacctttgcctcccgggttcaagcaatctcctgcctcaccctcccgagtagctgggtttacaggtgcccgccaccacgcctggctaattttttgtatttttagtagagacggggtttcaccgtgttgaccagggtggtctctaactcctgacctcaggtgatccacccacctcatcctctcaaagtgctgggattacaggcatgagccactacgcccagctttttttttattgttttgatatagaaacttgctttgttgtccaggctgaagtacagtggcgtgatcttggctcactgcaacctccgcctcccaggttcaagtgattctcctgcctcagcctcccaagtagctgggattacaggtgtgtgccaccacacccggctaatttttgtatctttagtagagatgaggtttcactgtgttggcaaggctggtctcgaactcctgagctcaagtgatccacccgcgtctgttttatttcttaaattcatgtgaagtctggatatcttgcagtccttttgaccaagtcttcttacttgcctgggatatatcccccattcccatccccagttccccagccccctcccaggaggtgaccctggccagcagctccttgttgaccctcccagagatgagtagacagatgtgtatctgaggacactgatgtgtctcacactccttactgttcaacgcctgagtctgggcagtactttctcatggggactggactctacctggcacaaggctcctcactgctcctcactgccagccccacctgctaacccagagacattggagggcctggccaggacgtgccttctcacggtgggggtgggggtggggtgctccacccccaagcccagggtcactggcctcagctttcttgtggatccactcttgtgctcagggtggactttcaggtagatccaaggagaggactttctgctctcagggtacctgcccacagcctctttttaaacagtgtctgggcttgtgtggaggtggacttgctggctgggtccaactccagggccagtgggccaaagaagagaggaggcagaggggcagctgcagcagcacagggtggggggtttgctcagcgaagcagtcacaggggcctccacgtctcaggtcctgctcctcagccagatgctgggtggccccggtgtgtggtgggagcctgtgcaggtgtgatccagatgttcccctggcccctctcccttcccaggagggtgagcgggccttgcagagctggctggcagctgggggctccctttctgagaagagggcctttctgcctgtgcgtcagcacagggagcgtgctgtggccatgtctagggccatggctccctgatcacccaggaggaagttggagtggggagggggaccagcctcacctgctgccacccgcagacccagctcatccagatggtggtgtggatgctgcagcgccggcttctcatccagctgcacacctatgtctgcctgatggcctcacccagcgaggaggagccccgtccgcgagaggacgacgtccccttcactgcccgggtcggcggtcgcagcctcagcacgcccaacgccctcagctttggctccccaagtaggacccccagggcaccgctgtggtagtcaggggagacgcttgggggtggcatccaggaggctcaacgtgggtggtgctgtgagtgatgaggggcctccacacagctgcacacgcacatgcacgtgcctcgtgtcccccgtggagacacctctcctgtctcctagcaccaccgtgactctgaggtggcagctctgtctccgggctcttcagcaggcttgctagaattaggggcagctcccagcccagcaaatcagtgctggaatctctgccccagcctgggagcagagcaggatctcataccactaccaggacagctgacacctctgcgccccagaagagccgtcatggccagtgtggcttgagggcagcagcctgttgccaggtcccaggtccccggtccccaggcttggggaaggaagggggtggaagactttgaaagtccccccttggctgaggtctggctgtaggcttcatgcttcatgtgaggaccccacctgcccagggtgctttgtcctccatcctgggtgagggacaggatgcccaggcccaccttggggtgtttgtggggcacacatcgcacctctgttcaggtcccttgaggttgcccccagaggggaggctacccgtttcccaagtcagccgtatgaggggcgtgtcacacccaggaggtggggcagcagcgaatgcttgcaggcagatgtaccctaacccttgtaggagttaggggtgtcattggaggctggctgctggctctgccctcgctgttcccctgggtgtcctggaattccacttggtcaccctgacccatgtcccccacagccagcagcgatgacatgaccctcaccagccccagcatggacaactccagcgcagagctacttcccagcggggactcgccactgaaccagaggatgacggagaacctgctggccagctgtcggagcatgaacgcgcagccatcctcagtgtacccgcagcccagaaccctgaggacctccgcatgtttgccaggtgggtgtaggttgacccgttgggactggggccagttgcagggtcagggcagaaagtggatagggacgtacgcaacagaaccaccaaatccactgagaacagatggggccctgttcgagatggagtctctgcattcaggtgtgtaggggcaggtgccactgcccaggcctgagggttcggcttgtcaccaagacgccgggccatgggcctggcatgcctatttttcggactcttctctctccagtacttcttagatgttccttttcccttgagaggcagtgccaagttctttttttttttttttttttttgagacggagtctcgctctgtcacccaggccggactgcggactgcagtggcgcaatctcggctcactgcaagctccgcttcccgggttcacgccattctcctgcctcagcctcctgagtagctgggactacaggcgcccgccaccacgcccggctaatttaagtgccaagttctcaccctcatgggacttggcaggggtttgcccaggactgtaagccctgcgggcatccagggtcccccatgttaaaggtgatgtggctcagtggtctctgtcagccccaccctgacttgggggacagtgcaggggcatagtttcccgggagtggtcgggttgtcagggactgagtttccggttgagaaccacactcggccctcgagagaaccacttgcaactcttctgagcagctggtccaggtctcacctgcatcctagcctcctctgtgccagcctgagttgcagaaagcaccctaaagcagtgaccttccaaatgatggtgacattaaaaaaaaaaaaaaaaaaagtcaggcgcggtggctcatgcctgtaatcccagcactttgggaggctgaggtgggtggatcacgaggtcaggagatcgagatcatcctggctaacatggtgaaaccccgtctctactaaaaaatacaaaaaattagctgggtgtggtggcgggcgcctgtagtcccagctactggggaggctgaggcaggagaatggcctgaaggcgggaggcggagcttggcgggaggaggagaatggcgggaaggcgggagttgcagtgagcccagatcgcgccactgcacctccagcctgggcagcagagcgagactccgtctcaaaaaaaaaaaagcaggctgggcacagtggctcacggttataatctcagcactttgggaggctgaggtgggtggatcacctgagttcaggagttcgagaccagcctggccaacatataatgaaaccctgtctctactaaaaaagagagaaattagccaggtgtggtagcgcactcctgtagtcccagcttacctgggaagctgacgcaggagaatcgcttgaatctgggaggcgggaggttgcagtgagctgagatcgagccactgcaatctagcctgggtgactgagtgagactccgtctctcaaaaaaaggaaaaaaaaaagcagtgaccatttggctccagagctacgtgggactcactgtagcacgaaaaagaagccaccagcagaaccctggtcccaacatcaggacgcaggcttgggcacctctgggtttgaacagccgtctgccgtcctgaacccactccgcccacctggtggtcagcgggaccgtggtgggcatggggtccaggaggcctgcccacccttgttggggggctgtggtggctgcctccctggccttcaccaccagctctgttcaggcctgtgggcagctcagagctgattcccagcagtggctcttcagcagaggcctctgggggctggtgtcaggttgggctcacacccacccatcccttccaggctccttcactacttccgcggccgccaccacctggaggagattatgtacaacgagaacacgcggcgctcccagctgctcatgctgtttgacaagttccgcagcgtgctggtggtgaccacccacgaggaccctgtcattgccgtcttccaggctctgctcccctgagcccaggcggagggcggaaggctgctggggtgcgcaggtgggcgctcgcgtctccccaccccagggctccccccgtgctgaggctgagccctcttggccctgaggcctggcattgggtggatgcgggctggccgtggcccagtgaagcctgcagagccccgctgtccttgcccctggtggttccgctgtggggctgctgccctctgtgttcctacgcttccctccagtccttgccgcacgcgtaggcatctccacgctggaggggggcctgccaggactcctgtctctgggtgaggccgcatccttcaaggcccatgtgggctgtgcgtttctcagaccctccttctgtccctacacctgctccttggaccccccagtctgtggccaccctgaagaatgtgcagaaacacttgtgtggcctgtccctgtctctctgacagccttctatttgtgaagtgccctgtggccccctccccagcacctctgtctgccatgcgcttcttcctcccaggctaccctgagcctttcctggcccagtcctcaccacagtccacagaagccgcaaacaggctcatagccaagctgtgacctggtcctgaccatctggggcacgagggcctgggctggccctgctaggctggagaagccctgtcacctgtgcacatcttgctggtggaggcatggcccactgtgcaggaccccaccctcgggggctttcggctcccacactgatgattctccccagcatccacaccgggcctggcgctacgtactcaggcccccagctctcgtgtcctggaggaagagctagctccagacatgggttgatcacctagaggagctctggctaaggcacagttttctagaaataaaacatttattcggtttttaaacaattaaaaaatcttgtctgggcaggccctttgctcaggcctgtgtgtcctgctcagccactctgtcgaccacactgacccaggggctgccccggacatagaagcggaggggtttccgggcccactcccctgcatggccgacgcccacccgggctgctgccactacagccggctcactgggctccaggggaccacgctccagccatacagcttcatcctgtgccaggtccctctggtcaaagctcttgttgatggccagggcctggcacagcttggaggggccactgcagagctcgcggtccttgaggacacggctggcggtgcctttccggagggtgctgcgaagctgacgcatggtctccagaccttccaggggctccagtgctcgcagcaagacgcaagccccgtcccctgtgggacggacagtttggaagtggagcctccctaggctcctgtcctctctgccctagtacacatccagacatcctgtgctgcagggagggtgcagctgccttcctgcctgggccagggacctgctctgtgcacctgcaccatctcctgggtctgacctggtgggagggggctgcacctcactgtgtccagacccctctgcctaccttgccatcctccaagcctgcaccatgaggtgtgcctcctgtgggcacctctggcttccaccaccaggcagggcctcccccactgtggccgcccccacaaagccagactgttaaaaacacatgacaaatgctgggtatcagttcctttccacctggcttcccctggtcttgtgactggcagcagctataaagccagcaaaggaagctccagagagccagtcctcgggtgcgatcattcagccaggaagcaggaagccttggcctagccaggccccagcgctccccttctgcctcacccactcagtgtttgtgttggtcaagtggtgggggctaggagttggcttagagcagctgccagtgtgcaccggatgttgggagagcccatgcaatgactcagtggaaggactgactgcaacaccctgcacaggcagggcaggaggaggctgacaaagccccctcacctcccttgggatccctcctccagcctagccccctccctcaccaggccaggccccttgagaaacagagacagcaagcgaaggctcctgggcccaggggctcactcaagcacagatacccgaattccctctgccctgcaggtttggaaaggccccttggattcctggctggggacaatgatgacctggaccctggccagaagagccctggccctccagcaaggcagcacctgctctgatgcacctgtgcacccctggccctcccagccacctgggagtccgaagcttagcctggaggtggccaagccagtccctactcttgggctgcggccacgtgaggctccgcatcagcagccaggggcgagcactagtggacaaagccagcaaatgcggcgttcctgtgagcagataccctcaaccagccagctgtcaaaagtatttcaagataaaatccaggccaagc

SEQ ID NO: 436 - DNA, 127685 bp, Homo sapiens
ctctctctctctctcacacacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccaggtaacgcgcttcaaggggccgcggctcggagctgggggaccccgggccgccctgcccatacgagtgcgagcgtggagagcgcgggcgggggcgcggtcccgggggccggccagctggagggggcgggagcgctgggcggggcctgcgctgaccccggcgctgagtccctggggccgccgggcggatggcgtggccggacgcgggggccccgggccttccgggcgtgacctagggctcgggggcggggaggcccctccggcggggcggccctgggtggtccggcagaggcggaggccgctccgagcctgtgagccctgggcgcctgcggaggcggggagagggcggggtgtgccgccctggtggggaccgcggggtcggagaggggacattgccccccccgaggcgaacgtccaaccgcgggtccgggtccccgcccaaggccgccccgcgaggtggcctcggcccggccgtccccgagggtggctcggatcctttcaaccagcgcgctggaggcgaaggggctgcgccattccgggtcaggcagccaacgcgggacacgcgcgtctccgagcttgcggcccgcgaaacccgggtgacctaccgcgccggtgccctcaaagcccccacgcccgggccggtggccgctgcagccactgagccacgcggtctccccggcccggtcggcagaaggagctggtccgttactagaaaagtccagatgcaaagtcgggggtcgtgctgccgcttcctgccagcgcaccgcacccacctggggccgccaccgaccgcacaggacgcgcctcctaccccctgttctggcccggccgagagctggtgcccccagcggccgcccgcccccgtccgcagaccccggggcccttgctgctttgcattgggaacaaccggagccaggcccggagctgagggggccagggcctttggaggaagcattggcctccaggctgaagagcaagggccgtgtcacctgcccggagggcggtctcatctctgcagccaggtcagaggaagcagcggtggggagacggagtgcgcgagttgggaggctccacgcatcgtaggtggagagctggctgccagcctggcctgccctctcttccccgtcccaccatctcgcttggctccggcacctgcctgggaagacccacacctccgtctgcagtgcctcttccccctggaggccctgccctccgctcggggtccccgcatccttccgtggccctcagagcatcgcctggggcgcccgcggaactcatctgttaggcctgggatgcaggcaggcagaagtgggggtttaagtggaagcagtgagggtgggggtccggtccaaactgtgccaccttccaccccctgcccctgggagagcagacatcgcccactcgggctcacagtgccatccgggtgaggacctccgtggagagctctctttgccaaagaaaagcagttgcattaggtctgcgagcaggcagggtggcctcttcctggctccccatccaccaaggaagcttcaagtccctgggacacaggtggggaactccagcacccctggaggaagggagactgaggttggggagtggcatccaggccctgactctggggcacggtggtctgtgcaactgagaccctgcctcaggctccaacagcgcctgctcctttccccaggttgcagtgatcaccaggggaggtgctgggcgtgcaggctgccacaggaggggtggggaggtggggagtctctgtggcggggtggtgggggcctaggccagtcagctgaggacgtgttggtgcactcccgggagggcggtatgtgggtgaggatccccatgcagagtggtgcccacaaaccccccttccagagtcatctctggtccaccttgaagtccccaggaaaatgacctcgtcctccgcgggtgtgagccactaggcctgagaggacgccgggacggagctttcagagagggaggtgtcgggatggcttgagggtcaccaggtattaattaagcacttgctgtgtgccaggcactttcccacacaggatggagccgggccaccctcacagctcctgccctgcagacgctggccttgtggagggaggcaggcagcaggtaactccaaaagcacctctcagaggcggggacttcaggaaggatggtctgggaaagcatctttggtgtcatttaagctgagccctgaagcttctgatctcctgcagggagaggccagcgtgttccctggggaagctagagcagagtgtctgatgacaagagatggacccgggggtggagagtggaggggcagccatcagagccacctctgagtccacctgatgggcccatgtcttcatccaggggggagctgcacacacaccctcctcccctgtctcccatccctgccccaccccttcagctggggcctgctccgccgtgtctgcatggccccacccaccctgacctcaccacctgctagtgggccttgcagtttcagggggagtgtacgtttcaagtataccctgatgggggaatctggaccagggctgtcccctgggccgtgagtgccgggcgtggagagctggtgtagatgacatttgtagctccacatgccctggcctgggcgccaaggacagccgcagagaagaatgtgggtggacaggctctgctgcccatgagatggtgcagggatggcctgggggatgcttccagatgagagaccaccccaccctacccgtggctcctagggatggcgaccccggaggcgcgtgtgttcatgtgtgtgtgtggtgtgtgtttgtatggtatgtaatgtgtgatatgtgtatgggatgtatgtatggggtgtgtttatggtgtgtgtggtgcgtgtatagtgtgtatggtgcgtgtatagtgcgtatggtgtgtatggtgtgtggtgtgtatgtgtatgatgtgtgtgatgtatgtgtgtggggtgcgtgtatggtgtgtggtgtgtgtgtgtgtgtatgatgtatgtgtgtggtgtggtgtgtgtatggtgtgtggtgtgtgtgtgtccgtgtgtgtttggtgtggtgtatgtgtgcagggtgtgggtgtgtttgtgtgtgtgtgatgtgtggtgtgcgtgtgtatgatgtgtgtgtgtggtgtgtgtgtgtgcgtgtatgtgtgtggtggggtgtgtgtatggtgtgtggtgtgtgtgcgtgtgtatgatgtatgtgtgtggtatgtgtgtggtgtgtgtgtttagtgtgtggtgtatgtgtgcagggtgtgggtgtgtttgtgatgtgtggtgtgcatgtgtatggtgtgtgtgtgtgtgtggtgtgtgttgggcccagggcacgaggaggaagcagggctgcccagggaaatgccaccctggagaggcccctgtccctccctctccgtccttccctgtgcccctccgtccctccctgcccgtcctccccgtccccctccatccacccccaacccggccctcctcctgcggcaggcagcccatcttttgtgcggcctctgagaagcacagggagggcccggcgggcgtgaacccgctggcagccggtgtgtgcacagccttggcccgggcctcccagcccctgcatcccgagcacccgtggggcagttggcagcgtcctggcacggcctgggagattaattggtgcttttaatgacggctggtctggcagagacagagtgactacaggctgggccggcgcaggctgtgagcagaggctgggaaaggccccgcccccggacgggtctccaggggagaggaggggttcgcaggacccctctcaagacccccttcgggagtcagcttcttggccacgcacacttggagctctgggctgggttgcagctccctgtacttcactgtctcgggtgctggcagtgccagctggggcacgagttccggtttgggtcaaggctggcctgttggctggggtggcgtctgcctgagaactggccttgtctgtgccttaagcttcctggcgctcacagggcagtggaaaaccactcagtgagtctttcttggcaccttgcaggagcagtgctttctgggcctctgtagccagagctggccctgctgcagcttacgtctgcctgcagcccagacgtcctcctggtcctcctgatgcccccgacctccacggaggacgagcatttccagcccagccctccccatcttcacctcgcactcccctgacacactgggagcctcctgatccatgaacccgcgctggcgggagtagctactgaccgctggggacccctgcccaggctgttcgcatgtggaaaggattcagggagcaggcgatgcccaaagcgtggagaccagcactgctctctccccagtgacaggtgcacgcccagatcacggatgtgtcgggaacagctgtgctcctgctgctcagcgtccgtcactccaggctgggagcgggtccccaagcttctggctgggcctatccgtctccactctcagtgtgggggtggggggcgccaacagcacgcatttgctctctgcacttctcgtctgataatgggcagagggtccttctgcagccccaaaacatccctaggcaggagccctggggccccaagcagccagggaggtgagcaccaaggacctcccagagagcgtcaccttccgtcgagggaggcccagcctgggggcggtgtctgagacttggaatcaacgcttccgttggtggcagtaaatcctgtccctaaccctgcagtacagctgtgccgtgtacaggagggtgctgtctgacgccagacacctggactacagatcgcagcctgattcctggtcattgctccactgaaccccagaccccagcctcgttctgggccctcatcccctagatccagggaccccagccccatttcagcccttgggcccttgtaggatgcgaggccctgggccccagcccccagcccatccgtggcccaggcactggggggctgaggtcctctgagaagggacacagggcctggggggctctctcagcccatcagcaggagaggactgactccagaaaaatcagcgtttgtacccactcaggctgccaagacctgtgtccgtccttccaagctcaaccttcagagttcatgaggccccttgcccagaatgtccacagagttcatgaggccccttgcccggaatgtccacatttgaaacctcccaacaccgagccccatttcaagtataaccaggagggaaaatggtgcttgaaataagcatgccacaaaggaaaacctgctttctcgaaatgggccctggccgcccaggccctgacctccccggccaggatggaacgttccagagacccattagtgccaaaggcaaatgaaaacacaccctgtgaaaatgtctctgctgtctcccaagtatttatttttctgagcgtggggaaggaaggcttaattaagatgccctcaggcgggtacgaggggcaaagtgggagcagggagcgtgcttcctctgtggccttggttcagacaacagccttcagcaaagctttgctctagaggctcataggaagggacagagggcacaggcccagctcagcctttcccctgcctttcttggggcctgggcatggacagcaccgcctggcgacacacaacggtgggctctgaggctgtttgttacgcagcattaatgtggccgtcggtgaccgctacacggtgactgataactgcactgtgggtagagctcagcccgcagggctctggtttgtgacctctgggccaggcaactctcaaggcttcttccagtgcagaatatgattcctagagaaaaaaaaaaaattacacattcgtttcctaacatagggccctgcaaccggagaacaccaccacattgggagctgtgctttccactgtctagaaaccatggcttgccagcttgcagggtcacatggagccgcatctccttctggggtgcaggggtgggaacactcgtgacctgtagccgagggtgcagggagaggacagggtgagccaagcagaacagccgtctgtgagtcatcgtcccaggacaaccagcaaatggcacaacacctgctctctcagcccccacccgcacctgccagcctcacgtggggggtgggggggttggccgctggacagtcacagcaggatctgcccaaactgaccacccttccaggaggaggcaacagatgttagcatccacgggtcctgggccccccttccatacccagacttcaggacatgaaaaattggggtaaatgaagggtgcacgattatcttcgggcccacactggcttcctgcgggtgccagagacagctgccaccgcatgccagggacaatggccccgaggaggcgggagctgccaggccggggtgctgggggacagctggacgaggtgccgacaggggctcattcctccctgaagccggcccgcagctgctgggagcgtggccagccacgggcttgtgtgtgcctgggtcctgggggctgtgctggcgcaggccgggacggcggggacagggtcccacctagggcaggctggtcggtctccggggaggcagcccagtcttcagcctgcgtgctcttggggtgtccgtcccttcctccccattctcctcctcttctcagcgtcttctcccccagcaccgggcagccctggggtggccgagcctcatctccactcccctccctcaggcctctcctgggtcagcctggctttttctcttagagtttttgcttgacagggcactctcaggacgccctcctcctcctcccgcctcgggttggtgtgaggcgctcagggcagggcccacgtgcctgtggtcacaggacactgagctgcagggtgaaaggaccacacctggccgatctcccggccgctgcagctcactctgggtttgcagagaagcctgtttttaagtgaagtgccttcttagagaataagacacacctgtatctaaatgttatttttaaactgctagatgcgccttaatatagacaaagaagtaaggtgagcgtaaatgacatgatgtattccgacaggtgacagcgccttccgggcgattctgaaacaccagtgcagggctgtctgttgtcttttgttttcattttactttttttttttttttttgagacagagtctcgctctgtcgcccaggctggagggcagtggcacgatctcggctcactgcaagctccagcccccgcgttcacgtcattctcctgcctcagcctcccgagtagctgggactacaggcgcccgccaccatgcccggctaattttgttgttgttgttgtatttttagtagagacggggtttcaccgtgttagccaggatggtctcgatctcctgacctcgtgatccacccgcctcggcctcccaaagtgctgggattacaggcgtgagccccggtgcccggcctcattttacttttctaaaattcgaggcgaaattcacatagcatgaaataagccatttgccagtgaacgactcggtgtttagcacctcacagtgctgggcagccatcgcctagttccagaagattctcatcagcccaaaagaaaacgtcctacccccggaccactggctccccactccccgtccccagacctggaccacagagctccctcctttccccgtggctttgcccaccccggacatttcatgtaaatgggctcacgcaactcatgacctccgcgtctgtcctgtcccactgagcttgatgttctgaggttcatctgtgttgtagcacgtgtcagaactggattcctttttattttatgttttattttagtgagacagagtctcgctctgtggcccaggctggagtgcagtggcgcgatctaggctcactgcaacctccacctcccgggttcaagcgattctcctgtcacagtctcccgagtagctgggattacaggtgcccgccaccacacctggctaatttttttgtatttttagtagaggcggggtttcaccatgttggccaggctggtcttgaactcctgacctcaggtgatccacctgcctcggcctcccaaagtgctgggatgacaggcgcccggctcctggattctttttgatggctgaatcataacccagtgcacttttgattaaattcaggctgaaatgggcacgaccagagctgctggtccacctctccccggcccaagccctgcccccggtgacctgctctggagccattctgggcagtggatgggacccctgcggtcagcgtctcaagagagcagaccctgagggaaacttgagctcagagagaacaggagctcccagcagacccttccgctgactgctcccaccctgggcaaatgcagagccggagcccggagcgctggaagctggaacaagaggcccttttctgctctgcacaatgccccattgtgcccttcgcggggagagcagctcggcccagcgaggggaagctgtgcacaaagcctccttgtgagggcagccccacctgaggacagcgcagggccacacctgacgcagggcagtccctctcgccgtccgtcccctagcaggcctggcacccagacagggcccgctctgcaggcgtggtcccagggtgtggggctccctgttccccacagatgaggggaacagtgtgggctgtgccggcccttcctaagctggcccccaggtcacgaggagaggtacgggtcgtgggctctgtggagggacttgggtgccgggcgccagccagggccgatgcctcctgcgatccccaaggctccgagccctcaggcacacaccacgctcccggaggctgggccagcatgcggaggatgtttgtgtgttcgtacccgttgcaacatctttaacagggtcccatttcacagctgggctcctaaggggggtttcatagaaaagaaatggaaactaaaaatgaattaaaccataagatgtacacgtatgctacggccccagcaacacagggaaggtggaggctgagaggaagctcgggccactgctggtcaggcctggatttgggggcccgatgtccacagtcagtccctgcccacacaaggctcacactgcaggtggtgaagatataattaaacaggtaattaaacaagcaataaagacgggtcatttgaccaacccagtggcgataattgatacgccaaaacactaggaaagctagagaggcaaaagagaagaatacatgaaaacaaaaacaaaaaaccaggacaaatatttccaatatacacaaaagaacaggatttttcatacgtaaagagtgctgacaaatgaataaggagaaatctgcacttccacctaagtgccccacagtttattcactaacccctaggtctccaatgcctactctagcctcacgccctttctttcctctaaggaatgcctgtgaccccagcccttcctagcacccgcttcacatcagcctccagaaccccgctccagtcatcagagtgtagagtgctggcgtcctccttcatgttctgtttggggcattgggcagttagcccttccctcctgagtcctgagtccccctcttcccccacagcttgaagtccagtcccaagggcaggcaggagctgggttgtgcaaaggcggaagggtgctcaggctgggagaaaggggagggtcccccgagcattccaggcacagccctgcctactctgtcccttgctggctgcgacgatcgccctagcaccctcctccgcagagagtgagtgtcagctgtgaggcaggggcacgcagtggtagcaccgccagggcctgtgcagcccaccttccccaggaccacagctgggaaggcgcctggctgggggagggcacctggcctctgcaactcggactgacggaaggcacgcgtgcctgccccagtgagctcgggtcgggcgacgcgcaccacctcccaggtacccggccccgcgccctacccgcagcagcgcccagcgagaactgcgaaggaggcaggctccgggcacccgctcccgcgcgtgggcggggccggctggagggggcggtgcctccgggactgtgagcggggcctcccggggtgtgggtggggccttcggccgtgggcagggccggccagggagaggcggggcctccgagaatgggcggggcctccgagaatgggcggggcctccgggagtgcgccctccccgcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtactgtgagtgccgggcgggcccgggacatccgccagtgtcacctccgcgcaccacgacccccgccctccctcgagactcctccgcgcggtctcgcggccgcggcgcccccacgcagccctccttcctgctggggcccgggcaaggcggggcgggcagggcaggacaaggcttgctggcgacagcgcacccggccctacccctgtcgccgcctcgagcctccggcctgggctcctgggctcccggttccacccgcagccccgaagttgcacggccgcgcctgccaggaccggctcggggctatgcgaggcggggccggcccgggccctggcccaggagttcccaggagagctgggcaggtggagggtcacccgtccgtgcgcaggtcgggggtctgcgtcctggctgcggggcggggggcggcctggagaggcgaggcgctcctgctgtccccgacacagcgctgtgctgacggtgaaggttcccactgtaactggacgcccgcacgccacatccctgccgcgtgcggcccctgccaaaatccgaggagccggcccgggagcctccttcgcgtctcccaggggctgagggaaggtgactggctggtggccagactggagtttctcctttagtgttctcgactagctcagtctgcgttcgggaagattcccagcggaggtctgggggcagctccggaacctcatctgcaagtgaagcctgcgcctcactgtgggatgtggttggccgggtccactggcggagacccttcaccccacagctgtgcggggcccgcgtgcgcagcctacagagcagagctctgagaaaagtcagttcacgctcaaaacctctggatcccctggccaggggcagctggcgattccaactccctctctccccagtccctacaacccagaactggtttggaagagaacggttctgtgatcacggtgacatgtgatcacacggatacatgtttcataagcccaacgtgtcaggagctacgaacctcaagtgaggctctcaaatgagtatggaagtgaggggagcctgccaggccgagatgcagccagcggggcgcgtgggcagtcaccgtcccagagggctccggagctgctggccccgggcgttgcccacgcgttggttgtaggccgtgggcattggacgtctccctttccttccatcgtctgcttccctcacgtgtggaaggaaagggtcaggttgcagaagttcttctttgcacagcctttgtgccacacacgtcgcgggaagtttggtagcctggttgtgctggagtgatgctcagttcgacgttttgtgtgacatttgtgtgatactttccacctcctggtgcaaagtgatgagacgcgctcatcactacaaggtttcctgtgggattgcagtatcggcttcaactgggtctgtgtctctctctctctttctttaaagcaactattttattttatttatttatttttttcgagacggagtctcactctgttgcccaggctggagcgcaacggcaccatgtcggcccactgcaacctccgtctcctgggttcaagcgattctcctgcctcagccttccgagtagctgggattataggcacgcaccaccatgcctgactaatttttaaaaatatttttagtagagacagggtttcaccatgttggccaggctggtctcgaacttctgacctcagggcctcccaaagtgctgggattacaagcgtgagccactatgcccggcctgcaattattttaaaaagtagttcttcccaggttgcttttccctccacagtattaaacagtcattttaaatgttggtgctgtcacttagcaaacgatgaagtagagataaagtgaagctgtgaggctctaataggccttccacaggggagcccgagatacagcaggaagtcccagcggccttgcctccggagcacagcttcataaaaccagctcagactctttcaaacgagctgaggctcctttgatctccgcagggattctctgttcaattcagaaggaactgcttttaagccactgggtcaagcggatattttaagcctggtgcccagcattgaacatttctccttgacatatgcacgttcttctgtcttgtgagtacatttggggtagaatcagtgtttttctgctgtatcaaggaaccagtttcccatctttcagggacatggttttctggctgagctggcccagggcaagcaggcagtcatcctgcatttatctccttctagaaagttctggattttactgggactgtgcgctactccctgttcctcagaatcccagggtttttccaagttgccataggggctctccaaatatttcacttgatactgaattttacaatgtttatagctattgaaacacttgtaattaaacacataaccaaatgtattctgtggaaactccccttgttaaaagacattgaactgagggaggcttacccttaggcagattgtctcagcagacatgtagtaaagatgtacagatcaggagaacacagaaacgcctgccctgtcggggaagcttcgaagccagacctggagaggccggctgccagcgacaggcctctgcattcaacctgactttgcatccgtcctggggctggctccttcccaccgcgggcctgggcgtttccatgtgctgccaccgaggtgtgtaggtgctaggggtgtgctcactgcacacagacgtgcataccgcgggcgtcctggggtgtcgggcatgccctgctgtgctgtgggagccggagtgtgttagcggaaagcggcattttcacagggctcagagttgaagacacacctgtcttcctgacgtgtggactcgggtccctagtgtgattactgcgttgagcagatgctgaagtagcaccctgcccggtgctgacctcctggtgacaacgccactacccccagtggacagcgaggaagcagggtcagccactggcccggctgtgcagcgattgtccgtaggccctggagttcagccctgcccttcattcacgccactgtgcagcctgcgtatcctggacacccggttcacatctgggcagcggcgttctcgggccgtgacggctcctgggaggaccgaggctgcccgaggtggtcggggatgcctgacactgacactgagcttcccctcagcacagatgtcactcccaggaatggctgaaatctggacgagtaaaagcttatgtgacaggagtttccggcctaagcagcgggacctgggtgccatgttcttggtgtgtaggggcagtgccggccgcccatgggtgccggtgcctcctgcagtcaggcctgctgctgtctgtgtgcgcaataaggaaaccgaacccaagagtgggcaccatgcccaggctcaccggaacagagggcagagcagcctggccagaatccctcactgttttatggcaggaacccccagggtcgtgcgtcgacgttgtggcccggcgttccctgcggaagattgaggccctcactggtcaaccctgcagtacgggggcgtgtgtggcaaacagctggtctggagcctcgtcagccaggccggctccttgatgctttgaaatccccctcccagggggcctggccaggtccgtccatgggcggccacaggcagctggggctggactcctggaatttccagcagccctgtgtctgttacagcgccagtggtagagctggattccctgacaagacgggggaaggacagccttgcaggtgctactgaagacaccctaggctagagctgcccaccctgggtgggttctcctggactgaactgacgttggtttgctattgatgagagtcacatagtatatgtacacaatgcattttaactgcctcagaattaaggtgttatctggaaacagtgtaattacagttggtcagaattgggttgatagcagttcactgcagagaactttctggaagctgtgacaggtggaagtagtggggctcagggttggtgggccacaccttagctgtgtggccttggccaagttgctcatcaagaccttcctgtcactgatgaggtgagagtgaccgctgggccgtcctgaggctgacatgggattccttgcctgtgcacacttcccagaaggcggaccaaggacacacccgcctgggagacggctcgcaggcagccacggagtatatatatctgaacgtcggaaaggacctttcctttgaagctcaaacatttatgagatattgttacaattcggaagggatctgtaggtgaaatgtgacatgaagactgggtaacgttggcatttgcagactgactttatgtgtggcacttttcgtgggtgccatggcgtcggcgcagagacactcctgagggatttcgtctgtcggtccatgtgtttgtgggggccgagtcctggacaggcctaggagggaaccgccccggccagggccggctgctcggcgcctgcacagggcatgagtgctgggggctttgggacacacgctccctgctgcctctggggcagatgtccacctgcactgcttgcagtgagaggctggggccccagtggacgagccgtggtgcctgaactgctcccgctgtgtccccgccacgtgaggcatctcttcctgaccgtggtcctgagaccacctggcctctgccttcccagggttaactgtacttgttctctccgtggctgccgacacccttctggccttcagacttagccctcatcactcgtggactcctgaccccacccagggctgaccaccggagccctgctctctgcttcctttgcggctgatattgtccccattccagtgttgttcttgtgcctgtctcccctctagctccttgcagtcagggagaggactttctttatacctctatcccttgtcttctaggggcatctcctgctcagtgaaatgtgctgacccgtagcaggtggtctctaccagggcttagtgtcagcatgggacacttttccagccattaccccttctttcccctctacccacctccagccccgaggtgcggcccagcaggacagatactgccacagccctcccttggttgtgttcatacttcctgggctgctcatgccttcctgtttgctggtggattctctttttgctggagtgtatccccaagcagcttttccagaaaggaccaacttgcccggatctctaattctccatcaaagccactttccctcagagctttgcagcattgaggaggcatcttcaagcatctgactcttcttctccctggaagcttctaaagtctcagtgccttgccctcctgctctccacctttgctctctgttctggttatttatcgaggagtctctgaggctcttttttttgctctcttgtagtggccttggtgagctcttcagcctcaaggcttgtccttggctctggatgaggctcttctggcctctccccaatctgcccatgtgttccaaacaccgcatgccccagctgggttccaaacagggcgggtgggggccactctcctgtctagcttcgtagcgtgggctgaaacctgggaaagtctctccatgaagctgaatggagaagaacatggcttccgcgaggccctaggagccaagcaccacacagaacccaccgcttggctgtgatcccgagtgacggggacagcctggactgcagaaggaatgcccaacgctggcgggaacggaggggcttttcttgctcgtctttccagttccacattgtcacattggagtcctgggctcactgagattatgttgaaaatccgacctctaggggatctccatgctagttttgtcctttaggcgtggaggcatgcgtgccgcactgtggcgtctgttctgtgcgcctgctcaccgcccttccttcttttccgcgtggggcagttttatcgcgtctccccggcagctgcttcggcgaggtggggccgcggtgccattggtagcgtgtctctgagtctcaccgcagcccttgtagcttggcatcctcgtcagatgacacccgaggcagggttgacgtggcaggcagaatcgtttgcacccgtatttgctaaactctcagctgttcttcagaaaatttgaggagaaaatgaaaccaaaaagaatacttgaaaccctgctcagttggttttgttctgagctttcagtggctctaagagctcatgggaaatgagttctttttcttttctccgggccacttgagttctaatgaaatgcaccacttggttttacaagttcttctataaaatacttgcttgtttaaaaagcaaacagcactgccctacttcggagctctgcagcacatcccttaaagaaaaaatacttgaggtcactgtgctgaggcccagaatttaaccacggccagtaagaaccatcaacagagaacggcatttctgggatgactgttttaatcttacaacaatttatctgaaaggagaaaagagaaagctgattttttttttctgattctttttttttttttttttttgagacagagtttcactttttcgcccaggctgcagtgcagtggtgcaatctcctctcactacaacctccgccttccgatttcaagagattctcctgcctcagcctcccgagtagctggggctacgggcacaggctgccacgcccagctatttctttctgattctgaaacaaagtatttatcggccatgcctgctgttggctgctcgggcgacacggtatttcctcggtatttcctcgttgcagctcccaggtcaggctctgggtccctgtgagaggcgggtggccgccatggctctgctgcctcccgtgtggggtagtgacggggccttccgaagcttgactgcttggttagttttgttttgagagcctgtgatgtttcaagatttttactgcatctttttatgtagctatttttataacatgagtagaggttgaaatagtttttttctctctgaaatctcaattcagtctgtcttcctttttcctgataagcaggaagcatcctatgcttcttgccttagaattactgatttaggctattgctttggtgaggccacatcttgttttcctctgtggtcctggagtttgcgttgtggtgaggggtggagcacatccacccttcagctagcgccaattaggtccctgtgggaaaggggccccagcctagcaccaatgaaggctgggccctggagtgtgcagtggctgaacagtcacaacctgtgtttctcccacctgcatacatgccaggacatacacacatgcatccctgcacacgcacacatacatgtgtacatgtgcacacgtgtacagagacatgcatacacccgtgcacacatggacacagggcatccatgcacaggtgcacatgtatacatgtgcacatgtgtacagacacatacacacagggacacatgggcatgtcatacccatatgcacacacactggcctgagctgtggaagctgctggtgcggtccctgcacgtgtggccgccggggctgagggcctaccgcgaggtgtcctctatgttgctaggaggtcagcgctcacagctcaggtcccttccacccagtggtggaggcagtaggggtgtggggagccttctgctgcagccctgtttcccgccctgcgacccaccccgagtcccctctgtgtcccacctcatgtccaccctgtgtccagccttgtgtccagtctgtgtcccgccctgtgtctgccctttgtttaccctgtgtccatcccgtgcccgcctgtgtccaccctcttcctcctcacttggagctgcccccacccacctgccgtcgcagcccctttagaggtcaccagccctgaccctttcgtcgcccagggccctgcggtgctctgcctgtggccctgctcccactgccttggagggaggctgctcacagcgcttcatgccgggcactgagtggtgcagagtcttcgagaaacctttactttttaaaatttttttattaaaaataaaactattaactgaaactgcagactctatggcttttccacccgtgcctgttccgttctgggacccggttttgtcctggcgtctcctccctccctccctggtctgtgagtctcccagactttcctgtgcaggattccgaccttgacagtgtcaagcaggcctgtcatggcgtctgtagagcgtccctcacgttgggtccgtctggtgtttcctcgcaattagactgggtgatgggttttgggaagacgcccacagaggtgcggggcccttcccgtcacaccgtatcagggtcctgacgtccgcacggctttctgatcacccggccaaggtctgcctgccaggtgtgccctctgacaggtccctgctttcccgcccgctctgtcctctggaagccgctcactgggtccagcccccgcctcctgaagggagtgtctgcggacattatgtggaattcctctgtgaggaagatcttgttacttacttgtttgtggtcactgattttgtcactatggacccacgcccatttattttccctctgggtcgtgatcccgtgctgtcaccgtgagtctgtgtctgggtcgtgatcccatgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtggtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgttgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtctgggtcgtgatcccgtgttgtcaccgtgagtctgtgtctgggtcgtgatcccgtgctgtcaccgtgagtctgtgtctgggtcgtgatcccgtgttgtcaccatgagatggtgtctgggttgtgatccagtgttgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggtcgtgatcccgtgctgtcaccgtgagtctgtgtctgggttgtgatccagtgttgtcactgtgagtctttgtctgggttatgatccagtgctgtcactgtgagtttgctgctcagctcctccagctttgaccactggtgggtttcccctccttccccgcagggatgcttccggcccagcttctgtttctctgccccagccctagaatgagttgtttccaaggagccctggttctttttaggggagcatagaaacttcagtctgggcactgggagggccgttgctcccggggtgtcacagctgctggccctcttcctgggtagagctaggctctgtgtgtcactatctcatttcacacatttgattgcttctctgtcgtatccacctatccatctgtaagtatacgaaggtcaacctggtccatgccgatgactctgactctcacctggcacacggtgtattccagccttccgtcctggaacatggtgtattccatcctcccgtcctggcacacggtgtattccagtcttccctgctggcccatctgaatcctccctctctgctagtgggaacctggctcccctgactcctctagcatctgctcagccctggtgcacgtgcgagaattgtccacccaggcccgggggggaaagccctggagtgcagcgtttgtgtacagctccttctggccttgcggtctccactcagaacattttccggagttgcttaggcggctcctgccctctggccagtgtgtttctgtttcacatccgtgcgtgtggagcctgtattctatctgcatcccccaacctcctggtcgggtcttcccccaatagtttgtgcacattgaagttcatctcgtgtaatgctcagtgctgtgggctttgcctccatcaccccagctccagccccaagtcccccgtgcatgggagtgaccacttcccctgcaccagcccctggcacgcccgggtctgtctcccgtccctctggttttgccttttccagtgtgacatacgaatgaaatcacgcagtatatagcctgttgggtctagattcttttgcttagcaaaatgcacttaagattcatccatgttattgcctgaaccaacagctgcattcttatctctgattatttttctgttgcacaaatgcacctccggttatttatccacttccaccgtgaaggatgtcttccttgtttctagtttttagtggctatgaacagagctgctatgagcatctgcatgaggcttctgtgcgagcacactttcaggttgaaggcctgagaggtgcagtagctgatttgtaaggtaacccttcattatctgggtcagatgccaccgtctgccatccacagtggtaggccacagcatccccggcacagcgagggcactcctgctgtcccgaaccttctgcagcattgggcactgtccatgttcgtgttttttttgttttgtttttttggttttttttttgagacagtcttactctgtcgccgaggctggagtgcagtggcgctgtgtcggctcactccaacctccgcctcctgggttcaagcaattctcctgcctcagccttgcgagtagctgggattccaggtgtgcaccactatgcccagctaatttttgtatttttagtagagacggggtttcaccacattggccaggctggtcttgaactcctgacctcaggtgatctgcccacctcggcctcccaaagcgctgggattacaggcatgagccaccgcgcccggcctgggcactgtccgttttcaagcacttcggccatgtgacgtgtgtgtggtgacagcacgctgtggttttcatgggcatttccgcagtgatgaaggatgttgagcatcttttcacgtgttatttgccatccgtacaccttcctatgtctgttcagaccttgtggcctggttttttcttcccacctttaacattgggttgtttgttttctaattattgaattttaaaagttctttaaatattctagatacaaatcctttatcagatgtgtgatttgccagtattttcttccaatctgcggcttgtgttttcattctgttaaaagtagcttttgcagatcaaaagtttttcagtttgataaagttcaatttacagtttctaatttcatagattatgcttttggtgttgtatctaaaaacttgttgccaaacccaagtcacatagattttcttctatatttccatctggaagtcttatgcttttatgttttacatttaggtctatgatcctttttggttaatttttgtgtaaggtgtgaagtgtgttcaggtccatctttttgcatgtggacatccatctgttccaacatgattgttacagagactcttctttgtttttttatttattttgtagagactgagtctcactatgttgcccaggctgctctggaattcctgggctcaagcgatcctcctgcctcagcctcccaaagtgctgggatgacaggtgtgagccaccacgcccggcccaaggctgctctttgtctgtgtagttgcctttgaacctttgtcagaatttgttcactctgtgtgtcgggtcgggggcaggggggctgtgtctgggccgtctcttccattccattgagttctgcggctcttccttaatcaatactgcgctgtcttgatgtggtcttgattagctttttagtaagtcttgaaattgggtaacatgagtcctccacctctgttcttttccagatgattttggctttttaatccctttgctctcccatgtatattctagaatcagcttgtcagcctcggcggaagcactgactgggtgtttggttcagattgtgccgaatttatggatcaaattgacaccttaatgattttgatttttccaatccatgaacatggtctatctcttcatatagttagatcttgtttcatttttttaatcagtgttttgtagttttccatgtgcagattccgtttatatgtttttagatttataaatgcatggggaaaagtacatgtactagcttcctacatgtctacacagacactcactccaaaccagcatgcacagttacacagacatggaccccaagccagattcctacacgcagtaggaagccgcatgtacttgtggggttgctcttgtgatattgttatcattatgcaatatcttctttcatccctgtgtcattccttgtttgtaaattgatttttttccttttgagatggagtctctgttgcccaggctggagtgcaatggtgccatctcggctcactgcagcctcccgggttcaagtgattctcctgcctcagcctcccaagtaggtgggactaccggggtgcaccaccacatccgactaatttttgtattttttaagtagagacagggttttgccatattggccaggctggtcccaaactcctgacctcaggtgatccacccgcctcagcctcccaaagtgctggaattacaggcgtgagccaccgtgcccgacccttaaatctactttttttttttttttttgagatggagttttgctcttgtcgtccaggctggagtgcagtggcgcaatcttggctcactgcaccctccacctcccaggttcaagccattctcctgcctcagcctcctgagtagcttggattacaggtgcctgccacaacgcccagctaatttttgtatttttagtagagacagggtttttccatgttgcccaggctggtctcaaactcctgatctcaggtgatccgcctgccttggcctcccaaagtgctgggattacaggcgtgagccaccctgcccagcccttaaatctactttttatgatgttaatagagccacttccactttcttttgtttgtattttttatttttatttttaatttttttcagccatgatgaattagatccagctttcttttgattcacatttgaatggtgtatcttttttactttcaactgctttttcattcttcacgtttacacatgggaatgtgcttctctcacctgtcagcatctctgggtaagcattcagtgttctacaaatactgacgtccagaggatgtgagagagctgttgtgggtgggcgccgtgggacatgaactcggagacctgtggatgtgagagagccgtcgtggggtgggcgccgtgggacgtgaactcggagacctgtggatgtgagagagccgtcgtggggtgggcgccgtgagacatgaactcggagacctgtggatgtgacagtgccattgtggggtgggcgccgtgagacatgaactcggagacctgtggatgtgagagagccgtcgtgcggtgggcgccgtgagacgtgaactcagagacctgtggatgtgagagagccgtcgtggggtgggcgccgtgagacgtgaactcggagacctgtggatgtgagagagccgtcgtggggtgggcgccgtgagacgtgaactcggagacctgtggtctgcgtagagggcaagtgtggctcacctataggcagtaagtgtcaagccctgcagcgtgtgctgggagtgatgccgttgaccagagccagggtcctcagggtgtgtttcataatggtgaatgctgagtgcagtccggttggtcagctggctgtctgtgtgtagccaggcacgcaatttatatacacatgtctactttacttctatgtgtgtgcgtgtatacacactgcatctgctgcagacacggaatttatatacaagcatctagtttgcttctatgcgtatgcgtggatgcacacactgcgtctgctgcaggcacccattttatgtaacgtgtctggttcacttagatgtgtgtgcgtgtatgcacacactgcgtctgctgcgggcacgcattttatgtaacgtgtctagtttacttagatgtgtgtgtgtgtgtatgcacacaccgcgtctgctgcaggcacgcattttatgtaacgtgtctggttcacttacatgtgtgtgcgtgtatgcacacaccgcgtctgctgcgggcacgcattttatgtaacgggtcgggttcacttagatgtgtgtgtgtgtatgcacacaccgcgtctgctgcaggcacgccttttatgtaacttgtctagtttacttagatgtgtgtgtgtgtatgcacacaccacgtctgctgcaggcacgccttttatgtaacttgtctagtttacttagatgtgtgtgtgtgtatgcacacactgcgtctgctgcaggcacgcattttatgtaacttgtctagtttacttagatgtgtgtgtgtgtgtgcacacaccgcgtctgctgcgggcacgcattttatgtaacgtgtctagtttacttagatgtgtgtgtgtgtatgcacacaccgcatctgctgcaggcacgcattttatgtaacgtgtctggttcacttagatatgtgtgtgtgtggatgcacacaccgcgtctgctgcgggcacgcattttatgtaacgtgtctagttcacttagatgtgtatgcgtgtatgcacacaccgcgtctgctgcaggttggcttttccagtgtttcccccaaaatcttgagaaagtactcagactcctgagtctagggtttggccccaaaccgtcagccagactctgcctccccttcccgcctgcctcgccccgcattctgagctgcgcccatggtgtccacatgtggtttgttcctagtcatgcttgttttgtcttctttttcttccagtcgtggcattcctggtggctttccatcagaacaagcagctcatcggtgacagggggctgcttccctgcagagtgttcctgaagaacttccagcagtacttccaggacaggacgagctgggaagtcttcagctacatgcccaccatcctctggctgatggactggtcagacatgaactccaacctggacttgctggctcttctcggactgggcatctcgtctttcgtactgatcacgggctgcgccaacatgcttctcatggctgccctgtggggcctctacatgtccctggttaatgtgggccatgtctggtgagtagcaggaatggggcggtcggagcttagggcttgctgtcactcagcacaggcactgcaggtgtcctggcacttggaaagactggacgagcgtttatcttaaattccttcaggagggtattgtcattttacttaggccatggcagagcggccagtgcaccagccacagcagccacccatcttcaggattaaaaccccacctctttgcagtagctcttccttacttaaaggactgcgttgccagcttactggagccagagggatggggaaagggaggcagaagcagtgggtctgtgtctgtgtggacgtgtaggaggctggtttggggtgggtgtctgtgtggacgtgtaggaggctggtttggggtgtctgtgtggacatgtaggaggctggtttggggtgggtgtctgtgtggacgtgtaggaagctggtttggggtgggtgtctgtgtggacgtgtaggaggctggtttggggtgtctgtgtggacgtgtaggaggctggtttggggtgggtgtctgtgtggacatgtaggaggctggtttggggtgggtgtctgtgtggacatgtaggaggctggtttggggtgggtgtctgtgtggacatgtaggaggctggtttggggtgggtgtctgtgtggacatgtaggaggctggtttggggtgggtgtctgtgtggacatgtaggaggctggtttggggtgtctgtgtggacgtgtaggaggctggtttggagtgggtgtctgtgtggacgtgtaggaggctggtttggggtgtctgtgtggatatgtaggaggctggtttggggtgtctgtgtggatatgtaggaggctggtttggggtgtctgtgtggacgtgcaggaggctggtttggggtgggtgtctgtgtggacgtgtaggaggctggtgtggggtccgtgtctgtgtgaacgtgtaggaggctggtttggggtgggtgtctgtgtggacgtgtaggaggctggtttggggtccgtgtctgtgtgaacgtgtaggaagctggtttggggtgggtgtctgtgtggacgtgtaggaggctggtttggggtgtctgtgtggacgtgtaggaggctggtttggggtgggtgtctgtgtggacatgtaggaggctggtttggggtgggtgtctgtgtggacatgtaggaggctggtttggggtgtctgtgtggacgtgcaggaggctggtttggggtgggtgtctgtgtggatatgtaggaggctggtttggggtgtctgtgtggacgtgtaggaggctggtttggagtgggtgtctgtgtggacgtgtaggaggctggtttggggtgtctgtgtggatatgtaggaggctggtttggggtgtctgtgtggatatgtaggaggctggtttggggtgtctgtgtggacgtgcaggaggctggtttggggtgggtgtctgtgtggacgtgtaggaggctggtttggggtgggtgtctgtgtggatgtgtaggaggctggtttggggtgggtgtctgtgtggacgtgtaggaggctggtttggggtgggtgtctgtgtggacatgtaggaggctggtttggggtgggtgtctgtgtggatgtgtaggaagctggggatgcgctggctcttgcatgcccagcttggttccgccctcaatgggacagctgggctttgcatggagactgaggatggctcttgtgtctttcgtggacgggagacaggaggcagctggctcagggctgagtggtcggaaccaggaccctgtcccaggatggaaggctgtggtggtgagttggtgcgggcagggcgcagccttgggctgtggagcctgtgttttccatcctggtcagggcggctgagttgaggttggagtgtctggggccacgtgcacttccgggagcctgaatgctctgcctccagcacagcgcctgtggctccggtgttccctggtcggaggctcagattgctctgatctgggcttggtggcacagcccaggccctgcaggctcatgcagggagggctgcagctggcatcagggcacctgtgggggggggtccccactttgtggctgtgctggagtgggcacttgtaaggggggtccccactgtgtggctgttgctggggtgggcaccgctgccaggtccagttgctggtgtttcctcaggtctcagctacacttgagtgtgtcacctcattcaacaagcaggccagacagtgtcaccagggcagggcaggaggcctggggatgccttgggcacccacaacgtggctccgccccaggacccctccacgcacacatgcctgactttgccgaggcgcccatgagctgtcagcacaggctgaagtggtgtgctggggtcaggcgctctcacgggagtctgcaggcctggggccacgtgcaatgcttgtggctgtttgtggtttgcccccgatgccccaggccctgtgacgcacctcccccgcacatcacgttcacatgagctgtctctgctgacggtggcctggtgggggctgtgcttgttgagtgtctggacggtgaagtggctttttctcccttcaccacatgctcttggtgaggacgtcgctctgcagtcttcactggaggtgtgaggttccgccgcctctgggggtctgcaggagtcatgagcccacctgcgtgggaggcttctctctgctccccatttatcgttcacctgagcgtggtttgtcgcagcgtggacttgcacgtttttgttttggtactttgggggtctgtcttcttggtctagaaatttaaacatctgggggtttggcaacatttatgacggagagagccacagcttaataattgttgcataaaactctaagtgattttagagaggactctgactctgctcagagctggccttcctgttacataaagccacgcagccttgcaggacgctggagccctgagcacagcatctgctatagtatctgaagtcgcttcagcttttccagaacattggctctgactccatcgttggctctgactctgtcgttgtctctgactttgtcgttgtctctgactctgtcattggctctgactctgtccttggctgactctgtcgttggctctgactctgtcgttggctgactctgtcgttggctgactctgtcagctgactctgtcattggctgactctgtcgttggctgactgttgttggctgactctgtcgttggctctgactctgtcgttggctgactctgtcggctgactctgtcattggctgactctgtcattggctctgactctgtcgttggctgactctgtcggctgactctgtcattggctgactctgtcattggctctgactctgtcgttggctgactctgtcattggctgactctgtcattggctgactgttgttggctgattctgtcgttggctctgactctgtcattggctgactctgtcattggctgactctgtcgttggctctgactctgtcgttggctctgactccgtccttggctgactctgtcgttggctctgactctgtcattggctgactctgtcgttggctgactctgtcgtctgactctgtcattggctgactctgtcgttggctctgactctgtcgttggctctgactctgtcgtctctgactctgtcgttggctctgactctgtcattggctctgactctgtcgttggctgactctgtcattgtctctgattctgtcgttggctgactctgtccttggctgactctgtcgttgtctctaactctgtcgttgtctctgactctgtcattggctgactctgtcgttggctctgactctgtcattggctgactctgtcattggctctgactctgtcgtctctgactctgtcatctctgactctgtcgttggctctgactctgtcgttggctgactctgtcgttggctgactctgtcgttgtctctaactctgtcgttgtctctgactctgtcgttggctctgactctgtcattggctgactctgtcgttggcctgactctgtcgttggctgactgttgttggctgactctgtcgttgtctctgactctgtcattggctgactttgtcattgtctctgactctgtcgttggctgactctgtcgttggctgactctgtcattgtctctaactctgtcgctgtctctgactctgtcattggctgactctgtcgttggctctgactctgtcgttggctgactctgtcattggctctgactctgtcattggctctgagtctttcgtctctgactctgtcgttggctctgactctgtcgttgtctctgactctgtcgttggctgactctgtcgttggctctgactctgtcgttggctgactctgtcgttggctctgactctgtcgttggctgactctgtcgttggctctgactctgtcgtctctgactctgtcgttggctctgactctcattggctctgactctgtcgttggctgactctgtcgttgtctctgattctgtcgttggctgacgctgtccttggctgactctgtcgttgtctctaactctgtcgttgtctctgactctgtcattggctgactctgtcgttggctctgactctgtcattggctgactctgtcattggctctgactctgtcgtctctgactctgtcgtctctgactctgtcgttgtctctgactctgtcgttgtctctgactctgtcattggctgactctgtcgttggctctgactctgtcattggctgactctgtcattggctctgactctgtcgtctctgactctgtcgtctctgactctgtcgttgtctctgactctgtcattgtctctgactctgtcgttggctctgactctgtcgttggctgactctgtcattgtctctaactctgtcgttgtctctgactctgtcgttggctctgactctgtcattggctgactctgtcgttggcctgactctgtcgttggctgactgttgttggctgactctgtcgttgtctctgactctgtcattggctgactctgtcattgtctctgactctgtcgttggctgactctgtcgttggctgactctgtcgttgtctctgactctgtcattggctgactctgtcgttgtctctgactctgtcgttggctgactctgttgttggctctgactctgttgttggctgactctgtcgttggctgactgtcattggctgactctgtcgttggctgactctgtcgttggctgactctgtcattgtctctaactctgtcgttggctgactctgtcattggctggctctgtcattgtctctgactctgtcgttggctgactctgtcgttggctctgactctgtcgttggctgactctgtcattgactgactctgtcgttggctctgactctgtcgttggctgactctgtcgttgactgactctgtcgttggctctgactctgtccttggctctgactctgtcgttggctgactctgtcgttggctgactctgtcgttggctgactctgtcattggctctgactctgtcgttggctgactctgtcgttggctctgactctgtcgttggctgactctgtcgttggctgactctgtcgttggctctgactctgtcgttggctgactctgtcgttggctctgactctgtcgtctctgactctgtcattggctgactctgtcgttgtctctgattctgtcgttggctgactctgtcattgtctctgattctgtcgttggctgactctgtcgttgtctctgattctgtcgttggctgactctgtcattgtctttgattctgtcgttggctgactctgtcgttgtctctaactctgtcgctgtgtctgactctgtcattggctgactctgtcgttggctctgactctgtcgttggctgactctgtcattggctctgactctgtcattgtctctgactctgtcgttgtctctgactctgtcgttggctgactctgtcgttggctttgactctgtcgttggctgactctgacgttggctctgactctgtcgttggctctgactctgtcattggctctgactctgtcgttgtctctgactctgtcgttggctgactctgtcgttggctctgactctgtcgttggctgactctgtcgttggctgactctgtcattttctgtaactctgtcattgtctctgactctgtcattggctgactctgtcgttgtctctgactctgtcgttggctgactctgtcgttggctctgactctgtcgttggctgactttgtcgttggctgactgtcgttggctgactctgtcgttggctgactctctcgttgtctctaagtctgtcgttggctgactctgtcattggctgactctgtcgttgtctctgactctgtcgttggctgactctgtcgttggctctgactctgtcattggctgactctgtcgttggctctgactctgtcattggctgactctgtcgttggctgactctgtcgttggctgactctgtcattgtctctaactctgtcgttggctgactctgtcattgtctctaactctgtcgttggctgactctgtcattggctgactctgtcgttgtctctgactctgtcattggctgactctgtcgttggctctgactctctcgttggctctgactgtcatccgcgcttggctttggcagtggccctgcaggctgctttgctgctcttcagcacggcagcaccgccatcccttccccactgtctcgaccccagaaggaaggaaagatcctctccagaaacttggaccaaagtcaggacacctcaggggtcctccttcctgtggcgggagctgcccttggagcttccttcctgggcaggacggatggtggctccacttcaaagagtactgagagcagcgccagggctggaggggacgctgggaggccgccagcacccagggacaccgccctcggtgcttcatttctcactgacgatgaacagcatgtttgggctccaggacttcaatgtaaggaggttccacaagtacctgcaacaccttttccaccacctgcctctgcgtagccccaactgggtgggtggggccctccctggctgggctgcagcctctgtctctgtgttaatgcatgggaagggatttgacaaggcgtagacatatttgatggtaaaagtgacgtccttttcatttcacaaggttcagggaccccgtggtgggaggggtggcagttgccacacaaggccaggcactcagagagcccaccctgggcgtctcttctgtcagccgggtcatggtcgtgtcctcctttcaaatggcgtgggaaaagcctgatcctgttgctgtgtgctgggtgtctttgtctgtgatatctgactcctgcctagcactcagtcctgcctgtgagctgacctctgaaacaacagagttaccttcctggctagacggggattagtctccagagcctggcaggtgggtgagcgtctctcatatgggagcctgtgtgtgtctgctggtgcaactgtcatcgggtcatttacacagctggcagatacttgctgagcccctgcttggcaccgtggacactgaggagggggtgccctgacttcagcttggtcaggcccaccagggcacgtgaggtcccttgagaggcagaggaatccatggcagggcatgggccatgtaggtgactgagcccatgttgtttggcttgaggttggacctgtgaacgttctctgttaagcccaccttccgaacagcatacctgtagacgggaactcccacgagaggggcctgtgagcactcacctttccagtctgctctaaaagtctgccatagcctcagcaggaagaccaggactgtccgggcctcacactgtaaaaggcctcttctggccttggatcagttgccttagcggacaccctgccctggataggaggccacaggacagcgtggccgtgggtgccttctgcagaggcttgtccccctcctctctaggacttgctgggagaagcgcttccttctggcttccactcctgcttggagctgtaatggcagagttgggatctgaggtttctgggatttgcaacaatacagtgaattcggaaagcacacaagtggctacatccgctgccagccagctgtcccctccccttcgtggctgctgcggcacatggggctggcagacgccgcaccttgccctccctggctggcctgtggttgcaggtccacttctaaggcgaaagaactcccatgtcccatgtgtcatttgcagataaccacagctgaagccagctccgagactctgcattgacttcttggtgaactctgtgtccaccattagcttgttttggggtgaactctgtgtccaccattagcttgttttggggtgtccatgtcagctgtttccagagggtttcctatcattgctgcataacaagagaaacatttcaggcagctggacgccggggggagaacagtctgtctttgcaccttgtactgaggcttttctggtcctgcggggacttggcaacccagtctcctgcgtccagagctttcttccacagtagctgtggtgtatgaaccgtgacttacttcatttcctagaggtgagtggattccttgaagccacgtaacatgtgtttcccaaccctttctgccaagaccttctacttctccaaatagattcctgaccgtttctgccaatgccttctacttctccaaatagattcccgaccctttctgccgaggccttctagttatccaaatagattgtgaccctttccgttcttaacctaaatctctttcacattttaaacagatattttttcttttttaaattttttaactctgacccagtgccagctgaacttttttcttttttttttgagacagcctcttgctctgtcacccagactggaatgcagtcacacagtcacagcccactgcagcctcaacctcctgggctcaagcaatcctacctgctcagcttcccaaatagctgggactacaggcacccagcaccacacctggctaatatttttattttttgtagagatggatgtctcactatgttgcccaggctggtcttgaactcctgggctcaaagttcaatactcctatctcagcctcccaaagtgctaggattacaggcatgagccaccgtgcccagccaaatattttcctttttttttttttttttgagatggagtctcgctcttgtcgcccaggctggagtgcagtggtgcgaactcggtccattgcagcctccacttcctgggttgaagcgattctcccaccttagcctcccaagtagctgggattataggcatctgccaccacgcctggccaatttttatacttttagtagagatggggtttcaccatggtcaggctggtctcgaactcctgacctccagtgatccacccgccttggcctcccaaactgctgggattacaggcatgagccacggtgcccagccccctattttttttaacctaacaagagatatgtatttctttgactccgaagagtacatcccataatcatcaaggtgcaccaaaggggcagggatgacaattgagacgagatggggtgtttagggcactggggccgtagacagggcgagacttcagcaagcagcaaggaggggccgtagacagggcaagcctggcaggggcagtttgagggagaggacgtctcacattgaaacaatactttaaaataagagatttgtcttcatggactccatgcccgtccatggcagagtggcaggtgcaggacgagcctccccactatgaaaccgtcagcaagtgaaataccagagggcacaggtgcccaggactgctgtccctggaaaggagatacatacagggtggccttggtggccccggccttctgcctgagcaccttgtacaccacagctagggcacccagcagaacacaaggcgtctccaagctcaggaggcagggatcagagttgagggcagcttgcatttgtgcggcaaggcattagagtaaaggagctaacacagacatcaccacagaaagctacatggattccactaagtccttgggtttgttctaagctgtgaacgtggagagtgagagtctttgagggttggtggaaagtggcgggtagagtctttgagggttggtggaaagtggcaggtagggagtggtgaccttagtggtgagtctgagggtcccacagtgctggctgggagacaagcctccccatcagccggtccagaggtgacttgcataagaccctaggcactcagcgcatgcccccagaaaggccacatcttaggaggagggttcctctcgccctagaaaagggctgttctagactgaccctaactgagcttttggaaagaccaagttcatcctccagtagctcagctgcttaccagacagactcattcactctccaaaggaagcagacaaaattaacttctcaatgatgttatgatctttcataatgtcaactagaatcagaaactactacacaagtaaagaaacaggaaaataggatccctatacaggaaacaaaaaagggtcacaagaaactgaccatgatagccaagatagcacacgtagaaaagaggatttgaggcagccattacagatacacaccaggactcaagggaagtattcctcttttttttttttttttttttttttgagacagagtctcattctgtcccccaggctggagtgcagtggtgagatcttggctcacttcaacctccacctcgcaggttcaaacaattttcctgcttcagcctcccaagtagctgggattataggtgtgcaccaccacacccagctaatttttgtatttttaatagaaatggtgtttcaccattgttggccaggctggtctcaaactcctgacctcaggtgatccgcccgcctcggcctcccaaagtgctgggattacaggcatgaactaccacacccagcctagtagtggtcttaatgaatgaacacatgggaaatttagcagagactctgaatctttttttttttttttttttgagatggagtctcgctctgtcgcccaggctggagtgcagtggcgcgatctcggctcactgcaagctccacctcctgggttcactccattctcctgcctcagcctcctgagtagctgggactacaggcgcccaccaccacacctggctaattttttgtatttttagtagagacagggtttcaccgtgttagccaggatggtctcgatctcctgaccttgtgatccacccgcctcggcctcccaaagtgctgggattacaggcgtgagccaccgtgcccggccgagactctgaatctttaaagaagagtcaattggacattttagaactgaaaagtacagtatctgtactgaaaaatctgttgcctgggcttaataacaggttggaggtgggtagaagatagcctcaatgaattttaagagaaatctgtagaaattatccaagctaaagaacaaacagaaaaaagattgaaacgagcagagcttcagtgacatgtgggatagcaccaggtggtctaacatacctgtgattggagccccacagagagaggacacacagaatggggcatatagcaccaggtggtctaacatacatgtgattggagccccacagagagaggacacagagaatggggcatatagcactaggtggtctaacatacatgtgattggagccccacagagagaggacacagagaatggggcaaatagcaccaggtggtctaacatacatgtgattggagccccacagagagaggacgcagagaatggggcacgtagcacccggtgggctaacatatgtgtgattggagccccacagagagaggacacagagaatgaggcatatagcaccaggtggtctaacatacttgtgattggagccccacagagagaggacacagaaaatggggcataaaaagtatttaaagaaataatagctgaatgatataaatgtgtaaatccaagaagctcagcacactgtaagcagtaaaagtaagagaaaatgttatctgggcacattgtagtcaaactaccgaataccaaagacaaagatagcacctggaaggaaaaagacgttacactcaaagaataaagattcaaatatgtctggcttcttataaccactggaggccagaggatgatggactggcatctttagagttctaaagaaaaacgattgtcaacccagagttctatccagtgacaatatccttcaaaaacaaaagcaaaataaagacattttcagataacggaaaactgagagaaggctttgccagcagacacactatagaaatgttaaaggaatatcttcaggctgaaggaattattgcttggcagaaagaattattgctaggcagaaagtcatctatagaaaggagtaaaatccactggacatggtaaaggtagggaaatatgaaatgttctctatttctttttttcttaatttaatacagacacaactaaggcaaaaactgtaatactgtaatatacacaacattagcacaaaggagggaggggatccttcctgaatctgtaacatcactggctctctaaattctacgtgaagcgagaaaatattaaccccaggtctgttgtgagtaggtgagatacctgctgttagccctagggcaatcactaaaagtagtgcaaagatatgtagctgaggagcccatggagtgattgaaatggagtgttaaacatgtttgcttccagtaagaaggcaggaacagaggaacaggacgaaaaaccaggtgagactctgaaaacaaaaaataaccaatgagccatatcaatgattacattaaatgtaagtgactaaatcttccaattaaaagacagagatttagaatcaggccaggcatggtgactcatacctgtaatgccagcactttgggaggccaaggcaggcagatcacctgaggtcatcaggagttcaagaccagcctggccaacatggtgaagcctcatctttactaaaaatacaaaaattacccgggcatagttgcacgtgcctgtagtcccagccactcaggaggctgaggcagggagagtcacttgaacccaggaggcagaggttgcagtgagccactgcactccagcctgggcaacagagtgagactctgtcgcaaaaaaaaaaatcaatttaaaaaaatcaggtatcaagtatatgcagttttcaagagctatgctttaaatataaaggtacaaatgagttgaaagaggaaggataaagataaagaaggatagactacataaatatactggaaagctagagtggctgtattaactttagacaaagtaaagttcaggacacggagtattatcagaggtgtacagagacattttgtggtaataaaagacttaattgatcataaagacataaaggcaccacatactgaacctcacaatatatgaagcaaaaattgcagaactccaggaagaaatacacaaattcacaattctgtttggagattttaacatcaatcactctttcaataattgaaagaacaactaaacaaacaaaaaaaagaagacatagaagatcagaacggcactatcggccactttgacataattgatgaatccctttaccctgcagtacttccgggtgtttttcctaagaagagtgttcttttcattcctgcagggatcagctgcagtaggtttaacacggttgcggttctgagactgcgtctcccactcattttccagtttgtcatctgacctaaggataatccttatagcatttactttccagaatagggttcggcgttgggtttagttgtctggtctcttctgggacatccatcttttatgacactgatattttaaagttatgcattcctttaaataaatggtgttcctctttggggtttcccagctgtttcctgtggtcgtcgtcccaggcaggacgctgcctgcggggaggaccctcccacaccacctgccttgtcctccatgatatgctggtccccggtgggtgagcctgtgtttctaggtggtcaacagggaatggagatatgtccaaaccagttcccatggccctgtgagagatgcatggcggcattctgcagccatgaccgtgaccacgtggggaggcttcaaacaagaaacacttactcttccacagttcttgaggccagaagtccgaaatcagggtgtcggcagggccagttccacccaagtctctatgggaggagggaccttcccttccctccgagtctctgcgggaaggtccttcctcgtctcttccagcccctggaggctccgggcacccccggcttgtggacgtatcactcgggtccctgccgctttgcctcctcccctttggtctgtctcagggttcctggtacgtctctctgatgaggacgtctgtgatcacatagtccaggacgccctcacctcgagatccttaacttaattacctccacagagaccccttttccaaataagacagggtgcaggcattaagatgtggacaggtctttctgggggcctccttttagcccactgcccagggcttctctctaataaaggtgggctcagactgcgcaccctgttttattccctgtctggtcacttaattcttaaacaattttcattacctggtccttatgacaatattggaaataaccaaagtttttttacttcccgtcaaatcacaagtatcttcccatctcgccgacgttgtcttacagcagctttggtcagcatgtactgctcctgacagaggcagaggccgcgtggagagtgggccgggtcgccgcagacacagcagggtcgaggcctggcgccggcagtctcagcgacgcactggtcattgccccagatgccacgcgcccgtctggacctccgctgctcggcggcacgtgtggtggccacagggtggtctgttacgtgtgtttgctcattgcgccaagcccaccggccggcacgttggttgttcctggtttttattgctggaagtggcacctcggtggccagctttgtggcgcagggatattttgcagggctgtgacttactgtgtgaactagctcctgaggtgggctgctgggtcagggtgtgcgtggtggacgggtgccgccagcctgcacccagggttcgtgctcacggcggggacagcgtgctgttgtcctgttccctactcagaacatcccatttccgaaaaaccactgagagtttttaagtgaaaataatgttatttaaatacgcatttctctgccaagttatttttcttggttttgctcttgttgtttctctggggatttgtgttttgcctttgccgttcccctttggtgtgaatgttctttgtttatccatctgtaagaggccctgctgtccgggaaggtaaatgcacgtggaaggtgtaaccccttggccgcatcccattctgtatgcacggactttgctttctgcacaggtttcctcttgtgtccagtctgcccgtctttccccattttcattgctgccttaggtgctttgtcgaaacggcctccagcactttttccttacacttttaagggctatttacatatttacatcctgttttaaattgcttacctgtagtgaatggactatgtactctgaggtcggttttcacacagtaatgggagcactgtccatccatcccttcgtctgtccatccatccatctgtccgtgggagccacacatgcacttggtgctccctgcgctgcctggcttcaacagcccgggtcctcccaacagccctgggacctggacttcctcttggcagctccagtaagaggcaacaggcgacagatgtttgcaaagacacctcttgttattaccattttattttctctgttgtatgaacttaaacattagggtggcagcagtcatgtcttcagtgaaccagttgcctcactggcactgccgaactggtatgtgtggtccagccccacccctgccatccccacgagctgccatccagccccatccctgctgtccccgcgagccgccgtccagccccatccctgccttccctgtgagccgccgtccagccccgtccctgctgtccccgcgagccaccatccagccctgtccctgcaagccactgtccagccccatccctgccgtccccacaagccactgttcagtctagcgcttccctgtgccaggcaggccatggccctgcacagcgggacccagcgtcccggccttgccagtgctagctggcaccccgttccgtgattgagtgggaggcacagtggtctggtgggtgctccaccccctctcctgcgaggcgggtagacatggaagccccccagctgctctcacccaaaggcgcccctctttttttgtggtattttttttttggtaacttctgtaaataaatccacgtttggccttcaccacatgacaaagacttcagtcttgatggtgggatcagctgcagacacaagtcaggaacctgggcgtggttcaggatcagctgcagacacaagtcaggaacctgggcgtggttcaggaggacatggttcatgattaagtccctactacacactctagataggcctccagcaaagttctttgcactaggccagaaactggaagatttcttacaaatttacaactagcctgccccaaaatggggagcataaaatttaacaaatatttatacatgaagtctttttacagatgataagtagctggagccaaatgtgtttttaaatcaaaagcttcctatagaaatgggagcccccatccagtgcaaggggcagggcctgtgctggggccgtgtgcagcatctgcagggcatcgggggtcttgctgcctccctagcacagagaccccaacgacctgtcagtcaacagagaccccagcagcctgtcggtcaacagagaccccagcagcctgtcagtcaacagagaccccagcggcctgtcagtcaggtgtggaggctcacaggggagcaggttcctgacctcactaggcagtcagagggagcgtgttaaccccgaccatccaaaagcaaaatctacgtcccactgtccaggaaaggacttgagtttctttaaagaacaaaacagcagaacaaacccagaagaactccacggagtcggtatcttctaacgtgagttccaactgttgaaaatgtaataaaagctatgaaagtaataagacgttttagtttttcgtgtcattaccttagctaaaacctgctatttaaagattcttttatcaggcagccttgaaatgcaaaattcaaagcaggtgaagtgacagaagaatgcattttcgaacaccctcagccgatgtgaaggcagctgcgtctggactcaccccttctctgcacaacgcttgtattttggtggccctgagtcactgaaactcttccaggccttggtcccttctgataaaagcgtgaggctgcgtctttttagctaggatctcccgccctgtcgcccaggctggagtgcaatagtagcgcgatcttggctcactgcagcctggaactcctgggcttaagccatcttccagcctcggccccaaggtcactgggactacaggtgtgcgccaccacacctggctaataaaagagcaaagcttttattctctatggatttgaaaaatcagctccttttcctttctccgttcaactaaggttatatattgggaacattttgggggtaaatttatttctagcattagccaatgtgtacagcggttgcttggaagattttggtcacggaaaggggggcagggagtgtatcctgcagcccacagagtgccctctctccctcccagcctccttcctcagcccacggggtgccctctctccctcccagccagcttcctcagcccacggggtaccccctctctcccagcctccttcctgagcccacagggtgcctcctctctctcccagccaccttcctcagcccacggggtgccctccctccctcccagcctccttcctcagcccacggggtgccctctctccctcccagcctgcttcctcagcccacggggtaccccctctctcctagcctccttcctcagcccacacggtgccccctctctctcccagccaccttcctcagcccacggggtgccctctctccctcccagcctccttcctcagcccacggggtgccctctctccctcccagcctccttcctcagcccacggggtaccccctctctcccagcctccttcctcagcccacacggtgccccctctgtctcccagccaccttcctcagcccacggggtgccctctctccctcccagcctccttcctcagccaacggggtgccctctctccctcccagccttcttcctctggagtgaaaagcaaatctagacttcgtactcttttacctataaatagtgtggacctctaccgggtaagggatgatttaaaaagatatcagagccactggggcagccacacacctgatgcggttgaagaatgagccctccagtactctgtccccgcccacctcccccacggctcagatgtcgtttgtcatggcctttgctgtgcttttatcgtaatgtcaaggtggaaaatcacagacatattcaaaggtcggacgatgtagggagccctgggatgggcagtgggccctgagggccgtcccacaccctgtagcttttcattcctgtggatttcattaggcaacgttgctccttaatgtctttagtgagatagaattcacataccataaaactgcatttaaagcaagcttgtccacacgcggctcaggatggctttgaatgagacccaacacaaattcataaactttcttaaaacattatgagtttttttttttttagctcatcagctgtcactagtgttagtatattttatgtgtggcccaagacaatttttcttcttccattgtggcccacggaagccacaagattggacaaccgacaaccctgacataaagtgtacaagtcagcgtacatattcatggactctgaagccatcagcaccacgttgaaaacattctggctggggcagttcacacctgtcatcccagcacttagggaggtggaggcaggaggatcgcctgagtctaggagtttgagaccagccagggcaacatggcaaaacctctatagaaaatacaaaaattagtggggcatcatggtgtacacctgtggtcccagcaactcaggaggctgaggcgggaggactgcttcagcccaggagcttgaggttgtagtgaggttatgcaccgctgcactccaacctgggtgatagaatgagaccgtgtctcaaaaaaaaaaaaaaattctgatcaaccccaggataaacctggcaatctacctcctgtgtctgtggaccggcctgttccgtacatttcgtgtccacaaaccacatgctgtgccttctacgtcaggtgtggcactgagcacctgaggcagggctcctcatgcgggcattggtgcatcctgcccgcctcttgcgggaccataggtggcagagggggtttcttctagagcccaagggtaggtcttgctgtgaggtggggtggggttagagaggtcagaggctgaggcaggtgtgggatgcattggtgttgctttcccgcggctctgcctcctctagacacccgtgctgcttgcccacgcctctgctgtctgagggtaagaagcgggtcacagcatcactgaaaccccttttggttgggattcaatagtaaagacacaggccttgcccagcctttcccaccaattcctttcatttaagatcccttttctaatgagctgcgctcgaggtcatgtgatgtccttaaattttcagattccagagtatgacatttgccgtggcatttaattgatgctgcaaaaaaataagtattaattcactcattcgcaaaatacatatttttttatttctatgggtacttagtaggtgtatcttggaatatgttttggttgcctgttctgggcctgcctgtgtgtgagccgtggggaggggctcctgttcccctaatgcccagcgggcaggtcctcctcgcagggcttccctgaccccacaccgtgctgggtgccagggtgggcttcactcagtggggaaacagtgggtttttggttgaaacaagccaaagtgttaatactcgtttcttcttttgtttttcaggtactctttcggtaagtgagatgcatttagagaaagctctgcgagagttgagcgttgtgtgtttggtatgtatcttcacgcacttttcctggcctctccccttccttagcctctgccatcagccttcccagtatgcacggagggcagtgatgggcgcttgtgatctgatccgtgcctcctccctggatgtgggagctcctgggcttccaggccccgggcacctagagacggatggtcgcacgcatgattgtcggcatctcacaggtgtgattaccaccgcttccctggggcagagggaaagcacccacaggcccatcccccgtggacgctcaaggctgtgtgcccctcggcatagagaaggttcacggtgctcacggcactcacgctggtgggcactttggcttgtgctttgtttggtggaggggaccggaggtcttccccatcccacacaacgcagtcaatactggagggtgggaagagggcagccacccagtggacaggacagggccgggaggacggtggatgtgacctccattgggcccggaggcctccagaatgtcatgggacacacggtggcttggtaagcagacctgactccaggaccttgggaaggatgaccatacccccacccctgcctttctccatgacctcagggcgcaggcagaggggccggtctttgctggtaaaggccctggcctgggcctcgcactcaggctctctctgccccgaactctctggctctcggcccctttcccaggagagcaggggtggcctgtctgggcgtggatctttgcctgcccccttcacagtctcagccttcagggcctgtgtccttgcggtagaggtcactttcttcattcttttattcctcacgtattttcattccttcaatattgagtaccagtgatgctggaaatctggatcgaatcaaagaaaggaagaacatcagaatctgttaaaacgtaaatacaaaggaaccttattcctgattttaatcaccttgaaaggcaggttcctgtaattgcagacgaccaggccaccttggccactgtcactcatgggtttcctggctgctgggtgccacctggctcggggtgcaccgtcagggcgtgcggctctgcgtgcttgcgtctgttcattgtttccatgtttttcttaaagcaagaagcaaggaattatttcaggaattccttttctgtttgcaaatctgacacaacctggttggaaccagctggttttttgcctgccagtcctgtggctgcatcaagggagcagagtgctcacgcgtgtgggagcgagtagacgtgaggaagcgtgtgcggcggcctgagtccccaggcctcccctagagtgctcacgcgtgtgggagcgagtagacgtgaggaagcgtgtgtggtgacctgagtccctgggcctcccccgcagtgcgccagtatacattcagtatcaaaatgcccacagagaaaactacattcttcaacatttagataaacaaatcttttcttagtaaattttatttatttaaaattacaacagggtgggtgcagtggcttatgcctataatcttagcagtttgggggctgaagcaggacctcttgagcccaggaattccagaccagcctgggcaacatagcaagaccctatcaccacaaaaaaaatttttttaattaaaattgtacaatcacaacagtattattttttcccagttcttatgaggagggaaagctttaggtcctgacacctgtgtctagcgggagaagtccctgctgtctgatgttgtggactctgagcagtgatcgcaaaatcgagtccgtgaggcaagagcccagtgcgcgggtcagagggtcagcaccgcgggggctgtgagcgggcaggccggggcaggctcggggggcagcggctgaggcttgtgtgttccctgtgagagatgggcctgcgaggccacggtgctgccgtgtctcagcaccagggccacaggacccatcgctgaggatgagagggcctggagcccaccctccccgtgcccccgcctgtgaggcctcctggggaacacaggctctactctaagtagggtgggggggaagtgcctggggcagtggactcccagaggcagtgctggagcggcagaggcagtcgaggagccgggtgactctggagccagcctcccgcgtccccaaccacttgctgaagcaaaagcaacggggtctgcatggggggtgggacgtgagcctgtgtggccgccgtcgggggctgcgcttgcgctcccagcccagggaagtcagtcttctgcgtttgtgtctccctgggtgttttcaggtgagcgtcatacattctaactgattcttcggtagcaggtggtaattgtagggactcagaagcgaattgttgactcattaatgttaatgttttccgcctgagagccctcgtgagcctgagtttcatgttgtgtctgaccctgcagcggctcagcacgtcactttggactgtcgcgcagaaattcagaagactcgtagtagcttcggcagtgctctccctgccttccgagcagccatgcgtctttgaactgtcttcccttccctgatcttggagaacatagagctgccagttactgaggtatgactccgggtgctgggcctcagaacacctagaccaaaggcactggaaggtcaggcttcctgatctgagacctctggggaggctcctttcctgtggcctcgttcgggacggcctgggagaatgcagtttgtgcgtgcgttcctcagctcatccgagccgcgtgtgcgtctgtgtccatctcagtgacattccttgtcttcattttgcacaatgggctttagtggagatcaggtggttcagggcggggcacggggtcggtcactgggaccctgcggcccgcaaagcagcatcctcaggcagtgcgtgccccgaggcagcagccagccggctctaggtgggccaggcttccagggcccccacccagcccggccactgggcacatgtgtttctaaaattaattaaaactaaatgaaataaaaagctccagtccttggttgcgttggctgcacctcatgtgctccgtggccgcatgtagctgtggcttccccactgggcggtcccagaccttttttttttttgagatggagtctcgctctgtcgcccaggctggagagcagtggtgcgatcttggctcactgcaagctccacctcctgggttcaagtgattctcctgcctcagcctcccgagtagctgggattacaggcgcccgccaccacgcccggctaatttttgtatttttagtagagatgggatttcacagtgttggccagcctggtctccaactcctgacctcaggtaacccgcccacctcagcctcccaaagtgctgggattacaggcatgagccattgcgcccggccccagaccattctcagcccagcagtctgcagaggctgccagtcaaagatcctaacatttcaccagcagcaaaccctgccttctgagggctcgtggctcggcgtgggctccccgggacatgctctcacaatgctgtgggtgtgagcgggacccgcctgaaaatacacacggctgctcttagtgaaacggccgctggccgggaagtccgcacagcccccgtcgctagtgtcttcctttttctcaggatgaccacaccatccacagaatgtttacgtttcttttcttttcaaggcagagtcttgctctgtcacccaggctggagtgcagtggtgcaatctcagctccttgacctcccgggctcaggcgatcctcccgcctcagcctcccgattagctgggactacaggcgcactgtcatggccagctaatttttaactttttgtggagatggggtcccactgtgctgcccaggctggtctttgggtctccgttcacatctctctactgttgtaagagcccctccagcgagctcgcctgctgctgtcctgggctctgtgtcccagggtcctgcgcccctgttcagacggacgcgactgctgctgtcctgggctctgtgtcccagggccctgcacccctgttcagacgaacacgaccgctgctgtcctgggctctgtgtcccagggtcctgcgcccccgttcagacggacgccaccactgctgtcctgggctctgtgtcccagggtcctgcgcccccgttcagacggacgtgaccactgctgtcctgggctctgtcccagggccctgtgcccccgttcacacggacgcgaccactgctgtcctgggctctgtgtcccagggtcctgcgcccccgttcagacagaggcgactgctgctgtcctgggctctgtgtcccagggccctgtgcccccgttcacacgtacacgaccactgctgtcctgggctctgtgtcccagggccgtgcgcccccgttcacagacggacgtgactgctgagcaggatgaagctgcgttcgtcagggccgcgctttccaggacgcaggaaaaccacaatatttgttaaaccccattctgccgtctgtgtttctgctggagtttagatagagctgagctttgagggctgctgagtttggtaacattcacttcaaagaaggagcctgacggtaatgaattccgcagccccgaatgtggccgcttcctgccgccctgcagcgagtgcaccttttgatattcagtgagcctggatctgggagtgtctcgagcttccagccgcccttgcgcattggaaaggatgcgggaacccgagaggacccgcagcagcgggtggcagggctccgtggggctgcctgctttccctccaggaccagaccgcctttgccggcaccctcccgacaatgcaccgtcccccaagtgtgggcctgacccccagtttggccccatcccctgagtgtggaccctgtcctccagcgtggtccccgtcccccatggggcgccatgcctagcacctggttctgtatggagagcgggctctgggaaggggctcccgtctgcagagtttggtgaggttgaaacagcaaaggccacagccgttgttctgggactgagaccagggccggtccccagtgcttctggagacgctttctggcccctcccaggcctggggcagctgggagggatggctgggcttttcaggcgcgggatgggacagcattgtgaccccactggccgctgagatgtgaccaggggaaggagacactcgtggtgaggggttctggaaccaggggcagccttgtgtgagtagggggcagagtgcacaggcgccagggcagggcttcctctggctcagctcctgggccactttgccaggtctttgtgcccagatagagtcccagaggaagaccaacaggttcccaaggcctttggagtgttttaggcccccaaaatcgttttgtaatttctttgtgattttagcctgatggacttgggtgtgtacgggtgtctacctccaggcgatcctacccccatcttgcaccactgggcccccatgggggtgtagggatgggcccgtgggggcgtggggatgggcccgtgggggtgtggggtgggcccgtggggatgtggggaggggctcgtgggggcgtggggatgggctcgtgcagggaaccgggctgttgatggtgactgcctgtggggaggggctggaggcctttgcccccctgctccctcagggcagtgaagtgagggtgtcagctgggggcatacagaggagtgagggtcccaggacccagggaagggttctggaagtctccaccttcccaggatattcctttgtaggaagtgggttctgtttcttactacagtcccatccaggggagagttggacaggccagggcctgagggaatttggggtccttggagtaagaaacttggttgatgaatggttggtttatccttatcttccactgatgaatgattggtttatcctcatcttctggaaggccaatgccagctggtctggggccttcctccatgctgggccaggtgtcagcgccaacacacaggtggcctgggtctcactgggattggactgtggttatgctgaaaacacgtggaggctgggggggcccatccacgtagcgggtgcgaggaatgaatctcagcagcaacgggcgctcctgtgtgagccacggaggcaggacggccaggctgtcccagcgttgggtgcctgtgtggggccgcggcccaggtttcgttgcaggttgtgctggaattcggttatttgtcgctacattcggaggctttccaagcgtaccaggcccctcctgggttttgctgctgtgctcttgccaagcgggaaacttccccacctctcaggtctgctttctaggctgtccccgcacaggccaagtgtcgccgtgcgtgtgcggggccccagacactgggctagggtgttttccattgcggcagcacctcccgccagccattgtgaattaaatgctccctgtgacccttcacccttgcggctcttaaattcgtgctttaaaaacagcttaatgaggggttcactggcccaactggaagtttttattaagccctattagtgctggagcagagcctgcctgcgggaagcgatcgccgggtgagctccgcctgggctgcaccaggctccaccaagcagccccagtccccgccctcctgtccctgctttagctgatggcccttccctccccttcccagctcccagggtcagggatgcagtttcttttaattaaattattccctaatcagaggcagcctccacggcctctgccgtgagctcgctcagctgccgggctgcaaccggtaggccgagccagctcctctctgggtcctttctcttgcattcctgtgttgatttaattgcacggcccctccctgggggagaagcatcctgtagagcgtggttccagagggttccctcaaaccgggaggcagagcccttccctgtcacctggggcgtgaatgactgtggtcctgcgtgtctctggtctcagtgtctggtcgtgttcttcataggaaggacagggaagcccacttgggtgacttttagagcccgccacgtgacatgggctagctgtgagccatctccacgggccatttccaaggtgagaaagggctcttgagcagcttctgccacttcctcaccatgagcggcccttggttggccatgagagaaggagaggctgccctcagactcggctccatctctggaggcctctgggcctgagtctccgcctgggtgcagtggcccttctggaccctccagtgctctccactggggtctcggggtgtttcttggctccaggagtggtgttctcgcctggtggcttctctgtcactacttgccaggctgtcttcttgggccacagggaccccagcataggcccggggtgccgtccagggaggactcctatggctagaaggggaggactcacagagaggagaggtggcaaatggggacccggggagcagctgacatcctggctgtgacctgcagggtcccttgggtcctgcatgcagccagcacagtgaaggaggagaggaagcctctgggtggatgccgggaccccttagggtgtgggccgtggtgccgggttccaccttcttcacacatgtgcgtgcgcagctttggtggcgcttgtttttagggtagtcttctttggtggcgcttgttttgagggtagtcttttttcatctaatttacatccaccccgtgttaacctcccggttccgtccattcttatcttcatgccaactcagatttgtacccaaacacagacgtgcaaacacacgtgcgcacatgcgcacacacagacacacgtatgcagatcctgtgcaaacacacgagcacacatggacatacacagatgcatatgcagatcatacgcaaactacacacatgacacaatgcagatcatatgcaagcacgtgcacacatgcgcacagacctgcagatcttatgcaaacacgcacatacatgcacacagacacgtatgcagatcatatgcaaacaggtgcatgcatgcacacacagacatacgtatgcagatcatatgcaaacgtgcacacgcgcacacagacccacgtatgcagatcatatgcaaatgtgtgcacacgcgtatgcacatatgcaaacacaggtgcacgcatgcacacacagacatattcagatcatatgcaaacgtgcacacatgggcatacagacccacctatgcagattatatgcaaacgtgtgcacacatgcgcacacaggtatgcagaccatatgcaagcacacatgcatgcatgcatacagacacgtatgcagatcatatgcaaacgtgcacacgtgcacacacagacacatatgcagatcatatgcaaacacgtgcacatgcacacagacacacatgcagatgcacatacaggatttaggggtaaatgtttgctttactcaaacagggccatattagatacatttctttcattccctttttttcacttactaatatctggtgaaaattactaagttgaacctagaagaaaagcatatatatatagtttttcttcagagacagggccttgctcatttgtccaagctggactgcactggcacaatcacggctcattgcagcctcgacctccgcagactcaagtgatcctcccacctcagcctcccaagtagctaggaccacaggcatgaaccaccacacccgattaatttttttattttcttttttatagtgacagggtcttgctatgttgtccaggctggtcttgaactcctaggctcaaactgtcctcctctcttgacctcccaaagtgctttaggggattacaggcatgagccaccacgccctcccagaaaatagattttaaaggccattttgtctcattcacacgatcattaacattttgttggttttgaatttctcccatcacgttgttagccatttctgttttaaaaaattctctttactatgcagaattctaaactactgaagaagtgttttgttgctgtgattcatacttccagtgctgaatccacttgagtggctttaatctagaatcttcaacgtggctttttaattgtttttaactgtatggatgcaggatgtttggtggcatctgctcttcattcctagtggattagtgacagtgacagtgagcaaggggcttcctgtgtggctgaagagggcggtttcgtcaccacccattccgcagggggcagctcagcccagcaggcatttggggactcgcacccagcactctgcggacgggggtctgactgcacccgctcctcccctccaccccccgctgccggctggagggcacagtctgtgcggtggccttgccaccccctagcaggtctgcatccgttctcccgcctgggcctcaatacttgtttcctccttttcctcactctcccttgcctaaaccgccatagatcatcccctttatgggtcttttcaaagagctggttttatctatcagaattttaaaatatactctagctcattcgtttttgcctcttgtagttgcttgctttttctgggagaaagtggtttatcatttccagtgcctggagttggttcagctattttctgtctcttcttctctgctaatgaaagccaactggagggcggctacccacttctgggtatgtccctgccctaccctgtcatctgagacccccggctgcccctgacagtggccgatggtgtggttttataaccttcagcgctaatgcctctagaccaaggacagcctggagaaatgcttcgaaaatgccacatgctcagggttttacaggtggccttttgtttctcaactttgattttattacactgtggccagtgtggcctgaagattgttcttttaattattaaaaaaaaatgggcatgtgcatgaatagtcaaattgtattacacgacttataataaaaacagaagcccttgccgtaccacttctcagccacatgctgttctccagacaacccttttatcacttcctgcacttaactctggtatttgtctgtctttctgactgataggtttatatgggttattcttcgcataccacggttagacactgtgtatacatgtcctcttatgaacgacagggattgccctcacacaccctaatgttcttctcatcatcatcagtatagctgtgtcacaagtataatttttattagtttgattgtctttacattattttgactctgtaaatattgtgactgctgagccaaatagtgaactatagtaactttttttctaataactcttcatttttcctggagttcatagttgccttttctattttgattggcttcgtttttcatctctgatcatatctcactcatttgttccaactttaccagcacaactggtcaaccctttccaatactgttgtttttacagaatcaaacacattggacaatccatcagttttttctctccactttgtgaagatttccgctcaggacctcattgttactgcttggagcagatgctttgtaggcctctggatttggagattgtggggcaggttaactctgccagattgggggccactgatgagtttgtccctctgcccattccagggatcctaagatggttcccaggagcaggtgacctcattgtattgagggtaaggctcagagtccacagcccctcctccacgtccttctaaagcagtgctcttagggaggatttctcttttttagagctgggatcttgctctgttgctcaggctagtctcaacctactgggctcaagctgtgctgccacctcagcctcctgagtagccgggactattggcttccctgagaagcctgatgctttagtggggaaggtgtttagagaccaagacgtgggtgctggggtgcccgttactactggggtgctgcagcttctcagcccctcagccggcagagttaggaaatacatggctgttcaggaagccacgcaatggggaggaatgaactgtggacagctggggaccctcgtaggccacagtgcaccgtgccagtgttagcagctgccacatccgccccacactccttgcccctgctgttttgccatgacgcagatcccaggcatcacattcctgcatttggaaatgcctcctcgtacacctgaagacaggcctttgcaacaacacgacgccaacaccacatcacacccgaaaacccaggcgactttcacacagggccttcgcaacaacacgacaccaacaccacatcacacccgaaaacccaggcgaccttcacacagggccttcgcaacaacacgacaccaacaccacatcacacccgaaaacccaggcgaccttcacacagggccttcgcaacaacacgacaccaacaccacatcacacccgaaaaccccggcgactttcacacagggccttcgcaacaacacgacaccaacaccacatcacacccgaaaaccgaggcgactttcacacagggccttcgcaacaacacgacgccaacaccacatcacacccgaaaacccaggcgactttcacacagggccttcgcaacaacacgacgccaacaccacatcacacccgaaaacccaggcgactttcacacagggccttcgcaacaacacgacaccaataccacatcacacccgaaaacccaggcgactttcacacagggccttcgcaacaacacgcaccaacaccacatcacaccagaaaaccgaggcgactttcagacagggccttcgcaacaacacgacaccaacaccacatcacacccaaaaaccgaggcgactttcttcacgtccatgttagtaatgccttttctcagctgtttgtccacacaagggctggccacgttaggtggacgcccgtgtgctgtctccctgcttcaggtcctgctggatcagttccccagtggccgctctgcctgccattctgcctacctggctaccagtcgctgtgggctgggggtgagagctcacagctggatcagaaccccctctgtggcccccctcgggaggtggctgccttctcccaccttgcatcggaggcgagattgtgcagggaccagaggctgccctggtctgcctgtgagaaagcccctgggtggttgctgccaaggagcatggctgggcctgcgagacagggtgccccgatctgcctggaagttttctgtccaggccgccctccctcatcgcctctgtcccgtgttggctgcttggaatgcgtctctctggacctcatctgggataaacagctgcttctctccccttactcctcagctgtgggggaacgctggtttccaggcccactcacaggatttttaatgttccgcccagaccttgctaacacctctcagcggctaagcctatttctgtagattctcttacttatgttttgtttttaaattttctatgtagtcaatcttttttacatttcaaaccttttaacctttgtttttctcctaagaattgtatagtaaaacccgcacggggaccgcctggatgccgtaggttctgttcacggggtttgctgcgttgttacgtagtgggtctcctcgcccgtgtcccccgtccctgcgtcggtgcttcagcgcacatcagggtggggctggtgtcaatgcttcccacatcattagctggaactcaccgcacactgcgtctttccctccataaagaacttgcacgagccccatcaaggtatagggagtggccgtcaccccagaaagtcccgtcatccccactcgtcaccgcccgcatttgtacagagatacagctgtcttgttctaagggcgagtccctgtgagaacgcgtggagcgttttgtccctgcccccacacactccgccggggggtttggctttgtgccggtgcctggctggcgggtgaactttccacagggcctgccttgtccacgtctctgcagggagcgcaggtccgtgtgcccacccaggaggtcttggacccagcagcccctcaagaagggctatggcgactgttcaccgcaggagggctctgcgctgtctgaaaaggggaacagaatgccccagtggaagcagatttgcaggtgatattagggaagcttcctcctgccttctacttacctggacttcttatcctccaaggcgcttgactcacagtcttacctccttgagttgcctccagaagaaaatggtctttgttttactgagttccttctaagcgcagtctgtgatggggcccgttctgtcctgtcctcgccctgctgagcactgagacagagacccaggcgacctgctgaccgaggccagctcacgagcctgctctgggccacgtggtgccgagttgcttcctccttcaggctctgatgacactgaagctccccggggagaacagcggtgtcctttgctgctggagatgcctgcagatgcttgctctgggcatgcaggggcccctggggaaggatccgcgcctggctccctctctccatctgtccctcgttttggacgggaagtcgactatcattcctgacgttccagtgtaacgtgttatgtttctctgatggctttggggattttatcttccgttgccagtttcttgactatgatatgcctactttttaccaaatttggataatttttgccaatatttgggggggttgccccatgttctttctcctctcctgtggctccacggacatggacatcaggcctctccctgccttccacgagctcctgggccctgtgcttctgtgtggtgttttctaaaagcctctcatctctagaatgagtcactgtggctgctatgtcttcgtgttcactgccttttctttcgttcttcactctgctgctgagctcagccaggggcatttgtgctctggagattttagttcttgctctggagtgggcctggccttcctccgaggctctgtgtctctgctcagctctccagcccgcctgcctggcaagcacgttttcctgtgctttccggtcctgatgctttcctgcgtccgtgtggagccagcgcttggggtgtggtgtgtagagaggggaatgtggacatgcagtgcgtgctgtgggggctgacgggctggggccggtgtggatgtcgtgtcgggggccgagccaacgggccagggccagtgtggatgtcatgttgggggacgacggactagggccagtgtgaatgtcttgttgggggcccagctgacgggccagggctggtgtggatgtcctgttgggagccgacaggctggggccattgtggatgtcgtgttgggggctaagccgacgggccagggccggtgcagatgttgtgctgggggccgacaggctggggccagtgtggatgtcctgtccagcaaggccctggaggtggtgtccgggcagtcttgaccgaggccggaaggatggtgccgggggcaggagcctgactgcctcggaggaagggggtcccggggcggagctgtggggtggggagcccattgtggatgctggctgcttcaccctcacccccacgttctgtctgtgggtctccgtgaggctcctcccagggcggccctgccacatgatgtagctgaaacccagtcctctctgcacaccagtgtttctaggaaaacacttcctgtctttctccccaagacctccaggacgtgggcctgaggtcatcactgcctccttcagttgctgctgcccgaggcccccaagagtgacccacatgagactgcggtccagacgccctccctgcctctgagggcgcacactgtccagagcgggtctgtgggtggaatgcccccagcggcctccgggccccttgtctgtggggcctgtgccctggtgctgccggcactgctgtcctcacgcgagcgctggagatatgagctttcccaggggggctcagcagtgatgaaggtggggcaggagctgtgtgtgtccaccataggtcctgacagagatgaagcagaggccacagggctgccctgccccctgccgcgggcatgtggggtgattcccgcccacttctcaggtgtgccaacccccacgttccttccctgtgagtgtgtgagctcacatagcccctggacacaccaccctccacgtggggtggatcgtgcctgttggccacactgagcacacctggaaacgccgactgccgagtgtcaggggagggtctggaaaagccgcgagtgaaaacagactgtcccccgagactgtgtggtgaggggaacacctgattctgcagcctgggagtccacgccgacatgccgactgcccacacaggtgtcacagcagggatgtggatgctactgtgctgtgcgggctccagcccaggaggccccgtgggaggagcaggtgccgagagctcgtcccaccgctactcgggagtgagacccacatcccacaggtgtctctgagcaggcgcccaccccaggactggctgagagtcagggtgcaccccagggcactggccccacgtgagagtcggggtgcgccccgggatgccggccccgcgtgagagtcggggtgcgccccgggacgtcggccccgcgtggtcacttaaattcacatccaagtgaaccaaagttaaatgtgatttaaaatgtgcttctcagccacgcaggctgcctttgagtgcctcaaggcctgaagggccggggcccttgaggcacaccccgtgacccaggacagctccgtgggcacaacgtccccgcagcccacgatggccagcacttttctggggtctcatgagtcccttggaggctcggcacacttcagccatttttcatgcccgggacacaaaagacaaagaaatggtcaggtgtggtgcccaccagcctgacttaggtgaaatacttggaacacattaatcctaaacactctttgccgcgaagtctaatttccgtggacgggaagcattttcgtatttatccaaaaccaataaagatagctaaggtcattactgcggatttgtttcccaagagctggtgacacctgcacagagctgagccacagggacacctggggctaggaagtctggttgtcacggcaaccaagtacgaacaagccgcgcggccgggcgcaggggtcactgaggccacttcctgtttctcggcagcgcccacggacagccttaaaatatgtaacagtccacgaaattcctcataactgagagcgtgcagttaacgtaattttatctaaagcacgaaagcccttaaccagcactttcagagatgtctggttactagaaaatgccctcccatttgccatctgatctctggtttaacccagccagccgccccgcgccacgtcccgacgccatgtccccagctctgcacctgtatgtcttgcgggcagcagaagggcggccctcctgtgaaacgtcctcaggacgtgagacatggccagcgggcagacgcagctgtgaagctcaggccggttctggaggttcctgtgcagagcttggctctgggtgaccacaggccagggagctgcagtccactccagacacagcctggtcaatcccagaggagggaaggagcccacggtcaggaggaggccgggggtgccgggcgagcacagcagtactcctgtcccctgggacacctctggggtggggctgacatcaggacctcccagcacccctgcaaacagccccggtacgggggcaggcatgtctcttaggggagggcagccctgcctggtcatctccagtgagccggaggggtcagcgggcctggacaagcccctagaacggcacctgcccgcagcacacacgtgtggcatttcttcacgtgggcctgcgcccgcccacagcgcacacgtgtggcatttcttcacgtgggcctgcgcccgcccgcagcgcacacgtgtggcatttcttcacgtgggcctgcgcccgcccgcagcgcacacgtgtggcatttcttcacgtgggcctgcgcccgcccgcagcgcacacgtgtggcatttcttcacgtgggcctgcgcccacccgcagtgcacacatgtggcatttcttcacgtgggcctgtgcccgcccgcagtgcacacgtgtggcatttcttcacgtgggcctgcgcagcatgtgctctgcgtggccacaccatggctgtgtgttgcccatgtgcttgggggaggtgagatggtggtgacccgtcccccatggtaccggcatgagagtggctttgggcctggttccccacaggattgcttctgtgtgctgggctgcagatggccccatacacgtgactttagctctgccttcaagatgagtttgcagcatggcagcccctgggtggcgtctccatccccgacgctgagcagtactcatgctctcagagctcgctgcgcagagaaatagccgtaacagacccggagctcaatattcaggggatcccagagctggctgtgcagagcaatggccataacagacccggagctcaacactcagaggatctgcgaggggacacccgggaggtggctagttgccaggagaggggtgttcctgacataccttcatttgctgccagggagccaacgaggcatcccaaggccgcaggcctcagtggcagagcctgcacttgtccctctgaagctttttcaaacatggtcacaaaagatgttttccccgtggccagagacatggagaagtggggtctggggctctgcatgtgggcggatcacagacaaggccacctggtgtcccggggccatgtgggtgtggcctaccagtgcccagccccgccactggcgcgcagcgagagccgaactccccagcccccatcatccagccccaggggcgtctgtagcccacagcccctgttccgtgatagtgcaaagtaagatttgcagtgctatttcataacttttcagcttaaaatataacctgtaaaaatgaaggaaacttttaaaagctcccagctctctctggggccgccattagaagcccctggggtggcagagggcggcccggcgcagagctgagtgacaggcagtcaagatggaagcgctttgctccctcgtccccgattttaacagcgaacttaatggatttcctgtttctaacgtggatggtggctgtcatttttgaaggatccatctgtgctatatttaatgactctccctaagtaactaaaatagtttccacagagttaatgaggcctcagctggcgttctctcctacagtggccattgcaatgacttgcacctccaaagcgttgtgttaaatcacgtttcttccttggtcagaggcggctcagcccacaacccactggcccctcatccctccctttgccggaggctaccccgtgtccctccctgtgtcctgagggctgcccccaccctgcacaccttctgcaccctccgagcctctgcccctcactggtggccaggcagcgcctgggtgtcacctgccccagctgctgagtctcacctgccccaggcccccaagtctcacctgctccggcccccgcgtcccacgtgctccggcccctgcatctcacctgctccggcccccggtgatggtgctcatctcacccgcctgaggcaccgcagtcgccccaccctgcgtgtctctcgtcccacacggctgctggcctccaggacttccgtccggaaaaccccatctcaggctccaccccagcactctgcctggccagcactgcaccctgtccctaggctggcctgggaccctccatcctctgactggggtcgccaaggctggtggtgcatgagtgtgctgccggctgcccagcccagcccagagcagccgccaggtgcccctccacatgttcccacatgccccaggccgccaggcgcagatctcgcctcttggtggagaatcttctggttcttcagtggcagagggtccctcctcaacctctgattcccataaatagaaaagaaaggtgagcacgcacctctgcctgggttttatttggggagcaggtgcctaggagcttggctgcggagtgagggaccccggccgttgtgaggatgaagagggctctccgcaccaccctgtggtctctgcctgccctctgcccccatcctgtgcctggctcctctggtgtttcagacccatccatacccatgcctcacacctatgcacacagggcctgcccagcctgaatgtccccagagtcatcccttggtcgccccttggctctgcagaggcggatctagggtgagtttttctttagctgtttttaaatcagtggtattaaaacaagtagcccaggaccctgccatctaggaagcgagcacgagatggtgaaaaccctacaagccctcaggcctcgggggatgcccctcctgggccagccgagcaggcagcagcgaggccggagtccttagagacgccgatttagggctgagagctgtgtggccctctgcgtcagtcactacggaacattactgattagcactcggatatttagttcagagaaaccacgtttccatctgattccaaggcagtaaaattttgtcaccaatggtcatgggagagagggagatggtcatgggaagggagggagggagtgtgtcaccagtggtcatgggaagggagggagggagggaatgtgtcaccaatagtcatggggagggagggagagtgtcaccaatggtcgtgggagggagtgtgtcaccaatggtcatgggagggagggagtgtgtcaccaatggtcatgaggagggagggagtgtgtcaccaatggtcatggggagggagggagtgtgtcaccagtggtcatgggaagggagggaaagagggagtgtgtcaccagtggtcatgggaaggagggagggagtgtgtcaccaatggtcatggaagggagggagggagcgtgtctggttttgcacttggagagctggagcgatcacggggctcagggcccacagcggtgtgcgttctctcgtggaccctacgagtgagcatccggtctgtgtcctgcagagcaggaaggtcgggtgtggggagcctccccgggtcttggcctgcccagccttctccccatttgggtcagggctgtcttcacagggtgctggaagggtttgtactgaagcaacctgcagtcccccttcaacgtggagacgtttgctcccctcccaggaggggtcagggactgcccaggttgcagtggtggagatgttatctcccctcctaggaggggtcggggtggcccaggttgcagtggtggggatgtccctgtccccagggctcagcatctcgtagggcctcagaagaccgtgcgtgtagctgcagccgcccaggcctcgcggcccatcaacaatggtgagaactgattccaaagtctagagctctgggaagccactccaagaggcgccatgtggcattcgccattgtctgcagattttctcttccgagtatttcatcttaaatttccattataaaccgaggcgtcagaatccctgtcggggtgtcgggggcctgcaggtctggccctggcctcgccatgtgcctcgggctgccccatggcgaagcctctcttctgtgtgccccacgcctccggtggctgcagacctgacatccagagccttcaaaccctaaactgtctccagcaaggcagttatgaggctgcgtccttgtttctgccttttctgatgccccgagacgcctgtgaatggcacagtacagttacctgcagcgctggctgggcctgcaggccacaggctcctgccttgggcaccagcctggctgtggatctgcatgaatcctgagggggagggcagctgagaagcaccagtgcccagctgtgcctgggtgctggggcacctgcatttcctccgcaccagcatcggggcatccagccggcaatgagccattaacatgggtgcaccgggcgaggcgccagggcaggagttgggtgtcgcaccctgtccagcgggcagggctcaggagcatctccctggaccgtgcacatgcagcttctccgctgattgggccaacgctgtctgtgtcgcaggaaggagagcagcggccgtggaagtgaatgttccccacaagagctactgccccgttacccaggcagaacgcgtcaggctcctcacagggtgtgctcagtctcccggaaggcccagcacagcacgaggtggaaacgacgccggagccgtggagtggagcaggggccctcccggagccgtccccctggctaaagggaagggaggtccctggggaagagcagggcgtgcagatgctggcgcccagcaggcagcgcgtgcagctgcgcaacgggaaaggcactgaggcgggggcgaggacggctcctctccccggcagtggcagcgtgtgctgtggccctgcgtgttgccgcctcgttcgggtgcctggggctcgcttcaggcagcgctggtgtttgctgggtgagagctgtctggagagccctggccctgaccttggcgctgaggccgccctggcagcgtgctgcttattgactttcctggggacgcgttgtccgccacgctgaggcggagaacaatggcagcccttgtgcacgccgcgcagctgctggaattcctcaagacccaagcaaagaaaacagaagcaggtgggcccagggcaacccttttcttcccagggtgtccgcaaggcccagccagccaggcggctctggcttccgtggggaagatggggcccagcgagcctggggcgtgagcgaggtggagggggtcccgctgagagaccagcaggcgtcagcttggcagcctgtgccctccataagccggggcagcataaggactgaccgtctgtccattcagagaccagggtcgcgctgcctccactcacgccgatctgcttattcagtaattggcgcacatcagtgtggacttgcaggcgtttattttgtactttgggttacagtccagtgctgctgtagcagcctcttcacgggcttttgactttaccgtagtatctcaggtagagatgagttgcaccaatggttggaggaagctccccgcgagcctccgtctgcttcccctctgcactctcccgtcctctctgtggcaggtagacactgcccccacaagcctccgtccgcttcccctccgcactctcccatctgctctgtggtgtgtagatgctgcccctgcgagtctctgtctgcatcccctccgcactctcccatccgctctgtggcgcatagacactgtggtggtgtgagtcatgtgatcgttgtcatgctgggcagcgggtggcctctgtcccatccagcatcctcagagcccaggagggagcccggcctgtggggtctctggggccctgggatgtgaccttccattgacagacgcgagctgtgggcagtttccagcagccacattcacggtggcctcacctctgagaatagcactggaatggcgacccgcatccgcattcttatgctgggtttccagtgcgaagaatccgttgggcccccacgtgtcccccgcatccagtggcggagctgctgccttatcctgggactgcgaggggctgaccggtgttggttccgtgtggacccaccatgacctgcctctgcatccttgcctggcttccatgcccatctgggaaggacagggccagagggagacactgcctcacatggaggctgggctgcctccccagtgctgcctccccagtgctgctcccccagtgctgctcccccagtgctgcccccccagtgctgcccccccattgctgcctccccagtgctgcccccccaagtgctgcccccccagtgctgcccccccagtgctgcccccccagtgctgcctcccccaagtgctgcccccccagtgctgcccccccagtgctgcctccccagtgctgcctccccatgctgtttctgggctgggaagaaggtgaaagctgttttcatgcaaacctatgggaggggaaaagcttcccccaaagtctgccggcagcatgtgtgcagggcgcattctcagatgtcaggtccgtgcagcgtcctgcagggtggcaggtggcggacctcagagcggggcctttccctccagggcgaagggtgccgaggtcacaggaagtcccgacctaggccctgggtcccacgccagagctcccactcctgcagacctgaccttgcgtgtcgatgttgagactaatacgtgcgggctggtgtctctcagtagcaagatcagccctgtctcaaggaccgtttccattaaactgagtttctgaaatgatttctttgtgaaatgtgtggcttccattaactcacctttggtatgtctcgttgttttaggatgggagtcccagcttctggagacggggttcctggggatcttcctgtgccctctgtggacgctgtcaaggctgccccagcatacccccacatcccggattgtcctgtggggcttccggtggctgatcttcaggatcatgcttggagcagtaagtggagctcttctgcgtggtgtttggggaataacggtggctcttctaacctgtgaggcttctaggagaggtgaggctgtttccttcctcccccgccgccctctgtcctcctgtcggcctggcctggccagctgcgcactcttctgccccttcaggggcctgtgtttgaatgctggggaccggctggcttttcccgggcatgctcatgatccctgtttctgggacagaaccacacctctgagtctgtttcaggaggagactcagagaggagcactggacgccctgcttcccccaccagccctcctgagcttcccccaccagccctcctttgcttcccggagtgtccgaaatatttcagagctcgtttttaaatgacagagtctcaggccatggtgggcgcgttggcagacatattcaagggtgagggaggtatgagacccgccgtcctgacgctcagggaaagcgcggcctcctcatggtctcttggctgcgtccttcctcccgggtgctttgcctgcttggctttgacgtctctcaggacgaccagactgtccaggttccctgctgagccccggggtgggggtggcgggttccctcctgggccctggtgtgggggcggcgggctgtgcgtgcttcctgcccagccaggggctgctcatctgcgtctgccctgcaaacggtgaatcacatgccaaccccctgttcagcttcagtaatgtgacctctgagttcacaaaaacacgatgtgcactttaaaagcaggagcgacgtggtccttttgacgtctgccacactgaccagagctacgcagctctcacctgctcttccgcttcacgtggtttggtagtaagattttcattttgggctggaatgataaaatcttcatgtttttgtgttggaaaccatgtcgtacagatatgctctctgagcatctgtttgcttaagtgtttcgtggaggattcgctgaagacgtacgaagagttgggcactgccccaaggaacttgtgcctgccccacccgacagcgcgctcacgccagggccacggccagagtgtgccgccgtctcggccactccttcagtccggaacgttcctcttctctccctggcctcgaggcgtggctgccgtgcctgtgttcagcttcaggtcatgccgcaggcaggggcccgagtgctgggcggctcctcccaccctgtccccccggggcagctgcggacacttgggacacccagtcctaagacagcactggccacggactcaggaagcgatgactccacgtggtttggggtatcatgtagcatgaagtgtggctcggtgtagcgtgtagcatggttcagtgtagtgtgtagcgtggcttgctgtagcgtgtagcatggttctgcatagcgtggcttggtatagcgtgtagcgtggctctgtgtagcgtggctcagtatagcgcatagcgtggttctgtgtggcgtggctcgctgtagcgcatagcgtggttctgtgtggcgtggcttggtgtagtgtttagtgtgctttggtgcactgtgaggggctgtctgggcccattcctcaccgtgtgttccctgcatcgtaacgtccatgtctgggcatagctcttctttccatctcgttcagctcggggctctgtccccctgtggctcccatcttccccagcgccctccttttccctccccctcactcacatccctgcgtctcaccttgcgccagcccttagccagtgctgcagaaacgtcagccatgcatggagtgaactggccatttcttgaggtgctccctggtggtatgcgagcacctaattccctttattccttttctgggagggttacatggcctctcatgatgagcacttgccggggttgggaggggtcactgcaggctcagctgcactagcaggagacccacagagagggacctcaacaccagggcccctctcaccccccaggacaaggtgtccagagggttgtcccaggcagggagcctccagctttcctctctgccctctgtggcatgccagcttcaacccaggtgttcctgccccagccgcacgggggtggtgggcacccgtccgcaatgtcactgcatacctgtggatggcgggcaccggggcatccctgacaggttggttttctggggctgtggggagtcttgggtgcttactctaggtcctcactgtttttactgtgtgaaccctgcgggctggctccgcctcccaggagccgctcccgcatgctgcagcctggtgacctctgggctggtgagctcagcctctgtccacgaggccaggtgtctggggagggcactggaagcagctggaggcagcagggcctgacctgccccatcccctcgagggcacgagcaggcccccagggcttgtcaagggccagggccttcccatctctgcctccttgcctggtcgggtgtgctcggggccatggcacagcgggagggaaacatgggtgggtggggtctttggagagctttctggacgtggtgtcgggcagggtcctggctgaggggtgcgtgagtggctgcagacagttggccatggcttgttggaggagggcatagctgcaacccggcatccagatcgcgcaggaaagtgggatgctgtctccgggtttacttttccatttaattagaaatactagagatgtttccatggctccttttaatggaacattgaaattcttcattgtctccagccagaatacagatattctcacaggctgtgggtcctgatctttccagggcttagttttaggttccaccctctgctggcttgaatatgcacagatgtggatgcagcatttccaaggactctgtggacagcagccgggtgggggaagcgctgtcaggccgaagccctgggagagaagcagagctccagggagaggagccggccccgcagaggagccgccaggcggttgtatgcaaagctcctggtgccaagagttgaacagctcccacaatgcctagtggatgcagggactcatctgctcatgggaagcaccttttatggcattttgattgattgctagtgccagctggagaagaaattatcaggtgcactaaaaggtataattacttgatagactcctgtgttgggtgtgattaatgttcctttggtggaaagcagagggtgagttgataagaaagtgacagcagcagagtgtccacctgctgatgaaccaccctgtggacagagccggctaggaaggcacgcacaccccttcccccgctcgcgcacttgggtcacaaccagcgccgcaccgtcagcttggcggattcactcagaaaccagcacctgtggttctgtggcctggagggtttcagatgccctaaccactgggttcctcagagccatctcagggggagccccgtggccctcccgatgagggtgccaagcagaagggaaggagaagccacagcctctgtgcccgccggagctggacgtcagctgcaggcctcaaggccaccacacaaaatcagttgtatttcttttttttttttctttttgagatggagtctcgccttgtcacccaggctggagtgtagtggcacgatctcggctcactgcaagctctgcctcctgggttcacgccattctcctgcctcagcctcccgagtagctgggactacaggaacctgccatcacgcctggctgattttttgtatttttagtagagactaggtttcaccgtgttagccgggatggtctcgacctcctgaccttgtgatccacctgcctcagcctcccaaagtgctgggattacaggcgtgagccaccacacctggcaaatcagttatatttctatatgctgggagaaaatgtcaaaatgaaaatgttaagtatagcatttataataacattcagaaccataaaataggaaattttaacaaaagaaatgcagcctgtatgcctcgaaagatagcacacattgctgaaagtaaggaacacttcagtaaatggagaggtataccatgttcatgaatcagtcttcatattgttaaactgtccatcgtcaccaatttgagctatagattccatgacatcccaagcaatcccagaaggattgttttttccagaaacagataaactgactcttagatgtatatggaaatgccaaggacctacatagccaaaacaattttgaagaagaataaagatgcaggaggagtcacactacttgattccaggatttactgaaaaatgatcgtaatgaagacagtgtgacacaggtgtgtggagggttccctcgagggacagaactaacaggagaaatatatatataaaggggtttattgagtattaactccacgatcacaagtccccacgataggttgcccgcaagctgaggagcaaggagagccggtcccgagtctcagaacggaagaacctggagtcccatgtttgagggcaggaggcgtccagcacagaagaaagatgcgggctgggagggtaggcccgtctcccctcttctcctttttctgcctgctttatattctctggcggctgatgagatggtgcccaccagattaagcttgggtccgccttccccagccccctgacccaaacaggaatctcctctggcaacaccctcacagacacacccaggatcagtactttgcatccttcaacccaatcaagctgacactcagtattaaccatcacaaggcgtgaggacagatagctgcatccgcaaaatagagaaccaagaaatagtcccacaccaaagtcaggatcaaatgattcctggacaagccaccaagtcaattcaactgagagaaagaagcctttgcaccagttggtgctggaagttctggatatgcacctggataagtgaacccccctccgtcaccacacacaaacgttaatttgagatggattgcaaacataaaagctaaaaccattaacacttcttgaaggtaacatagaatattttgtaatgttatgataggcaaaagtctcttaggacacacaaaaaaattaaccataaaagaagaaaatggctgggtgcagtggctcacacctttaacaccagcatgttaggaggctgaggcaggagcgtcccttgagctcaggagttcaagcccagactgggcaacatagtgagaccctgaaagaaaaagaaacaaacacatacattggacttcctcaaaattaaagtcttctgttcttcaaaagacaccaccgagaaaatgacaaggcacagatcaggagaaaatattcacaatgccattatgcctgacaaggaacctgtatctggaatacataaagaattcataaagttcaataataaagataatttgattttttaaagagggaaaggattttagcaggcacttcacaaaaggaaacatgcaaatggctctcacggcacttgaaaaatccctcagatgcactggctattagggaaatgctgagcgtatctacattgagacaattcctccccccaagaacagctgaaattaaactgagatacttcctcctcacaagaacggcagtgcagaagtcaccaccacacagcagagacgggcgtcctgtgggcagtgcagagttcaccaccacgcagcagagacgggcgtcctgtgggcagtgcagaggtcaccaccacgcagcagagacaggcgtccccacgggcagtgcagaggtcaccaccatgcagcagagacaggcatcctgtgggcggtgcagaggtcaccaccacgcagcagagacaggtgtcctgtgggcggtgcagaggtcaccaccacgcagcagagacaggcgtcctgtgggcagtgcagaggtcaccaccacgcagcagagacaggcgtcctcacaggcagtgcagaggtcaccaccacgcagcagagacaggcgtccccacgggcagtgcagaggtcaccaccacacagcagagacaggcgtcctgtgggcggtgcagaggtcaccaccacgcagcagagacaggcgtcctgtgggcgatgcagaggtcaccccacgcagcagagacaggcgtcctgtgggcgatgcagaggtcaccaccacgcagcagagacggccgtccccacaggcagtgcagaggtcaccaccacgcagcagagacaggcgtccccacgggcagtgcagaggtcaccaccacacagcagagacaggcgtcctgtgggcggtgcagaggtcaccaccacgcagcagagacaggcgtcctgtgggcgatgcagaggtcaccccacgcagcagagacaggcgtcctgtgggcgatgcagaggtcaccaccacacagcagagacgggcgtccccacaggcagtgcagaggtcaccaccacgcagcagagacaggcgtccccacgggcagtgcaaaggtcaccaccacacagcagagataggcgtcctgtgggcgatgcagaggtcaccaccacgcagcagagacaggcgtcctgtgggcggtgcagaggtcaccaccacgcagcagagacgggcgtccccacaggcagtgcagaggtcaccaccacgcagcagagacaggcgtcctgtgggcgatgcagaggtcaccccacgcagcagagacaggcgtcctgtgggcgatgcagaggtcaccaccacgcagcagagacaggcgtccccacaggcagtgcagaggtcaccaccacacatcagagacaggcgtcctgtgggcgatgcagaggtcaccacgacgcagcagagacaggcgtcctgtgggcgatgcagaggtcaccaccacgcagcagagacaggcgtcctgtgggcgatgcagaggtcaccaccacgcagcagagacaggcgtccccacaggcagtgcagaggtcaccaccacacagcagagacaggcgtccccacaggcagtgcagaggtcaccaccacgcagcagagacaggcgtccccacgggcagtgcaaaggtcaccaccacacagcagagacaggcgtcctgtgggcagtgcagaggtcaccaccacacagcagagacaggcgtcctgtgggcagtgcagaggtcaccaccacgcagcagagacaggcgtcctgtgggcgatgcagaggtcaccccacgcagcagagacaggcgtcctgtgggcgatgcagaggtcaccaccacacagcagagacgggcgtccccacaggcagtgcagaggtcaccaccacgcagcagagacaggcgtccccacgggcagtgcaaaggtcaccaccacacagcagagataggcgtcctgtgggcgatgcagaggtcaccaccacgcagcagagacaggcgtcctgtgggcgatgcagaggtcaccaccacgcagcagagacaggcgtcctgtgggcgatgcagaggtcaccaccacgcagcagagacgggcgtccccacaggcagtgcagaggtcaccaccacacagcagagacaggcgtccccacgggcagtgcagaggtcaccaccacgcagcagagacaggcgtccccacgggcagtgcagaggtcaccaccacacagcagagacaggcgtcctgtgggcagtgcagaggtcaccaccacgcagcagagacaggcgtcctgtgggcagtgcagaggtcaccaccacgcagcagagacgggcgtccccacaggcagtgcagaggtcaccaccacacagcagagacaggagtcctgtgggcagtgcagaggtcaccaccacgcagcagagacaggcgtcctgtgggcagtgcagaggtcaccaccacgcagcagagacaggcgtcctgtgggcagtgcagaggtcaccaccacgcagcagagacgggcgtccccacaggcagtgcagaggtcaccaccacacagcagagacaggagtcctgtgggcagtgcagaggtcaccaccacgcagcagagacgggcgtccccacaggcagtgcagaggtcaccaccacacagcagagacaggcgtccccacaggcagtgcagaggtcaccaccacgcagcagagacaggcgtccccacgggcagtgcagaggtcaccaccacacagcagagacaggcatcctgtgggcagtgcagaggtcaccaccacgcagcagagacaggcgtcctgtgggcagtgcagaggtcaccaccacgcagcagagacgggcgtccccacaggcagtgcagaggtcaccaccacacagcagagacaggagtcctgtgggcagtgcagaggtcaccaccacgcagcagagacaggcgtcctgtgggcagtgcagaggtcaccaccacgcagcagagacgggcgtccccacaggcagtgcagaggtcaccccacacagcagagacaggcgtcctgtgggcgatgcagaggtcaccaccacgcagcagagacgggcgtccccacaggcagtgcagaggtcaccacactgagccagactgtcctcggccttccctgggttgagcaccggatgaaaaccatgtgctttgagccctggaaagacaatcagcccagccagagccagagcctgaaacaggcagcccccagggcgcagctgcaggaagccgcatcctctcgtgggctccagcaaggcgggggacgctgtgttccctcagtggcttcttggtgccccttgatgtccaggagtgtgaggtgaggtgagggctctgagctgggaagctgacaagtcagggagaatgccaggccagacgcatcggcctgcgggggctggagcagagcctggcactcactgtacttgctccgtctcactccggctgctgcgctggcccagggctgtccaccccaggcgtgtggcagagcaagcctggctcccagagctcccctcaggccctggagcggcaggcagtgggcatcctcagcccaacccatgtccgtgccatgcacaggatagctgagcttgccgctgccacagggtgtcagcgggttggggcaacagacagggccccagtgctggtggccaggctggctgtatgtgtgggttggctgccacctgactgcactgaaacaagaaccacccccaccccaccccccactgctctccacccggttcggggccggccctggctgggcttcgtggatcctcaggttgtgcgggtcatggcttcctggggctgggccagagccatcatggagtcagcacggttccttgcagacacaggcggggcaggcggcgcctctccaccttccttgcctcaagctgcggggacagcaccaaaaagccacgtggacccagatggcctcgccggacttcctgactcagggctgtctccagcctacatcccaccggggctgcacgcacagacggcttctcctggagccctggagcatttcccccgtgtttcggccaggttttctgctttaaatgagtttatttcagtcgtgtcaaagtgaaggtctctttcactcaggacgtgatcaatggcgtggccatcaagtcacagcgttgaaggcaacagatggcctttaatgacgctattttaaaaaataatttcccctttctttccccatcctggttttgtgaggacagagcatcggcatctcagggcgggggtgggtctgcctactctgtggccagcacgcagcagatccctgtaggtggagccccacagctctgtgtcccggcacctctgtgccacctgcacaggggcagagggtgggttttccgtgacgccccctggagccaaaccaccgttgatcacttcctcctgatgaactgggctgtgttggggtgcagaggtctcggttgcgtatgttctgggaattgagccagggtccttgttgctgggaattctcagacctggacaatatcagtagaggagaccacttgatttttagtttgacccctggagaattgaaaagctggaaatctgttttctgtaccttccccctcccaaccctcccccgactccctacctggcttctgtctggagaggacgtctgcatggctgtcctggggtggctgcaggtgtgcagatgctcaccgccactgtctccccattcctgctggagcccactttggtgtgagtgtttgcctggcagaggcatcgcaggcccacgggaggataaagagaagccagagaactcataattccaaaagctggcaaagttaaaacgtgatgtctggccgggtgcagtggctcacacctgtaatcccagcactttgggaggctgagatgggcagatcacctgaggtcaggagttcgagaccagcctggccaacatggtgaaatcccgtctgtactaaaacacacacacacacacacacacacacacacacacacacacacacacacacataaaaattagcaggtatgctggcgggcgcctgtaattccagttattcaggaggctgaggcaggagaattgcttgaacctgggaggcggaggttgcagtgagccaagatcgtgccattgcactccagcctgggcaacagagtgagactccagctcaaaaaaataaaagaaaagaaaaaagaaaagaaaataataaaataaataaaataagatgtccaaactcacacctgtgcagcttacggctctgcgaggctcacacctgtgtggctcatggctctggagggctcacacctggctacagcacccagaggtagggccttctgatgctccttgtgtgcaaactgtcttggtcctcattaacacaagaagaaaaagcaacggctgaaatgtggaatacgtaagcccacagtgtgaaccattttggggtcagaatcgagcaaaggccaggaagccatagccaggctgtgtgattgcaggcaccgtggaaactccagtaactaagatggcaccatgaagagctgcctgggatgttacagaagccttaggccagtcagtgtgacaacttagatgagatggacaaaacccttgaagaagggtgcgggggagtgccgggtgcagtgacttctttactcaaggaaagccaggatttgggacgcgtgtcggagctgagccccacatctctctttacacccagacctgctcaccttttgtgggattcaggcccgagtgtgcggcatcgtgcagtggagcctccgaccctcacgggcacggcacatccggcgtccagggcgtgtgcctcccacgtgtgtgctgccaccccaagcctcgtggggtcggaaggaaggtgccaggggctcaacaggtttgcgccttcgtcatctgctcttttcccacaggcccaggactgtctgcaaagcgctttacgccgagcatgcttcacccccgagcctgccagagggtccgcagcccatgggaggtgtgggtcatgggcggcgctgaaaggcagacgtggagcggtgctgccgacatcaagacctgactttgaagtccacaggctgctgcttggcatcagagccactgatgaaatcacattaaacgtaatggaattggtatcggcatgcagccctgtgaggccaggatcaggcagatgtgctgccgtttccctgacaggcccgccctggtcctgggcagccacactccagaacgagagtaattatcctaattgctttattgcatcagtgtgggggcagctcgggtagctcagaggaaaaggggcttctttcagggcccatcggcttcagggcgacatgctccacccggaaggggcagacctctgactccggcacggaggcgtcgtgggaatttttagaaaatgatatctatggcatcctgatctctggcccccagctgcagccccctgtgaggccgaggcccagaccggagtccctgaaagcgctttgtgcctccgacctccggcgtttttggcagagctggggcaggagccggggtgctcctcgcggctgaagcgcatcagcctccagggcgagggtgtctcagatccccgcacagcccgtcacacagcccctgggacaatcacacaggacagtgctctcctgtgatcttcaaaggatctcctgggttgtgggggtgcaaaataaaactctgctacaaagagcattagtaattcctcttcccaaccgcacagttcagctcaagcgatctcccggtaacagaaccagcccctgtgcttaccgtgaacacgcctttctgggttcacgccgaaggtttctattgaagtgcacgtcgtttgccaaaaaataaaaataaaaatacagtaagtccaaaatctgctctgtctgatttctaagttaaaaccgtgatcacagcaagaggaatttacatggtatggtgactagggcagcaacttctggaaggcaaaccaatcccgtcagagagataggcggctgagagtctacagcagacctgtgcttcggagatgaactgccctcctcttaattcccctcgcccgactaagctgccaaggcctggtgattcttggggtcttcatggtgtctggtgacctgacagcatgtgccccaaatcctggcccctacacggcctggctgccaccccttggctctgcccccacctgggctgctccaggccccagcagccaaggcctcaaggacacccagagccgggggaaggagcagttcaggtgttttcagacagacaagcctctgagaacaggccttagatcccggaagcccaggctctcccggctggcattggtcagaaagtcagtgcccctgcccgcagcgtgggtcccctaggctctgcggcggcccgactgtcagcttgggacagccttttccaggtgcttggggaggaaacagctgccctcaaactcatgggaattcacttccaggcagcaagcgagcccagggcgtttgtccaggtccaggtcccttggtctgcaagttagagcccagccagtgtcgatgagccagtcagctgcgtgtctgagggaagagctttgtcctcaatgtgaagccacgggggacctgggtccccttcatcaggagccatggagaccctggcccacctcactttgatgctcagcccactgttctgaggcatgaagtggcccagaggcgaggcccctcctccagaggacgcccgccacgcagaaggcgcccaccacgcagaggatgcctgccatgtacacagctcctggtgcagctgtgccacaaggaagtctgcgtgagctgaagcactcgggggcggagcccacctcccatgccagttctctcttgcatgagggcaagaaagtgcggaaaccatcccaggaagacaggaaagccacggagccaggcgggaccccaggcaccacccctgctgcagctgggccaccctcagatatggagactagagggtcttgatagaccccatagtgcctctgcccacggagcccaccagcggtcccttcaccctgagacacggtttccacccacccccagctctcagagcactcggggagaagcagtggctgttgcaacaagtctgagacccctgcagctgctcacaggggcactgggctgtgacctgactccaggacaaagctctcccctttgagtctctcctgcggaggcaggacctgtcgcgagtaattccctgtgtttacaggtggggaggaagggccactgatacaggcgaggggaccctaacgccagaaggatggaggaggttgtggctcggagggaggcctggcggcgccccctcctcaaacaccacgttagccggtgctttcggggactgtaggggctgggggtctgtcctgagccactgtgcaagggtacacagggggctgtcgctgcagggtggatggcggcctctgggggccaagtgagagaagcggggtctccacagagtgtctccttctccgcatacgaccgtcaagacacttcgagtttccagatggcagatttggggaagtgtgtcccaggacacacaggcatcaggagaagagctgctgcagccacacgttgcaaggcgggaacatcgtcgatgggcctggaaagttctggcattccgagcagagcgggagggtggcacgggcagtgtgggtccccggctccctttgggtctggtgcgtttattggcctgtctgtgccatttttttttttagaattaattttgggctgaaaagcctcaaagaaggctttgttcctttgacacttgctctgggagaaaaaaaaatccgtggaaaatctgacatgtgcaatgtagagagaaatcaatagatgggaggaatataattatcctccactcctgaaagaatttttcagatttttaagtgtctcatatcagcttagaatttgaatgacattttaattattttgtttttttcttcttttcctggtttgaatctccatagagttccactctcggattctgcagggagcagagctggtgctcatgcggggggagcagtggcggtggttgtgcccctgcccggtggagccgtgcatttcatcagaagcagcagctcccctgggtgtgggcagcgccttgaggagtggggccttctccgcccggtcagctggacaccctcggctgttttcatgcctgtttgcagaacaggagcccaagcgggaaacagtctccggtgcttttgtgatctgagcaaacccagcctccagaagacctgactctcagtttttaaaacagttcacccttcaggtctttaaacagtaacactcccgggtgttcggcgccctccctgtcgttgggggcacagggcatgtgagggcagggacgtacagcaagaccctagagacggcgatgccggacccagacatggccccgccagaggcagccttcacagtgcgcggggtggctgagcctcacaacccctccgaggcgtgtgtgtggaccgtgcagcctgcgtgtgggtggctgagcctcacaacccctccaaggcgtgtctgtggaccgtgcagcctgcgtgtgggtggctgagcctcacaacccctccgaggcgtgtgtgtggaccgtgcagcctgcgtgtgggtggctgagcctcacaacccctccgaggcgtgtgtgtggaccgtgcagcctgcgtgtgggtggctgagcctcacaacccctccgaggcgtgtctgtggaccgtgcagcctgcgtgtgggtggctgagcctcacaacccctccgaggcgtgtctgtggaccgtgcagcctgcgtgtgggtggctgagcctcacaacccctccgaggcgtgtctgtggaccgtgcagcctgcgtgtgggtggctgagcctcacaacccctccgaggcgtgtgtgtggaccgtgcagcctgcatgtgggtggtgtcccgtctggctcacgtgacgtgaggaacagggtgcctgttgcttggtgttcctgtagggccgggctgggctcttggtcccactcccctgccgtttctcattcgtgtccctctcggcatcggtcacttgagccacgtgccgtccttcagggcgcggtgcagcctctcctggctctcccactcccccgccagtctcgcgagccccatgttccaaacacgttggaattggacacgcccctcccctgcccaggtcgtcctgcacagacagcagcagagcctgctgccttctcggtcacatgtagccagagaacccggcggctcccgtcctgcctggccccggctaggggcccacggccgccccgaaggccctcccgtgtgtggttggttttctgttggcctggctggcctggggtccctggtccatcaccaaacactggcctccgtgctactgggaggtattaatgtttcgcagacgtggctacagcccgtgatgggctgacctggggaggaggattctactgggagcccgaggctgacccgaccaggcaggagaccgaggctggagctggggctccctggagaggaggaaattccatcccaacagcagctccggcccctgctctggaggtcctgatggccccggcaggcctcaggccgcaccccccgccgtctggaggccagtctcccgcagtgggaccgcgactggcgccgtggcagatgggaccctgcgttccaggggctcctgggcctccccccgcggcctcctcagccctgctgtaccccacgcttctgcctgaggggggcgccctcaccctgtcttcctccctcgtggccatccccaccccgccccggggctccctgcccaggacagccctgtcagctctgtccgggccgaggctggcctccgctgtgaacagatcgtgttccccgaattccatttcgtgtggaaaccctgagcccagtgtcatggtaccaggagccaggcccgacaccccagcacgcccacggaggggagcactcgctgatgggaggcggccattacgaaagtgtccccagagagaccctcaccctcttcccaccgtgtgggcaacagtgagacagcgctacctgcagcccagtgcggctgccccagagcccaccatgctacacccaccacagccatcgcctccgaacctgcagcatggattcctgtcctttatgtgccactgcgtctgccacgactggtggccgtccttcctctctgcgccttgtcgcacctgcgcctgcagcatgcggcctctatggggtggagcagggcccggcacctcaagggcactcagtacttatgtgccaggtagaagtcgggtggacagggggatgggtgggcggacggccaggtggacaggggatgagtcgacggacggtccagtggacaggggacaggtgggcggatggccaggtggacggggggacaggtgggcggacggtccggtggacagggggacgggtgggtggacgatccggtggacaggggatgggtgggcgcactgccaggtggacagggggacaggtgggcggacggtccagtggacagggggacgggtgggcggacagtccagtggacagggggacgggtgggcggacagtccagtggacagggggacgggtgggcggacggtccggtggacaggggacgggtgggcagacggtccggtggacaggggcatgggtgggcggacggcccggtggacagggggacgggtgggcggatggtctggtggacaggggacgagtgggcagacggcccggtggacagggggacgggtgggtggacagtggggtggacaggtggatggagcccaggggatttggccgggagtggttgtgcagcagaaacccctgtcatggaggaggcgggactcacttccacatctgtgcagtttcacctcccatgcaccagtgtgtgagagacgctggatgtgaatctgtgtctcagcggtgattttagggttagcgggaagaggggacagtttgtttctgacttgtgaaggaatcatctgaagccgggagtgacccagggaaagcagacgggtgtgggagccgacccttccccagatgcttcactgtggccctggcactgcagaaccaacccccagccccgcagcctctctgcccaagtcccaccttccccagtgctggcggctccctctgcaggcccctggaagcctgtcccgtgccccaggagtcctcacagcaggcgagctgcagtgtgtgggagacacacggggcctgcgcctcggctccctttgtgccgcagggggcggggctgagacgcgtgtgcactgggtgctccctccgactttgggctcatcctggaggcactgagaagcttccctctgacactgtccgtggggtctgtgcagggcgtggtgcatttgtcctctttaaagacacgcaacttctgtagcgtgatgatgcgtggagctctgagaatgagtgttggggaaggcgcaaaggaagccactgttgctcacgcccgcggtgtgcactaaactcctgtcctcaaagcagccctgaatctgcccttctcaaattctgccttcctgagtgtttcatacgtaaggtcccctccctcacagcgcctgcagcccagatccacggccttcgtggatggttcgtcttcctgggaagctgtttctgtcggggccgccgcatccccagcccctgtgactgactctccctctgctctcttccttgcagggcctgatcaagatccggggggaccggtgctggcgagacctcacctgcatggacttccactatgaggtgagcgtgccgtgcagcgtgagggcagggcacccggtctcacgccgccccgttcccactcttggcggggctcagtcctgcacaccctggtgagctgtcgcatcacagggtcacccccattgattcaggacgtcctctccctcccttcacggggtgggtggtcacacgggggcttgctggggctgcggggacggggtctgtggccctccatggtctcgagtgcagctggtttgctctggttcctgcacgggcaccctccgctgctgtccttggtcctgcccaggcctccgggccggcccctccttcctggagtccacagctccccaccgtcccctgacaggtgcctgttgggggcttcctggctgcgtgcccagcccctgccacacggaactgtggctccatcgttacctggacacgggcaggtgtgtcccacagggcaggtgtgaaccacagcacagttccactgtgcttggcccccagaccaaggctgagtcccttcagacgccccagttcctgccaactgctcacgtgttcacatgggggctgggagtggtctggggcctggagctcacgtgttcacgtgggggctgggggtggtctggggcctggagcttggatagtcatttgttctcagtccatgtgggagcctcctggtagcaccatccccaccctgggcccgtgtggtcatggccacggtgcacctagagcatctcaggcctggacaccccttcctgcatttggcccgtcactcgcacctgcacgcggaagccatcatcgtctgcctgctgccgacagccagtgatggctgtctcactgcctttgcgttttctgccagggttgctctggcactcaccgcctccaagcgtggagctggcaccgtcctcacgcggtgcctctgctgcgattccgggtcttggtccacgtgccggcctggcacaggcgtttgtgcctgcatttagtggctgtgtcctgactttattcttcaggctcttgagatgtctccatagcccatcaagtgccccgccttgctgaggacccgtgagctcctctctttgtccgagagcaggttcagctgacggtctgtgaaataccagaaagtaaacactctcagctctttggctggatggtcccaacacagccgtgacggggagcagccgcagggcacacgtgtgtgagaggctttcgccaacaaagctgtgcacaccgcagcccacgccagccaccctgccctcaataaggtccagcgccctcagcccaggtcaggaaagctgaggggaccagtgtctccagatgccctcaggacaggtcagaaaagtgggcaggggggcctgtgtctcccccatcaccctcaggacgggtcaggaaagtggtgggggggtcccgtgtctccagatgctctcaggacaggtcaggaaagctgggtggaccccttgtctccaggccagaagctccatagcgcatctcactgagccccctggcccagcaccggtggcgacagcagtggtgcagtgggctcaggtccacgaaggctgcgtgctggtgaggaccgtcccgcacagctttccattggcaagagatgctgaggcgcccaccatgtccccacaaacaaacactctgatgccttctctatggagtggctgcatttcaaagccggcatcaggcgtcctgggctgcatcccttcagtgaatgtggctgctctgggcccaggagtgtctcaggatccccaggactcacctggccaggaccaccagggtgtggtgtttctgggggacgggtcatgccacagctgcactccggcgaggacgcaggttgcaactcttggggaggcgggccgggggggcccacagctgcctgtcagcactgccttcccctgtgtccacgtggccagctgggatgcagtgggtccctcccgcccccatgagcacccagttcttcctgtgccttaaaggcccaggactgcccctcaccagagctctctgctgtgctgtttgtgaggagtgctctgtgtcagccgtcaacaccagttcagacatggcccgagacggtggacagggtgggcccggcctggagcacacaggcaggggcagcccgggccagagggatggccctggatgtctcgaggcaccctcggtgtcactgccaccggagggttggccgcagcagtgtcagggcctgcaggcagggcccaaacccactctccctggagcttggagcgtggctttatctgggacctccttgtgattagttaagatgaagtcagagtggactgctgagccccaaatccaacgactgtgtccttaaaagaggcccagacacatgggggggtcctgtgcccacatggctgagcttctggaaggtggagcctcctgggaggttggattgtggctgaggccactcccatctccagacactgaggctggagtgcagggtgtgtgaggtcagggcccttatcatccacatcccaggacaggctgagccttggctcacagagagccatgagcctgatgtcctgatggtcacacggggtccagggccaagccaggcagcgtgaggctctggcagcagctgctgtctcggggggccgggccggctccttccagctgtggaggctgtccttggggaatcgcatttcaaaacccactgtgacttgaaaaggcatgagggagccccgctgagttgggacggggcccaggagccccttttcttgcttcccgggggccccttggggctccaggagcgagtacctggagtagcgagcgttcagagcagtgcggcgccgtgcctgcagcaggtggaccgccgtgacacggctctttgcggttcactgtgtctcctggggcaggaatggcccatataccggcctcaggggcctggactccactcgacagacggagcagtggccatgcccagtccaaggccagaagcactggggggtcctaggtacagggggcagtgtgtggggagagcgaggacaccacatctggggtggggttttagggacagctacatggggaccccgggagagggatgcacaggtgggcagcagggccagccagtgtcaggcagcagccatgaggcagaggggtcctcagctgggacaggagctgcatcccccctctcacctcagacttgtgtctcggacgaggatgctccctcccgtgtgtcttgatgacgaggcactggtgaaggtttcaggaagtcagggtgtcaactgcgagcccagggccctgcgtgaatcctctctccaaggaggacctgattccggaaggtggcaggcccctgcctgcaacccccgagccgtgccctctgccccacagcattgtgggcggggatctcaggcccttttgctgtctttccgattcttgctggtcagataaggagtcagaggggggtgcccctttcttggaaagttgcccctatgctgtaggggacgctgagcctcttcaggagcctgaaaacctccggaagtttcagcagcacagagcaagaggcagccatgcaccccggggatgcctccctcgggactcctccctccgggcttgggagctctgagtgtgcagacttctctccccagaaggaactgctccaccatggccatccacagcctcacacccacggccatccgcagcctcacacccatggccatccgcagcctcacaccccacactcaccgcttttttcatctgctggtaacgaaaggcagttgccggcaaattcagtcggttaagccagaagcagcagggaaggcatccccaagttccaagagaaggggccagccccctggagggtgaaaggcgaccgggtggctctgcctgaaactcctgacaacaagcctgtggctttcctcacgtcgtgttcccagatctctgtggactccaccagggtgccctgcagctaactcagttctgacgacctctacccagggtgagtgcagaccccgcaggccaagggcccgctcccatgagacaccggggatgcatggacggccgcttgctctcagccggcagagggaccagagccatgtcctcagcaccgttgtgaggacccccaggatcccagggccagcgcagcacaggagaggggggatgcagctcctgtcccagctgaggacgcctctgcctcatggctgctgcctgacactggctggccctgctgcccacctgtgcatccctctcccggggtccccatgtagctgtccctaaaaccccaccccagatgtggtgtcctcgctctccccacacactgccccctgtacctaggaccccccccagtgcttctggccttggactgggcatggccactgctccgtctgtcgaccagggacgggcgccgtccagaatgcagcaggctgtggggagggttgctgcggtccccacatcggagcggttgcctgacgacgcggatgcaacagcaggttgtgaatgtgggggtcacgcagctgcttttagcagcagggatggcactagctgctgaaatggaaaatccgggcctgtcctctctctccacttgggttttaggaagtcagctgtcatcaagaaggatggagtgaggactcccacagatggttttgatgcagagaaaactcactggatctggagtacagggaccctgaacgttgcaaacaattctccattgctttttaggggagttgaacataactctgttgctagaaagctgcgggaaatccaacactctgattcagtcccacggcgctccttccacacccctttcggagccacttcccagacgcggcacagggcagcccctgccagggcctgggcgggcagggacccacggccacttcccttgctgcctgcaggagtaccccactgagctccaccccctgcaccccaaggcttgggccgaggccgggcctgtctgtgagcttgggccgacgtcgtggagaactacaattccgtccgccgaaggatgctgtcagggctacagacaggccccgtgacgggcacggagccccccagagtcgactcaccgctggggcccaggccacgcaccacagaccctcagggagctgcctgaccagggcgggggtcccctggatctgcctggggccacctacgctcctggagcaagggtgtcccagcctgtggccggcagcctgcaacttgggggtgcgtctctgggctcccacacctgcagggggagttttaggccactgcttaagtagagtgatccggaagcactgcccctgcctgaggtcactgtctgcaccctgactccgggcccaggccacggccatgccttccagggtacctgcgaccaccctgctcaccctgaggtgctctcggaggctagaggccattcatgctaggagcgcgcactctgcgtggggcggaccacacagagcagccctctctgggctgggctcccagagttctgcggggcctccaggcgtgggtgggagtggctgagggggtgcagagctgctgtggacgccccccagggacatggccctgctgcctagagcagccttgctgacagaagcctcggctcacgcccccgtgcccgccgagctcccccacgggtaccgagaccgcgtgtgccccaacactcccagcaggagctgcaggaatccgtgttgaagtgctcagcctggcccggccagcttccacgcagtgtatcttgtggctggtgcatccccgtgtcaggcaggcgcccctttccagcctgcccccgcaaggctcacacagagcacagcggctggggctgctcctggctgactcccaacagggaagctcaacacaaccttctatcctcctggtgtcccaggacccacccagcaaggatttgggccaggagatcctgtaatgcctttaactgcgaccaggagccgtgggctgccagcccgctcagactgtgggtcaccaagcgccctcagatatgggggcccgctaatgtggaaataatatatatccaggttggcgtcgcccgtgaagactgtaaatgtcaccattaggggaaccacgcctgaatcccatccggcggctgggagccgaggcttctcgccttgtctcctggctgttttattggtttttgtaagaagagaatgttttctctgtgtgctgggggctgggaaggaagggcagtgccgggcctggggaatgccgggggcctagggtgggaggggcctggggaacgccgggggcctagggtgggaggggcctggggaacgccgggggcctagggtgggaggggcctggggaacgccgggggcctagggtgggaggggcctggggaacgccgggggcctagggtgggaggggcctggggaacgccgggggcctagggtgggaggggcctggggaacgccgggggcctagggtgggaggggcctggggaacgccgggggcctagggtgggaggggcctggggaacgccgggggcctagggtgggaggggcctggggaacgccgggggcctagggtgggaggggcctggggaatgtcgggggtctcgggtgggaggggcttggcctggcaggtggcccgctgcagggtggttttggccgggcgcggttcaaagccccaggcccgtgccctggcatcactcagcagagcagcccactgggcgagtgcaggcctgaggagacaccgaccttccgtgggcctggatttcccgcttgtcctggggtcctcttgccagggacaagccgtggctgggggagacaggggtggcgcctcaaggtcagcagtgctcacggctgttctacccacgcagccaaggacagcagcgcctgcatctgagccctgttgttatgcagccctgtgctgcccatcctccatgcgccccttactggcttgtgtgatcctgagcaagttctgtctttccagctttaaactgatcacccactaccctacggcggttgtgagaatcaaatgtcgtaacatgcactggaatgaaagttccttaaaggctccaaagagacggggattttccagatatctttctgttactggtttctaatttaattcctttattgtcagaatatacttgatatgccttgagtcttttaaaatttagtcagatttgttctgtagcccagaatatggtttgtcttagtgaaagttccgtttgagccaaaaatgaacagacagtgttctgtcaggattcattagatcaaattggccaatagtgtttttcaactcttctgtacgtcctcattttctgcctgttttatcaattattgagataagggagattgagatctccaactataattatggatttctctatgtctgcttacatttctatccgtttttgcttcatgtcttttgaagctctattatcaggcacatacgtgtttgagagtcttctgacctcctgatgaacattgtgaaatggcctcctgactgctgatcatattctctgctctgaattgtgctttgtctggtgtgacggtggccagtccagccttctcgtcgctcgtgtttgtatggtatgtttttccgtcctttacctttccgcctgtgtgtgtctttgtgtttgaagcggatctcttagagctggcgtatgcttgggtcttatgtttaaatccagtctgacaagtcctgccctttatctgggtgtctgggccgtttgcatccaatgcagtctttcctggggaaggtttcagcctgttgtcttgcgatttgttttctgatcctcccatgtgttctctgttcctttttgttgctgttattttacaccttcctctggattaattgaatatttttgtgactcctttttattttctttcttggctgtaacttttttgtcttatttgtgtggtggttttagggtttatagtatatgcctttaatccatcacagctcaccttcaaggtatactatgcctatctcataaatgctgaaagaattttacaacaatattctcccaacagtattttcctctcctggccttttgctattattgccaaacagtttgattaaacagtccagttatctttcagagacatttcattcaattggaagaacagcctcattgtgtatccatatacttaccatttccggagctcttttttccatctgtgatcattctccctccacctaacatcaccatttccagagctcttcactcctgcgtggagatccaggcttccatccgtgatcattctccctctacctaatatcaccatttccagagctcttcactcctacgtggagatccaggcttccatccgtgatcattctccctccacctaacatcaccatttccagagctcttcactcctgcgtggagaccgaggtttccatccgtgatcattctccctccacctaacatcaccatttccagagctcttcactcctgcgtggagatctaggcttccatccgtgatcattctccctccacctaacatcaccacttccagagctcttcactcctgcgtggagatccaggtttccatctgtgatcattctccctccacctaacagacttgacatttcttctagcataggtttgctggtgacaagttctttcagcttgtcaatgtctgacaaagtctttatttcaccttcatttttgaaagagattgttgttgggtatagaattctaggttgacaggtttagtactttaaagattgtactctactctcgtctcatttgcattatttcctgtgacaactccttatgtacatactctgtaacatctttatttgcatgtaagatttttatcacgagttttaagcaatattcgattatgatgtgtagtttgtagtactattctaagagatccgcttcaaatacaaagacacacaggctgaaaggtaaaggatggaaaaacataccaaaaacgtgaatgagtgacaagaaggctggactggccaccttcacaccagacaaagcagaattcagagcaaagaatatgatcaggagtaaagaggccatttcacagtgtttatcaggaggtcagaagactctcaaacacgtatgcgcctgataatagagcttcaaaagacatgaagcaaaaatggatagaactgtaagcagacatagacaaatccataaagttggagatttcaataatagataaagcaggtagatagaaaataaggaaggatgtaaaagagctgaaaaacactactaaccaacatgatctaattaacatttataggcagtttgtgacaatttgattatttgtcaatcaaactacaatcaaagtgatcaatagtgtcatattgtcatgcagtaaaatgtgaccatttggttatctggtgttgttttcctcatattttttgtgcttggagttcgctgagttgcttgaatctataggtttatcattgtcattacattcggaaaatatttggccaatatttcttcaaatattgtttctgtacctctccaggatgtgaggaggcttacacgggtacgagtgctgagccctgtctggggtggagggtgtgtgagtcagtactaagtatctgttacccaaagactcagaaagacttttactttggtttctctaaaatggggttttcccagtaacatcagagttcaacactgtttggcttctggattcaggctgtttcagagatctgctattgcccaacacaccccaagcctcagtggcttagagcagcagcatctttctcctggtcctgtgacaggttctgctgggcagctcctctttctcctggtcctgtgatgggcttcgctgggcggcttctctttctcctggtcctgtgataggctctgccgggcagctcttctgctgagcagctcctatttctcctggtcctgtgataggctctgctgagcagctcctctttctcctggtcctgtgatgggctctgctgagcagctcctctttctcctggtcctgtgatgggctctgctgagcagctcctctttctcctggtcctgcaatgggctccgctgggtggctcctctttctcctggtcctgcaatgggctccgctgggtggctcctctttctcctggtcctgcgatgggctccgctgggtggcttctctttctcctggtcctgtgataggctctgccgggcagctcttctgctgagcagctcctctttctcctggtcctgtgatgggctctgctgagcagctcctctttctcctggtcctgcgatgggctccgctgggtggctcctctttctcctggtcctgcgatgggctccgctgggcggcttctctttctcctggtcctgtgataggctctgccgccggctcctccttctcctggtcctgcgatgggccccgctgggcagctcctctttctcctggtcctgcgatgggctctgctgccggctcctctttctcctggtcctgcgatgggccctgcttgctggcttctctttctcctggtcctgtgatggcctctgctgggcagctcttctcctgagcagtagcaactttctcctggtcctgttatgggctcccctgggtggctcttctgctgcacgtggtgtcaggtggggtcattcacgagctgatagctaggccgggaggtccaggaaggcttcacttgtactggaacctagtgcatctcccggtggccttgccacatggccaccattggcttcctcacagcttggtggcctcagagtagagggacctttaatggggttggagctgcctcttcaaggactgagcttgaaagttcagaacatcactcacgctgcattctcttggccaaagctgagtcccaaggtcggctgggattccaggggaggcgagccatgctcaggaggggcagtggccactacagctgagcctgatgctcttctctttttaacacagcattgggtcatgtcagccccatgtctgttacatttgtcaccgtctttatcactcagtgtcatttttctccatctgcagttgccttggtgggaagtgggggttccacgtccacaaaggcatcgcactgtgtccctgctgtggccctttcccaggtgaggttctgagagcccgtggcaattaccacttcgggacacaaacatccaagggccgcttcccacggggacgcttgtgattggcttgttcctggaacacatgggacctccttcttcatcccaagaccctcacctgataagcataagcagcccccgctcccctccccgtcagagctcagccgacacacgtcagcagccccagcatgcaagagggaaggagaggttaaagtcccccaccccaaaagccagaccaagagctgggacttcgggtgtgggcctagccctggagatgcttgttcccaacacctggccaagcctgctgcctcctgcatgggtctcgccgcaaccccaaacacacaacaagcagcctaaaagggaagtggcagaccaggcattccggttcttctctggcttttccctgtgggcactagggggtgggtcccacatggggcactcaagccctaacagacgacactcattctcccccaagatctgctgccttctaagtccctaaacaggtgtcatccccttcactctttcctcatgtttttcttatttaaaattgtctttttaggagaagtttgcaggctgtttcctgaggtctgggccagcagcaccgccatgccctgacccaccattcccctggccgcgggctgagtgtcccagctgcacgggaactcctggccttgcctgcagcatgcgacactgccacacccacctcacggctcacagccaagtttcaggtcatgatgttttctcctagcctcagtgtaaacaaaaataactctttgccctctaagcaaatgagcagaggcctcaggaccctccccagcccacggctcttggggtgcactggggccctgtgcccggtcaccccctcgggtgtgcacatggccgcctctcctgcgcttcccacacccccaccccggagcaagcgctgcccagcacagcccctatgtgcgctttctgccacctgggggccccgacttccacgtagcctctctggaccctgggagtcccaggacctgggtgcggattctgaagcgtctgggggccgcctccctccctgcagggcgtgttcattgttgtccctagtggggtttctgcggctgtgccaggcccaatggctcccgcgggctgtgctagcaaggccttcagccctgagcagcatgcgggcaggcccctccacaaaggcaagcagagcgtgcagcatcgtccatctagggcactcttcccaccaccaccctgggctcaccgactcacacagccctggcagtgccactctggatcccgttgttgggggcttccagaaaacagcgtgtgggggcctgggccccatttgccagtggggtgttctcactccagacaagtctgcacaaccactctgacttgattgatggatcgactgtctgatacaaggtcttgttctgttgcctaggctgagtgccgtggcacagtcgtggctcactgcagcctctacctcctgggttcaggcgatcctcctgactcagcctcctgggtagctggggctacaggcacgcaccaccatgcccagctaattttttatttttatagaaatggggtcttgataagttgtccaggctggcttcaaactcctgggctcaagtgatctgcctgccttggcctcccaaagtgctgggatcacaggcatgagccaccgtgcctggccttgatagttttgaattatggtgcagggcaagttcccacccttcctcctggctgggctgctgagtgggaccctaggtgtggggacttctctgtgccttggcctgggaggcttccaggtccccacagccaggtcttgcgcttagagccttgagctgggctcgggacccgggccccattcctgctggtccccaaccggcacgtccccacccacgtgtccatccccagggaaagggcatcctgagcctgaggggccgcctgtggaccccggctcttgggggttgcagcttggccgcctgtgggcagcaggcggcgcgttctccgactgcctgttctccgactgcctgtgttctcaagttgggcacggggtttacaggtgtcgtctctccttcagctggggtgtgtattctttgcttttagatggtaaagattttaagacaaaaatgaacactttgcttttgcttcaaaagctccctgaatgtctcttggcccctcttagcgtggcaggtgggctccacgtgtgcagggccaggcgggccggggggatcctgtgtgcagtaggagccggggtcagggggccagggacccacaagcctctccctagccccgccccccgagatcggccaggcacctcacggcccctcctgtccctgcagacccagccgatgcccaatcctgtggcgtactacctgcaccactcaccctggtggttccatcgcttcgagacgctcagcaaccacttcatcgagctcctggtgcccttcttcctcttcctcggccggcgggcgtgcatcatccacggggtgctgcagatcctgttccaggtgagcccgcgccgcccgccctgccccgtgtccacagagacgctggcccgtcgccctatttctggctgccccgctctctgggaggaccctggggcattacaggccccctttcttggggacagcctgtcctccccagccttcgtttgtgtcacgggccccactgcagccctgtcccgggctgcaggctgagggtctccttcccaggcttcctccaaggactggctcctcccaagagcgtttcctgcagctgcgagaggcccggccatgtcctgggctcggcagtgggacggggtcagcacgccaaggccctgtgtggacacccccacattcctgggatccactcctaagattcttccattctagaggtttcctttcaagtgttcatgtcagtccacggggaaccagggtctgagagaggccagggtcatttgcctccatgtgggtgaggggctgcctcccccagcccccggaaccccgggtaccccctaacgccccgtcctgcccacagtcaccgccatccctgccccacaagccccctgcattgagggcgcctcgaaggacagagcacccccacgctgcctccaggggggctgggccagtcccgagcctttgcttttccctgtaaacgctacattccgactgtcaattcccaaggaaaatgtggtggggattttaaaggtggttctctctctcgattgtttcaatggaggtgtaacatacagccaggaaaatgcacaggtccaggtggcgttccacgtgctctggaaaacagatgtacctgggtgtcccacgccccttcccctgccctgcccgcccctgcccccgcccttcccctgccctgcccacccctgccagagcaccgccgcctagaggggcaaagctccgtcagcaggcacgggtgccacgccacgttggtgcacgtgggggcgcccatggttgttggccgggtcctgtttcacggtgcgtgcctgcggtcggttcacccgtcccgtctgtgcacgtgtggtagtttctggttttcaccacagcctgccgtgcagaggtgcaatctcgtcatcctgtggatgtattttcaagggcgctactgtatcgtgagcaggcctgtgattcaccttactggaagctgcacgtgtccagggtggctgtgctgttcttgacccctccccccagcaaggaccctcactctggccgccggggccctgagcagctcctgactccctcgggcttttccgcgttagctgcttggaggctggcaccggtgcccatcaggtgatttccctgtgggcatcgatgtcgccgtgaatctaagtgggaagaacggacttgctcacagatcgtcccccagccaggaccgcacgtttctctctgcagctgctcagggctcctggaatagcttcagtcggttccatgtagccggaccccacgcgtgtttgggggctcctggaatagcttcagtggattccatgtggctggaccccacgcgcgtctgggggctcctggaatagcttcagtcggttccgtgtagccagaccccatgtgtgtttgggggctcctggaatagcttcagtggattctgtgtagccagaccccacgcgcgtttgtaggctgcagctctgaggtgacttctttttgttgatgttgtaaatggtgcccttttaagtcacacttcctcctcttggtggctaagtgtgggactctggtgaccttgacctttctcagacaacctctgcactggtacttccccgtctgtctgcgggtccctcagagacgcgtcctgtgggtgatctagggattctgccggttctacgtccatccctttctcccctgctgggcgggctcgagtgctgtcctgggtctggggtcccacagcagggagggcccgccaccccgcgcactgcctctcacgatgccggctgtgggttgttttcgtggctgcttttattcacttctcctttgtgggtttttagccatgaatggatgttgagttgtggcgtttctccatcagtcacgagatgacttgttgtttcgtctgtaacgtggcgagttacattaatgctgtggatgctgaagcaagttcacattcccagaacatctgagcctcttcctctgcgggagtctggaaagcagaggtgaccgtccctcacacctggcagtgctcctgcatgaggccacctgcgccgccagggtctctgtgactgatcacccttgcgggccgtaggacacgcagagtttccattccttcttgacttgaggcagtttttgtggtgaacatttccctgggaatttgttcatctgttttcaaatcttttggcaaaaaaagtcatagtattatcttagttttatagcctctcaagtagccgggactacaggtgccaccacgccgagctatttttcattttttgtagagctgggggtctcgctatgttgcccagtctggttttgaactccagggctcgagcactcctcctgcctgacctcctaaagtgccgtgactgcaggtgtgcgcccggcctcaaggcctgtgtcctcaccgacacgcatctcctgagacagcggggagcaaggtcatgcttagggtcagcgtggccgtctttctcttttaagtaacaggcccgtatatctcaactgacatatttggacgtatttccacatctttgtgtttttctctttgttctttgtatctttctctctcgtttttttctgttattttccctcctctaatggataaggaagatcctctgtttcctcagtggttatcaatcaatcagccatgttaacttactgaaggtctcagtttgggcagcatctttgccaccatgaccccccgaggtcctcagcccgcccagcccgcctctgtccaaggtcctcagcccacccagcctgcctctgtccgccccaagccacttgcgtcctttgctccagtgtttcagctctgtttcgttttattaattgacttattttagaacacttttagattttcggaaaaactgtgcagagactacaaaggttcccttatccccccctcccagtttccctgcgctcagcgtcttgcatcggccaggaccttgtatagttgataggcaggactgataaactgttgccaactaaagtcccggctgacaggagagccattcgcagtgttgctcattctgtgagctccgacaaacggacgacgacacgtgtccccatcacagcttcatgcagagtcgcttgtggccctggaagttctctgtgccccgccgaccctccgtctccacggtactgcctcttccggacatcctagagtgggaagcattgtgcagcctttgcggactggcttcctgccctccgcggccgcgcgtgggctcctgcacctcctgcaggctccactgcttgtttctcttcggttccgagacgcccgtggtccgcacgtgccccggtttgtttctccactcagcctctgaagggcaacagacggagccccgggcacatgtgcttcccacagggcgcacaaggagggttgtgctgagcacaggcgtggggccagggccggctgtgccagccccgggtcccactgccacccagggaggggtgtccagcctgaatggaggggtgtgttccaggattcctgacctgggtggggccacacacacgggtgactcctgagccgtcttcagccatgcggtcctggggtcccagctgctggaggagggccgggctggagactcccgggagtcaccccgaccccacacacctcctgcgtgggctgtgctgccccagggtcccgcctgcccctgccggtggagaacacagagatgcccacgccaggctcgggtctggttccgaggccggtccaagggcacccctggacacacagcccaggcaggggtgttggtctgcttggctccgtggctgcctggcagtggggagtgctcaggatcccacctcccgcttccatggcccgtgtaccctgtagcgtccctccctcaggctgtgctggccagttccaccactgcccctctcccgataagctgatgctgcctgggagaagctctcatgaaaagcaaggtgctgagttacttaagtaaatggagaaagtgggagtcacttgagggctgagctaccgtgacatggaatggggaggtgacccttgaaccagaggcctcaaaaacgtccttgtttattcagaacgcaggaacctggccagggggttagatgagaattggaccaacgggccctggtgcaggcagacagggaccctcccaagcatgacggccaggctgcgggttcccttagtgccggtgctggccccgttttggagtccgctgcctggtggggtgagtggcggtggacagtggggatgctgaaaggggaggggacagagctgggcctcactgcacctgggactgtgagcaccaccctcaaagacccggcacaggcagcgcctcccttccaggcctcggaggtcaggctgcgtcatcctctccagccccacactgtgtccaggacgaggtggaagcaccagggtcgtggctgtgctctgcggcgtggcctggcgtccccccttggaagacaagatggtcggccggcagtcccggctgcgatgtatcctgccccctcacaggcagtgtggggtcttgaactagggcttttgcccccacaggcgtacagggcagagggtgtctgggggatgatatggtgtggggctgagagtgacccgcgccctctaacattgtagtgtcctggctggggctgcgtactcccctgtgccgcgctgtgacagccgagtgccctgagacttctgagcgccgcctgcctggagcctgtcctggttccgtgtgttcccatctgagcgccgcctccccggatcccgtcctggttccgtgtgttcccatctgagcaccgtcccccggagcctgtcctggttcccgtgatccttccgttggggagttgcggcatgagcagcctccctcctcccacgcagtttacacagctgttccggagggttccgcggggccctggggccgctgcctgcctggagaggtgcacaagagcagtgaccgcagagcccggccgcccagccagcaccccacgggagccatcagcctccactagggcactggtgacagggagacgcagccccggactgccagggcgggaggggcagggggtgagctcaggtctggaacctctgaggcgcctgcccacagcgggctgtccggccccaccccaccccgccctgcccaaagggctccttgccctgtggtggctgcaccccacgcccgctcaagacagaggcccggaggccctgccagccccgcacacacaggccggctgtcctgaggctctgtcccagagctgggctcaccggcccttagctgtgtttcggttgtgatgaaacaacacagataacgcaaagtaagttcatgcttttgaagtgaactcgggggcctccagcacgttcacagcgtgatgcaaccgccgcctccgcctggttccagaacttcccataccccccccacacccggcaaaggagaccctcacacccgccgccgggcctccaccagccactgggagcttcatctctggattcccgactcggacgttccatgcaactggcatcctacaatgtgcggcctccgtccagcctccctccctgagcaccatgaccctgggtctgtccctttcggggcacgtgctgaactccgattcctttgcaaggctgcatgcgtttccgtgggtcaggcatagggctctgggtcactgctgtcgtggatgctgatggactggtgttagacctcagcagattctctacctcccaccatgttcttctgccctcatctcctctctgtgacactgaagagagacctgggttcacgcccaccagagtgcccacctggaacacaatgcatttcctcagcagagggtccccgcgagcgcaggggtgtcctcggcggagggtccccgcgaacaggcatgtcctcggcggagggtccctgtgagcgcgggcgtgtcctcggcagagggtccccacaagccacctgttctccgtggcagctgacaggcaggaggctgcatccaaagatgccactcttccttcttggggccatgcgccgttggcctcggaacacctgctgctccgtctcttgggcccaggattccatcacctcaagctcctcttcctgtgccggccttggggaccccctcgggcctcgcctccgctcccagccaccggccgggtcatctgtgggccgcacagccttgtgaggactccgccggcgggggcgagcacagatgggcagtgagaagactgatttccctctgaggagatggctcagtgatgctagaagaaaaacaaggaaggcgaggtcccccaggagcgctcaggccgtgcactctacgcggaactgcgttttcataacaaaacagccgaccagatggagggcgagagatgcaccagagcagctgaacggggcgcagctggggatgcctctgcatggagcagggccccgagccccgaagctttcttagaaacaggatctgatgcccagatctgtgctctctggagccctagttccctgaggctagagttccccactgagcccacagcaggatgacccaagggggctttggaaatacactcaggcagggcccaccctgacccaggcaggcaggtgctcagggctgggtgttcctcaaagctcctgatggttctggcatggccgagcatccgaacgggcactggctcaggctgtgccccaggtcgctttggtcccatctgccagtcaggctgaccacagcgaagggccagaaagacccgagcttttcccaccaggacattccagtgtcacctgtggcatctcctccagagcatccccaagagtgggcccaaaggtcagacctcagtgcctagccctgcaccctccctgtcacgggagctcaggggctcccagccaccccaccccagaccagccctggtcacactcaggacggagggcatgggggtctggaccagcggaggggagctggtggcagaggtggctaaccccagccagggcgaggcggggctgtttttggcacaggggtttagtaaccttgtagacagtggagaataagaaataactgttttggggctcagaaccagaaaagctatttttcccaattcacccagggagagccatgagtgcacagttcataaaacaccatcatcgcccataacactgatgtggctgccctcacgagtcccttcattagacgtcgatgtccctgccctcaaccttcctcctgagttacggggataaaggctgggctttgatgcatcaaatctggctgacggagctgtctgaggaagccacacccaggtcctgccggcccagggtccaccggctcagctgcagaccatcacccatgcagggcgaccggccacgcaagctgcccctgtctccctgatgcctccacggcaacggcaggggtgaggtctggcagcacacctgtgatatcacccgacggagctgcagggacagcggctccatctccagtttcgtcacctaacgatcgctggcctgcggggatgtccagaagcgggtccctctgagtccctcctgccgcaggtttactcactgctgctgctgagtctttccttggagctctcccagccgtgctgctcagccagccctgcatgcagcccctcccctctcctgctgttcatctctgtggcacagggtcctgtgcctgtgtctcacttccttgcatttcgtattttggagtgggggcgttactggtggcccccccacggcccctgttgtctgtgtcacccatcggctgaggggcgtccccagtacccactctccaagcacagcctcctctgtttggactcaccagccttccccgggcatgaccccggcaggtgccctctgaaagtgaggagttccaggagggcacagggtctggtggtctggtccagcccccgccttgcggatcactaaagcaagggacagaacctgcacagaaatgtgcagtcatgggaggaatgttctggaagcacctgccggaaggcacctctgaggcatctgctgtcccctccatgaaggcacagctgggtttcagttgtgatgctgggcccgagggacagcaagggcagagctgggtgcaggttccctcccccctccctgctccaggaagagaggcgccagctgcccaggggccccacacgagcccctgcacgagactcagctgcggcgtctccacaggccgtcctcatcgtcagcgggaacctcagcttcctgaactggctgactatggtgcccagcctggcctgctttgatgacgccaccctgggattcttgttcccctctgggccaggcagcctgaaggaccgagttctgcagatgcagagggacatccgaggggcccggcccgagcccagattcggtaggtggctcagctgggggcccctgcccaagggcaggagaaagtcgggtggtgccagccccacagcctgcccgtgtgggttggggacgccagggtaggaggagagtcagcgccgtccgcagtgtagcgtgccaggaacaaggtgtgtgagttcgggtgctgctccgtccccgggacccaggacagctgacccttagggagcagcagctggggtctccccagggacaggccacggggcagctgggagccccacctggaagatgtcactcccctgccaggctccgtggtgcggcgtgcagccaacgtctcgctgggcgtcctgctggcctggctcagcgtgcccgtggtcctcaacttgctgagctccaggcaggtcatgaacacccacttcaactctcttcacatcgtcaacacttacggggccttcggaaggtatgagcctggggtccccgtcccccggagctgggtatatggggagactcagccctgaccagccacattcaggtggggttacagtgcaggcccccatgaccccaagtgtcccctgccccaccccagcctgacccaggcacaggccgtgctgtccccactaccgggcctggacacgcaggcctcctcgtcctggtcccatgaggcaaaggggcagggcccgaggtcaccaggcaggtgggctgcggccctggaatgcctactgggggcgtaagggagaggccaccaggccccaaccccctgcgtgggaatgccaggtagtgccacctgaacacaggcaccctccctgtcctggggccagccccttggcctctgtccccctcatgtccaccctgagctgccgaggggcatggggcacatggcggctgcagctgggtcttcacgggcagagaaggtgttctcgaatgagaccctggggccacagttcccaaaagttctcctcagccccacccagcctctcagtagcccctgaccaggaggcaggtggaggctgtagccctccccctgggccaggatggacagtcggggaaccccccccacccatgcaccccactcggcccagccggtgtgtgacgtgggcctggcctgcctcggtctcccggcagcatcaccaaggagcgggcggaggtgatcctgcagggcacagccagctccaacgccagcgcccccgatgccatgtgggaggactacgagttcaagtgcaagccaggtgaccccagcagacggccctgcctcatctccccgtaccactaccgcctggactggctgatgtggttcgcggccttccaggtgggggacggtccctggcgggcgcatggacctgcctgtaccccaccctcttctgcccatagatggcaggtttctagaacgcccactgaaggggctggtggggagggaggctgggagagatgggatcctgcctgagctgagaactgagcccacacgacatccaggcccagccttaggaggggcctcatgtgggagcccagccccaccgtccccccgggtctgccaggtagtgtctcatgccaggaatcccagcccgggtgccatagcgagaccctgtatctacgaacaatacaaaagttagccagcagctgagggtggcgcctgtggtttcagctacgcaggaggaggaaggatcgattgagcccaaccgctgcagcctcaaatgatggcagcgttgccttccagtctgggggacggagccagaccctgtctcagcgaacaggaaagaaggaatccccagggctgggggtagcagaggcacccatggacagagctgctgtttctgtcctcccggtcccgtctcagccaccagaaaactgagcctcagggaggcaaggcccagacagagggtgctggggtggacaggctccaaggcacccagccaggggagcgaagccagcggccgacatgggaatgagtggtcagggctacacgaagcaggcagccccttaaggggaccccagccaaagagctggagtgcggctgcccagggaacccacctccaggaaagcctcaggagggagtggagggcacagccgagcgtccggaggggctgtgcctggacagcgagtggcacagccgtctccagcccgacctctcctcccagacctacgagcacaacgactggatcatccacctggctggcaagctcctggccagcgacgccgaggccttgtccctgctggcacacaaccccttcgcgggcaggcccccgcccaggtaggatgccctccctgccgctgctcaggggtctcccccaaatccaggtgtctgctgggatcccaccacctgtacctgcacccccacctgctcacgggaagcgccccttccctcccgcagaggcaggaggtggggcctgctgggagcaaaaagggccccccccccccgccccacatcagccttggcatcaaggctggtcccacccctgcctcatagcccacctcaaaccaaaccagccgtggtgagaggagcccaggacagctgctctgggcagggtgaccccggctcacagctttgttgaggtgtcctctaggtgccacctctgctcctggcctggagaggcaagaaggacaggcagggccctcactccaggagccccaggggtccatggtgaactgggcaggggactgcagtgagagccctgtgggccctgcagcctcgcccactccggccagtgacgtggtgacattccaaggagggagccccgcagggtcagattctcaggagccagaggtggtagccatgggggaagtcaccctcctctccataccagggatgactttccagactccacgcaggggagctggggtgcacagggagacactaaggaccctgagcattgtgaccagaggacaaggttttggggagagctggggccttcagaagaggagcaggaggcagggatggggccccgctggggtacgggaggggatctgaggacagtgtggggtggggcccagggtggggcagagcatggaggattggagacgtccacgtgaccagacctggggcggccactctgacaagcgtttgtatcccctgccccacatggttgggattgagcagccccctggaggtagcaggaacagagcagagtctggactgcccacccctcccctgcgccatcagccgccgattctgacggaaaacacagctctggattttccctccaagaacactcgggagctgggacagctgcaccctctggagttgctcacagctgcctggagaccccagccaaggagccggagggcggggatgggaggggcgccgaggtccacagaggcagtggagcagctgggcccgagtctggcagcccaggcaggtgctcccggccaagcgatgcttccagggctgcttccccagcacgggtatcacagggagctggggcagaggggctatggggtccctcctcatgggcccggcctcaggcagtccaggggaggctccatcccagagcccccggtggggtggccgccctcctagctggcgccctcagggccaccttcctgtgaattggcatcaagctccaggtgacttgcctgccacgtggccaccagcagccctgggagcctgagaccttggagcccggacaggcggccgttcccctggctcactggggaccaggccccagagctcgtccttcgaggctcaatacgggtcttctctgttactgccccgtctcagcagccttcagagccccccagcccccaccccagatcgcagcctcctcggtgcctggggaccctggagctggcccagaggaaggtttgccatcgtcaggtcgtgacggaagcctcttctggccaagcacacagtcggatcatctgtttctcagccaggaggtgctggaaaaagtaatcatgtcagagcagcttcaggtccatccatgagtcccaaagtctacctgaaaggatggatactgtgaaaaccaagtgtgaaaagcagtaactattttatgtgaaccagtaatgagttaacatttagggaaaacattattgaacactgccacacggcacatctctcccgtctccatgatacacatgtttggcagctggagcaggtggtaccatgacaggctgtggctaaccgtgggcctgcattgagttcatcatcgactttaaaactggaagatggaacagacacttacccctgttcctcccactaagtgcaaccaagatccctggacgttatacataaaacaggaagaccgaaggtgagagaagagagccaccagcagggccctcgggacggagccacagccccaaaatggtggtgatcgcctaggcttgctttcggcctcattttctagacttgggggtgaggaaactggaaacccagtaatgccagcagatgcagacaagaaacacctcaacaaaaatctgctctctctgactaaagggccagaaaagagcagcctagcaagacaggaaatttacataaaataatcaccactccaggcaacaccacagaaaaaaccatggccccacccacaccagcaaggtatggagtagggagcctggactctcctccaaacggctcactgggatgctaccagaggaggccaaataggaagctgagattttcatccaagtgggcaggaaggatcccccgcttctgtggtatcagtggagaccacacgaggagcctggactcccccaacccctggcagtactgaagggctcctcccctccagagtggtattacgtaatagctaccagaaagtcaggaccttcaccaccacccagccagcaatgactaggccacccccgccatagtgtcatggaggcctagtgcagagccacgactcccaccctacccagaaacaacaaggaatactcccaatgcgtccactggagttctaccccaacctggcaggagcaaggtaatacccctgtctctaccagcatgaggtcagaagaagtcatctaaagcagaaggtttaaataagatccaaaatctcctaatacacaaaatgttcagttttcagtggaaaaattacttgtcacagcaggaaacaggaagacattggtgaaaaaggacagtcgacagatgatagcaccaagatgagggaggtattagagtgacttcacagagatgtgaatgcagccgtcgaaaacgcatgcagtaattatgaacacaactgataaaaaatacagcctcagcaaagaaatcggttttttaaagaaccaaatgaaaagtttagaagtgaaaaatataactgacacaaaacactcgacatctgaatggtgaggacagaggaaagaatcaataaacttaaacatagaaagtacccagtgggaacaagtgagaggacatagacggggaaaaacagcaagagccccagggatctgtgggactgagactgtaacagaagatccagaattcatgtcatcagagtcctaggaggaagacagagtgagctttagggctgaaaatgtacttggagaaataagaactgaaaacttcccaaatttggcaaaacggacaaacctaccgagtcaataaactgagcaaaccctaaataggaaaaacccaaagaaattcaaacctaaacacatcaaagtcaaatttctaaaaaccagagataataaaacattgccagcctggccaacatggtgaagtctcgtctctacaaaaataaaaaatgagcgagtatggtgccacacgcctgtaatcccagctactcaggaagctgagcaggagaattgcttgaacctgggaggcagaggttgcagtgagccgagatcacaccgttgccctccagcctgggcaacagagcgagactcaatctcaaaagaaaaaagaaaagacatgggtaaatacaatagacgttccttctcttgagttccaatcatgttggatggttaagcaaaggctataaaactgtctgaagtagttcaaagtttatgtagaggaagtagttaagataactataaatggatgagggcaaatggacatagaggtgaggtttctatgcttaacttgaagtggtaaaatgacatcagtagactgtaagttacgtgccaagaacagccagtaaaaaacaacctatactaagagatacattggaacacactattgacaaatcaaaatggaattctaaaacacttacataacccataggaaagcaggttgggaaaaacaaagaaatcagaaacagaacagatgggaagaagtaaaatgaccgactgtatattcaatgtaaatggtctaaataagccaattaagagataaagattggccaggtgcagtggctcactcctgtaatgtcagcactttgggagctgaggcaggtgtatcacttgaagtcaggagttcaaaatcagcctggccatcatggcaaaaccctctttactaaaaatacaacaattagccaggcatggtggtgcatgcctgtaatcccagctactcgggaagctgaggctacagtgacccaagacatgccactgcactccagcctgtgcgacacaagaccctatctcaaaaaaaaaaaaaaaagatagtaacttaaatatatgcataatgagcttatgccctgataaatgcagcataagttgaaaatgtaagtcaaaaatgagtttaatacacctaccaaacatccgtcgtagctcagcctagcctactaccttaaacgtgctcagaacacttacattagactacactgggcaaaatcacctagcacaggcctgttttgtaatacagtgttgaatatgtcatttactgaatactgtatggaagtgaaaacaggatagttgtctgggcactcacagtgcggttcctaccgagtgcgtatccctcgcaccattgtaaagctgaaaaactgtcagtggaactctcataagttagggaccctctgtataggcaggttgaaagtaaaaggatagaaaaaaatatgtgactattaatgaaaataaaggattcattgtattaacctcaaagtagacctcagtgcaaaaattattggagacaaagacggacaatgagaaaagaatcaacctgccaaacagatgtagcaatcctaagtgtgtgcactaagcacagatctgcaaaacatgtgaagaaaaagaactgaaaggagagctcgacaaatcaacaattacggctggatgtttcaacacccttctttcaacaataggtagaataactagatggaaattcagcaagaacataaaggagcaccatcatcgacaggcagggcctaatgatgtttatagaatatgccacccattgcactgaatgacatgtcacattttctgggatgtagttaaactagtgatgagagagaaagcaccaaatgcatacattagaaaagagacctgagattttagaaagaggaaggatctcaaatcaataatctgacatcagctggatgccgtggaagcacctgtagtcccagctactcaggaggctgaggtgggaggactgtgtgaacccaggacgttaacgccagcctcttggcatcaggcagcacaggaagaccccatcgcttaaaaaataataataatctagctcaagatcacatgaataactaggaaaaaatttaaagcaaggagcagtaagaaaatagtaaaaagcagaaaatgaaactgaaaacaaacaatagagaaacttattgaaacaaagagatggttcttttaaaagaccaataaaatcagcaaccctctagtaagaataacaaaaggagaagatacgattgccaatatcaaagatgaaaaaagaggttgggtgtggtggctcatgcctgaaatcaccgcactttgggaggccaaggcgggtggatcacctgaactcaggaattcaagaccagcatggccaacatggtgaaacccggtctctactaaaaatacaaaaacttggctgggcgtggtggcaggtgcctgtagtcccagctacttgggaggctgaaacacgagaattgctcgagccgagactgcagcactgcactccagcctgggcgacaccacaagattctgtctcgaaacgaaaaagagatatcactacagaccctgcaatctgaaaaggataataagcgactacgacaaacatctacatacataaattttataacttggatgaaatagaccaattcctcaaaaaacacaaactaccacaactcacctggtatgaaataataatttaaatagccctataactagaaattgaatttgtcattttaaactccaaaaagaaatatccaggctcagatggtttcactggagaattctaagattaatttcccagaaaatagaagagaaggaaaagcatcaatttacgttttatttatttatttatttattttttgagacaggttctcactctctgtcacccaggctggagtgcaatggcacaaacatggctcactgtagcctcgacctcctcagctcaaattatcctcccgcctcagcctcccaggtagctgggaccacaggcccacaccaccacgcctcactaatttttttagtttttgtagagacaggatcttgccatggtgccctggctggtcccaaactcctgggctcaggcagtcctcccacctcagcctcccaaagtgctgggattacaagcatgagccactgtacccagcctcaatttattttatgaagctagtggttctctgataccaaaaccacacaaagataatacaagaaaataatattacaagccaatatccctcagtgatatagacacaaaattttttaacaaaatattactaaatagactgggcacaatggctcacacttgtaatcccaacactttgggaggccgaggcgagcagatcacctgaggtcaggagttcaagaccagcctggccaacatggtgaaaccccatctttgctaaaaatacaaaaattagctgggcatggtggtggctgcctataatcccaactactcggcaggtggaggttgcagtaagcagagatggtgccactgcactccagcctcggcaacagagtgagactctgcctcaaaaaaaaaaaaaaaattactaaatagaatttgccaatatataacaaagaattctatgccatgaccaagtagggattattccagggatgaaggttggttccgtatttgagaatcagtcgatgagatccacacgttaccagctaccgaagataactcacacgatcacatctgtcagtgttgggaaggcccgtgacaagtttaacatctattcatgatttaaacttggaaaaacagagaaggagaggaacttcctccgctggataaagagcatctgtacaagccctgcagccagcattctcctcgagggcaaggaatcacccttcaccattcagatccggaacaagaaaggacgtctgctctaaccatcggatccggcatggtgctggaagcgctgggcactgcagtacgcaggacaaggaaagaaaaggcgtgtcgatcacaaaggaagaaacgaaactgcctgtttacagatgacgccgttgtctttgtaggaaatcccaaggtatccaccaaaaacactcctagaattatgaagcgaggccgggcgcagcggctcacacctgcaatcccagcactgtgggaggccaaggcaggccagtcacctgaggtcgggagttcaagaccagcctaacatagagaaaccctgtctctactaaaaaaaaattcaaattagccaggtgtggtgacgcatgcctgtaatcccagctactcaggaggctgaggtaggagaattgcttgtaccggggaggcagaggttacagtgagctgagattgcgtcactgcactccagcctgggcgacagagtgaaactccatctcaaaaaaaaaaaaaaaaaaaaagaaagaaaattaataagtgagttcagcaaagtcagaagacacaagatcaacctaaatgattcaatagtattcctgtacgctagcaatgaacacacagacacctaaattaaatacgcagaaccacttaaaaccactccaaaaagcgaaatacttaggtataaacctgacaaaacatgcacagaacttacatgctgaaaactcagcaatgctgctgaaagacgtcagcacacacctagagacacggccgcgttcgtgggttggaagatacaacaacgtggagatgacaggtccttccagattgatggacaggtttaatgcaattcctattaaaaaaaaaacccagcaagatgtgttaataggtaaggacaagtcatcccaagttttctatggaaatgtaaaggagcaaaaatagctaaaaccattttgaaagagaacaaggtggaacgaatcaatctacccagtttcaagacacagaactacagtagtcaacacagtgtagtattgacagagggacagacatgtaattccatggaacacaacagagaacccacaaagagacccaaacaaacatgcccggatgagttttttttacaaaagcgcaaaagcaattccatggacaaaaacaaaatcttcgacccacgtctcaccccacacaaaaataactcaaaacggatcctggacttcaacgtaaagcataagacaatcaactttcagggccaggcatggtggcccacatctgtaatcccagcactttgggaggccaaggtgggcagattgcttgacctcaggagtttgagaccagcctgagcaacgtggcaaaaccccgtctctactaaaaacacaaaaaattagcagggcctggtggcacatgcctgtagtcccagctactcgggaggctgaggtgggaggatcacttgagcctgggaggcagaggttgcagtgagccgagatcacaccaccacactccagcctgggcaacagagcgagagcccatctcaaaaaaaaaaaaactttcaggaaaaaatagaagaaaatctttgggatctagggccaggcagagtcattatacttaaagatgatctgtgaaaggaaaaattaattgaaattcattaaaattaaaagcatttgctccataaaaagacctgttaagagaacaaagataatttttaagctacagacagaaaatatttgcaagtcacgtatctgacaatagtctaaaatctggaatatgtaaagaagtttcataacttaatactaaaataatcttattagaaaatgagcacagagacgtttcaccaaagaaggtgcacagatgacagataagctcaggagaaatgcctgtcattagagaagcaaaaaccaccataacaccactgcacacccatccggtaccatcactgcacacccatcccgtgacaccactcacaccgatcccgtgacaccactgcacacccatcccgagacaccactcacacccatcccgagacaccactgcacacccatcccgtgacaccactcacacccatcccgagacaccactcacacccatctcgtgacatcactgcacacccatcccgagacaccactcacacccatcccgagacaccactgcacacccgtcccgagacaccactgcacacccgtcccgagacaccactgcacacccgtcccgagacaccactgcacacccgtcccgagacaccacgcacacccgtcccgagacaccactgcacacccgtcccgagacaccactgcacacccgtcccgagacaccactgcacacccgtcccgtgacatcactgcacacccgtcccgagacaccactcacacccgtcccgtgacaacactgcacacccgtcccgagacaccactcacacccgtcccgagacaccactcacacccgtcccgtgacaccactcacacccgtcccgagacaccactgcacacccctcccgagacaccactgcacacccatcccgagacaccactgcacacccgtcccgagacaccactgcacacccgtcccgtgacaacactgcacacccgtcccgagacaccactcacacccgtcccgagacaccactcacacccgtcccgtgacaccactgcacacccgtcccgtgacaccactgcacacccgtcccgagacaccactcacacccgtcccgagacaccactcacacccgtcccgagacaccactgcacacccgtcccgtgacatcagtgcacacccgtcccgagacatcactgcacacccgtcccgagacaccactcacacccgtcccgtgacaccactcacacccgtcccgtgacatcactcacacccgtcccgtgacaccactgcacacgcgtcccgtgacaccactgcacacccgtcccgtgacaccactgcacacccgtcccgtgacaccactgcacacccgtcccgtgacaccactgcacacccgtcccgagacaccactgcacacccgtcccgagacaccactcacacccgtcccgtgacaccactcacacccgtcccgtgacaccactcacacccgtcccgagacaccactcacacccgtcccgtgacaccactgcacacccgtcccgtgacaccagtcacacccgtcccgagacaccactcacacccgtcccgagacaccactcacacccgtcccgtgacaccactcacacccgtcccgtgacaccactcacacccgtcccgagacaccactgcacacccgtcccgagacaccactgcacacccgtcccgagacaccactcacacccgtcccgagacaccactcacacccgtcccgagacaccactgcacacccgtcccgagacaccactgcacacccgtcccgagacaccacgcacacccgtcccgagtcaccactgcacacccgtcccgagtcaccactcacacccgtcccgtgacaccactcacacccgtcccgtgacaccactcacacccgtcccgagacaccactcacacccgtcccgagacaccactgcacacccgtcccgagacaccactcacacccatcccgagacaccactgcacacccatcccgagacaccactgcacacccatcccgagacaccactgcacacccatcccgtgacaccactcacacccatcccgtgacaccacgcacacccatcccgagacaccactcacacccatcccgtgacaccacgcacacccatcccgagacaccactcacacccatcccgtgacaccactcacacccatcccgagacaccactcacacccatcccgagacaccactcacacccatcccgagacaccactgcacacccatcccgagacaccactcacacccatcccgagacaccactcacacccatcccgagacaccacgcacacccatcccgagacaccacgcacacccatcccgagacaccacgcacacccatcccgagacaccacgcacacccatcccgagacaccactgcacacccatcccgtgacaccacgcacacccatcccgagacaccactcacacccatcccgagacaccactcacacccatcccgagacaccacgcacacccatcccgagacaccacgcacacccgtcccgagacaccactgcacacccgtcccgagacaccacgcacacccgtcccgagacaccacgcacacccgtcccgagacaccactcacacccgtcccgtgacaccactcacacccgtcccgtgacaccactcacacccgtcccgtgacatcactcacacccgtcccgtgacaccactcacacccgtcccgagacaccactcacacccgtcccgtgacaccactcacacccgtcccgtgacaccactcacacccgtcccgagacaccactcacacccgtccggtgacaccactcacacccgtcccgagacaccactcacacccgtcccgtgacaccactgcacacccatcaaaacggctggaataaaagtagcaacaaccccacatgctggcaaagataccaagaaatcgagtcactcggctgttgctgggagggtaaaatggctcctcaaaaaggacacccgaagttgcagtggactcagcagctgcttccatggacgtttaagccagagagttgaaacccaggttcacgcagaaacccgtgcagaggtttacggcagccgtcacagacaaaaactgcaaagagctcagctgtccttccacaagagagcgaccgcacaaactagggtgcactcacgccgcagacgccggtcagcgacgaggaggaaggaagcctccatcacacgacctggcggaacctgagaattggcgtgagaatcgcctgccccgcgggtacgtgccgcagggttccactcattcttgaaatcatacgttcttgaaatcacacaaggaggccgaaggtcggggagggtgtggaaggacacgggggtccgggcgtggatgggacccgtgtctgtggcctcagtgtcaggccctggctgcaatccctactatagctgtgcaagatgcccagctgttgccagtagggtctatttcaaaagggctgggagatcccctattttcaacactctcaagccctccggggcggtgccatggccttctcgggtactttgtctgcaggaatgaaatgcaacccttcaggccgctggggcctggggccccttcccaccaacctgccagttggcacagagggttctgaccctttccaaaaccctttccaaactgcagttccagctcttgatgtcagagaccaggccctgggccccctaggccttgaccctgtcctgggaaggagcagaaagcaagagcaggaatttgggaaagatgggcaatcccactgcaggaggccttcccaggatccccaccctcccggcctcactaaatgcagggtttgggagagggtgggcctgcctggggactgcattgccctagcaaggcccaggagagtgtgcagggaccatgctgcccgcacagcccagcgccctcacggccgcattccagcccgtcccttcagtctgctgctgagctgctcagaggtcgacctcggggtccagtgtgacttctctgcctggcaccacctggcctcagtccccatgctggccgctgccgtccttatagccaaggaaaaccatggcagcctcaggcccaaggggtccaggaaagacccctggggcccagggcagtgggcagtgccctcctggagtggacgggagccaccaactgccagcatcaccctcagtcttggctgcccgggaggttttccaaaggcccgaccccactcctcttggagctgctgatccctctctcccatcaggcgcctcagggaccctcctccacccagagggtctctgtcttcccggttttcctggcgtaattcagacttggggagagaagaatcatcatccatcacacacccagacccaaagagactcaaagccaggaggagccgggtggacccagaggccctcaccctgccagcctaaggggcatggcccaaggtctccacccccagcccccagagcacagctgtgtgcaggtcaccagaagccccaaataatgacagcagcccagacagtcgctaccgggccctggtgcagtgtgaagcctctggcacctgcctgggctcattccaggggccatgagagggtcctgttatggctgcaccatcacacccaccgggcagctggggcccagctctgccatggatcccagccaggcagcagccgccctgtgggctgagaagcttccgctcctgctgcacaactgcgaaggggcctggagggccgggagcttgtgacggtgacaattcctcctggcgcctcctcctccggggcagccgagcaaccctggacatgagggggcttcgtcccacccccaggagaaaatgcccagtcctccgagagtccagtgagggcttgccagccagggaccaagacccagtatggcctaaaccaggcctggtcaccaggggtcaggcgggaccttatacagggctcagcagagagacctgcccgctaccctgctccaggggagatgggggtgggggccttcatcccactcgggcatgacagaggagagcagccagccagcatctgcacgtctcaggcagggaagggcctgaagccctgggaagcagaggctccgccctcaggaaacaggtcccggcctggctccctcacagcctcggactgccccgtggaccgaaacccccaggcaccttgcgccaggactggcctgatggtggagacgccacaccatgagcagtaggttcctctccccaccttcccaggcgggggacacttggggctcaaactggggccttgtgaacggtctcaggcttgctcagtgccacccgtgaagctcctggccttccccgggccggtccctctgccaagtgggccctgctgggtctcccctcccggagctgccccccgtccgcccttcccccttgctgcgctgttcactgctgagggtgccgactggaacagttgccctgcccggggtctgctgggggtctacctgtgctcagggtgggggctcctcatgcagcccctctgtccgtgggggaccctgtgagcagctgcagctcagcagcaggctgaggagccgggtcgggggccgggagtcccagcaggccctgggctgacatgtgcccccttgcaggtgggtccgaggagagcactacaggtacaagttcagccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcgaaaa

SEQ ID NO: 437 - DNA, 26920 bp, Homo sapiens
ccgggcgcgcgattcacagcgccgcgtgcgccccgggcgcgccgtagccgcggggcccgggccgggcgctacgctacgaaggcagcgtaaggcgggcgccggacgcgggcaggggccggggccggagccgggtcggggcgccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggtgagtcccgtcggccgggcccggccgggcgcccagccggggaccccgggcggggagcgcgggcccggagggcggcggggagcgcgggctcggcggggcgcaggaggcctcgggggccgggcgcgccgggctccgagccagggcagggacggcagggcccccggagtggggtcagcccgccgcccgctggcgcctccaggctggtgggggccagggctgggcgatgcttcgcagaggaacccagaggaaggcgggaagtcggcagggacctgggccatgtgggtcacttgaggccagccccgggggccgcgcacaccggaggcggcctcggccctgcctgcccttgagtgcccttatatccgggcccatcgtgcggtcctggccgccttagggatgttgtgcttggtgcgggcatcactcccctcacttggggaacggcctgggggcggccacctggcgtggaggggctggcgggagccccgtctgtgccagccatgccagtgttctcttccgtgttcctctggggctgctgcggcaccagctgggaagttgcaaatctgctgtcctcccgctggctgcagaaggggcccctctagtcctgaccgggggaactcttgtgtggtcagctggccctggccgggcgagctctcggggcccccttactgctctggagtttgttaccggactgcaggtaacaagacccggaaagcaatggtgaggcccagaacctgaggccaggcctgggtgtgtggggccagtggggaagactgggactccgttgggtgctgaagagttgtgtgcttctccttcgggaaacccggatctcttcctctgcccaggtctgaggggtgcggaaacgtgagtcacagttcagtgtgggagtgccccgtaattgcctccgcgtttccagagtctggggctgggcaaggatataggggtgattctcccttccggttctgagtgacttctcaactgtgaagtggggcaagagaaattgtttttctggcctgtctgggggaggcaggtcctgcaggaaaccagcttggcctggccttgggttgggtgtgccttgcctcctccgaggtccttctgcttgcgggaggagcacccctctttttcctgcttctgtctgtgtctgaggctctccagagctccttgattggcagaggagccagtgacctctgagtccccaggagagcccgaggctcagtaactgcataactgcgcagggcctcttgtctgggcctccacagaccgtggtctctgagagcaggaagtggctggtcccctgtaatgctgcatctgtgtgacagcctcaagccctgctggctctctctccgggcacccctcacttgcttcttgccctggccttgggcagcactccggtaaccccagtgccacaggtgaggaaccgaagctggagacagctgttcatggcaggggaggggccgagggaggctgagcgcctggtctctccctcctgctggttccaccagttcacacgaggcaattggagggaaggattctgctgcccggaaaatcctccggaaccacaggtgttgttcatgggcctgagccgctcagtgaagaactcggccgttggtggccgagttgcccctggtccagccctctggcccgcggtgtgatgcctctactcatggcaacaggcgtggacaggtgctgagaaggaggacgacatcattaaacaaaacagcttggggtctttgaaaaacagtgacagaaacccaggaaggctggtgacttgtcaggtctgtgtctgtcctgggtggccactcggccctggaccgtgaggctgaaatgacaggagacacggagggtgggcttgggtggtttcctcataagacacagaagaaggaggcccccaacccgggggctgcctcgtgcgctttgctctcctgttttcctgctctgtccctctggtcctgccctctgacccctggcacagcaggagtgcccagaagcccagtgggacttgttctctgcctaaagcccttccgcatccctcgtacccactcggtgtggatgtgggttttctcaccaccaggctgtgcctcagctgtgtggagccactggcctctcatgccccacgctggagagaacgctgaggtctgtgcggttctcatgtgaccctgtagctggtccctggctccccactgtgggatctgcctgcagcacttacacttgggaccgccctgtctccctgctggatgtggcgccgagggcagggtccgtttctgtttcttggtaggcctagtgtctagcgctatgcagccgtgcgcagagcaggcggtcagtgagcacctggggttggccctcaccacaggcagttctgaatacctgggttctggcagcccagggggactcctgcgtgctccaggaaagtagcacagcagcccctgtggcgtggacacggccacacctgagctcggcctgtttctgagtctgagagaacaggcttgctggcctgtgatctttgcatgtgtgtctcgctgcagggaggctgtgggttggggctggacctagacccgttcagccacaccctgtcactatgtgggtcacacacagctgggtggagacctcccggtgcgtggcccagggaggtgtctgggcgtggagtctgtggacagccacattgtaccactaggacaggggctgctgctgggcccacagggtgcacggaatggggtctgtgggaggatgggggcatcctagcccagggcagggaccccgtgggccccccaagatgagctgcgtcaggctgttgctttgcacactctgaggggcctgcctgagtgctgcatgggaagccagcagtgtggccgccctccccagaactcatccagggcaccagggtggacccatgagtcccgtcgggtcatgggcatcagcctcgccatcctggcctccagatacaacgatttgtcagattccctgaggtcaaagggaagcttcaagggttgccatccccgcctccctggcggtcctagacgggatgtcaggaggacgcagggccatcgctgctttttaaatgtcacagtgactgcagcgtctgctcctctgtggaaggagcttgctccgctaatgagggagttcctcctcatggccttcccctcacttctcttcaaaaagttgccctttattttaacattttttaagttttatttttttgagccagggtcgtgctctgttgcccacgctggagtgcagttgcaatcatagctcgctgcagcctcaaactcctgggctcaagtgatcttcctgcctcagcctcccaaatactgggactacaggtgggcgccaccacacccagcctctgccctttgtaagtgaagtcccccaggcaggttgaacctcttacaccttctgcccctgcctgatccccactccctaccccccacctccctgtcccctgtaatgagaaaggcaataagttttggagctttctggagttcctgcccctcctgaaaaggtggctgcagagaggctggagctgatggggaaagaggtgccacgaggcctcctctgggttagggccacacggctcccaaggcccccgtctccttctctggggtgacaggtgcccccagggccacacggctcccaaggcctccgtctccctctctggggtgacaggtgcccccagggccacacggctcccaaggcctccgtctccttctctgggatgacaggtgcccagggccacacggctcccaaggcccccgtccccttctctggggtgacaggtgccccctgtgtcccagaggcttctgcttggccaccagtgaggtcaccgggctgcccagaccagggctgcttctgccaccacatggcaagcagagaagtagagaagtgccaaaaaccacgagtgcttgtctggtccttttttcctgttaaaaatagaagtcggggctgggtgcggtggctgacacctgtaatcccagccctttcagaggccgaggcaggtgggttgcctgaggtcaggagttcgagaccagcctgaccaaaatggcgaaaccccatctctactaaaaataaaaaaattagctgggtgtggtggtgtgtgcctgtaatcccagatactcaggaggctgagactgtagaattgcttgaacctgggaggcggaggttgcagttagccgggatggcaccactgcactccagcctaggcgacagagctatactccgtctcaaaaaaaaaaaaaagaaaaaaaagtagaattcggttgggctcagtggctcatgcgtgtaatcctagcactttggaaggccaaggtgggtgaatcacatgaggtcaggaggtagagaccagcatggccaacgtgacgaaacccccatctctactaaaaatacaaaaattagctgggcgtggtggtgtgtgcctgtaatcccagatgtttgggaggctgagacactagaattgcttgaacccgggaggcagaggttgcagtgagtcgagatggcaccactgcactccagcctaggtgacagagtgataccctgtctcaaaaaaaaaaaaaaagccagccgctgtggctcacgcctgtaatcccagcactttgggaggtcaaggcgggtggatcacctgaggtcaggagattgagaccatcctggctaacacggtgaaactccatctctgctaaaaatacaaaaaaattagccgggcctggtggcaggcgcctgtagtcccagctactcgggaggctgaggcaggagaatggcgtgaacccaggaggtggagcttgcagtgagccgagatcacaccactgcactccagcctgggcaacagagcgagactctgtcagagaaaaaaaaaaaaaaaacaggtgatgcctgtgccactggacacacctgcacaccatcctcatgctgatcacaaaagagggtgaggggccgggcatggtggctcatgcctggaatcccagcactgggggaggccgaggcgggtggatcacctgaggtctggagttcgagaccagcctgaccaacatggtgaaacctcgtctttactaaaaatacaaaaattagctgggcacggtggcgggcgcctgtaatccgagctacttgggaggctgaggcaggagaatagcttgaacctgggaggcggaggctgcagtgagctgagattgcaccactgcaccccagcctgggtgacagagcgaggctctatctcaaaaaataaaataaaaaatttaaaaccaacaaaaaagagggtgatggctgagtgaggagtccatggtgggccctacacagggcccaggaaggacagggcgggaagcgtgagcatcctgcccaccgcagtgggtccgccatggagagcatgaccttagagaagcaaagccgcctggctcgaagcagtggccgccctgctgacagctgtagtggccgggtggcactcgggctggggtccgggggagtctaggtggccacctggctgtgtgcctgtgcctgcccaagctgggcacctttccctggcagtgcctgggaagctcggccgccctccctggctggtgctgctctgcagccccgctcatggactcttgcccacggcctgctccttgtagcagggtcgggccgtgggaggtccggacaggatcttgaatggccctgtctgcggtcctggctggccggaggttgaccgcactggacaggtcaagggccttaaaccagggtagtgaggagcctgctgagcccctgctgctccccgggctgcctttggcgctcggacagacacccaaggacagaagctcggacagcttctaaggcgaagggtctcccggggctgatttcccgggactctggctcctgcagagagggctggaggcggggctctgtgttccagggtcagagtcctcctggtggaagctgaggtgcctgattaaatgcctccctttctaggcagcagcccagacgcggcacagagagggcctgggagcttgctgcagcttcaggtgagtttgttcccaagccctgcggctcgtttatgggtttgcttgcgctgcagaactgtttgtggagcagcagggttggagtgcccacggctggggggcctctcggagcccttgattcacagaacccctggaggccggcagccctgcctgccctgaagagcctcgttctcccagccgtttgggccgtggtcctgtcgtgggaggcgacggtgagggcggcccggggtcccgacaggggtgtttgtccctttggggacctcccctgtgctgtggccccggcccccagatggagctccccatccccacggcagcgctggggctggggctggtgaggagcctgtgcacggcccccaccgctatcctcagccaggagggtgcctggtccctggggagcggcctgcacctgtttctggagaatgctgtcctgccagttgtcatttggggcgggcggtcggagtccacgtcctcccccagggcggggccctggccttgtttcttgtagggacgatgggaagccctgtcctcagccctcccacccgactcatgcaggagcttcctgtccttggggtcatctcctccacaggggccttagcgtcagtggggacaaaggcagagttgcctgtcttcaggttgtgggcaccgactgagcttcgtcccggtagtggctggctcttgtttcctgcctggaccagcagcctctggtctggtgggtgcagttttagggcgcagtggggttgccgtggggcaaggccaggccaccagctgcctggacacaggggcccccgctttccatctgctgccccccacacccccagctcgggcaggggtgacaccggggcatccttgttggggtcgctgtggttcccatggtggcaagatggctctgtgaaagattgacggagatgtagggcccaggagcaggtgctgtgtgagtgggacacgcctgtgtcacctgcggggcaggggagggctcgggggtacagccgtgtacatgattagttagcgagacagtgaggagtgtatgcggagtggacacagctgtgggtgccgcccgcgcaaggctgggggtcgctgtgccagccctgctcccatgtgggctcccagctccccaggtagggacgctgaccccgggaggtgcctttgcctgcatccactggagcctcaggagcatgcgttccgtccccacgggtcacccccactgagcccaccacctaccgagaggcacctcgagaccctgtcctgccacgggtgggctgtcaaggccagcaccagagacccccagcagacctcagtggccgcagatggagcggggcggcaatggtcacctccgggactcagccctgtgctgagccccgggcagtgtgatcatcctggcccttctcgtgcacgtcccctggctggatgctccttgctgccctcacggggtgtgtgtgtggcatacaggacagggaccggccagttggccctgctcattaaccacttgtccccacagggcagtggcggcctcacctctgcaattctctgaggctggatctaggccaccgccccgtttaaaactagggcatcggctcccagggagggcggggagctgcacagttggacttgtgggggtcaggcatggatccacacagcccggggccctccgcaccctgcccctccagggagcccagaggcgggcgtggctgcagcctggctctgtggcagtcatgagtcacggccactcttgaggcgccgccctgagagtcagccctgtggtcacggctcctgctggttcccattcgcgagcacctgaaacagcctggcccacagcagaggcccggggggcacatgcagctcacgggagcagcacagatgcttggccggcggcaggccctacaggagcagcagcggcccagggcatgtccctggggtcaggggtcagagttcggcatgctctgcgggggcctcaccctgctgtccctcggcctggcctgggcacactccttggtgacagtgcccctgcacgcccccccccccccccggttattcagacagggagccaggatgggaaccacggactgacctgacctgcgtcctcggggccactgcactgggtgattcacgtgtgcccaggccctgaggtgggccggacctgggagtggcaggtgagcgttcctcccaagagcctctggctggccgcagcaggccctgtccctgctgtcctcagtggccctggacatgataacccccctgccgaggtctggccggagccagcacccacggccgagatgcagtcagccctggctgggcgctgtccctgggggtggctgctggtgctgccctccctccttcccaccacttcttgctcctctttcctggggccctcccatcggagtcttcctcctaaatgcagttccctccctctaggggaacgcgggctgggagcctattttttttttttttgagacggagtctcgctctgtcgccccggctggagtgcagtggcgcggtctcggctcactgcaacctccgcctcccggattcaggccattctcctgcctcagcctcccaagtagctgggattacaggcgcccgccaccacgcccagctaattttttgtgtgtttttagtagaaacagggtttctccatcttgcgcaggctagtcttgaactcctgacctcgtgatccacccacctcggcctcccacagtgctgggattacaggcgtgagccactgcacctggcctgggagccttttccgtagctgctcatcctgtactagcatctgtccatcatgagtggacggaacacagggggacccaggacccacagctgcactcgggaaggccagcagggtggatttcgggaagagcatcggtgccagtttcccacagtcacccttgcgatgggaccctcaggttggcacgtggctggcagctgtgtcccgggagctcttgctccttagtgggcctcgccagccagggcagggcccccggcacccctcacggggctcttgactcctctggcagcggatcggggcggttcagcgataccatctctggagatcccctggcgtgtgctggaaaaaccccggagagggcttaacagagccagctgtccagcctctgtgacagggacgtttgcttttctctgcagggtcctctcttctcttccgagcacccacgggaggggactgtgctgtccctgctctcctaggacaggcctccctcctgtccagatggggcccacagggtcagttgcctgagactggctccagctcaagaaaggttttctgagtgagcgcaggggagcaggaggctggtgagcagctcgcttcctgccctgggtgcagctgggcaccacttctgccttgggcctaaaggcatcagtgaggagcaggcggggcctggtaggagcctgtgtttctagcggcacgcgtgaccccaggtgccacgtgggtgagtgcgtgggtgggtgagtggcgaaggagctgaggttggccctggcaggtgtgcagtcctcacacagaacgggcagggctcctgtcagagccaaaccagctcagggcccagtgcaagcagcttctgtcccgtggcacctccgctagtcgccgctcccacccaagccctgccccgccctgacccgctcagggtttggctacagaaggggagtgtcggaaatgcccaacccgtctcccgtgagggactcctgcgtggcctgggctggggaacgcaggggccgtttgggtggttccggcgtctggcgtagccacgcgagaggccctgggttgatgcgtgggctccctgctagcgagcctgctccgtgcgtgctgggctcccggccttgcttccgtgtggcattcgagaccccgtggacctcgcctgcgtcctgcatgtttgagcgctgccccttgtggaggccgccagcactggtggctgcagggcctgtagtgtggcacgtccagagacccggcctggagaacgggtcctggatgtctccgtcatgttttacgttcgcttcacacggacgcagcgatgtctcagatacctcggatcacacagagcacgtcgccaaggcttgttttgtctgttcctttccacctgtcttacgtggataccaggagatccgccacgactcccgtggccccgtccacactgcgcggcgctctccggcgtggccgccaggtgccccttcgagggcaggtgtgagtacagggtggtccctgtggagaagcgcctgcaggcgagtgagccaggctgtgccctgctgaccccgaggcctgaatttcatggaactcccacctctcacagagtattgtttttttttttgatttttttccaaccatttaaaaatgtaaaagccattgttgacttgcgggctggaccaggcttagggctgggctctggtccgcaccccacactggccccgtgtgtcctgtgaccgttctgcctacggggcaggcctgagccaccacaggatggcagggtctccagggtgcagggcccgcaatgcttcaaccctcccacgaccccagcaccttcagagaaaacggaccctcgtgccgagtgaagtggttcaggcgaacgttatcaccacacgggggactcggcggcttctgccccaggcctcaaaggagaggggatccagaattctctgtctcaccccctcagcccctgcccttgaagcttctgtccccaaggctgtggggaggaaccagggaagggctggcgcgtctgctgtgcgatcccaggtgctcgtgcctcgctgagctcagcccctgtggcctcagagctgcaggcccctcccgggtgtcagagcactgactggaaaggccccccacatccctgccctctgctgctccccatcgtcgcgggggagaagctggaactgcacccccaccccccccagcccgctcacctagggctgcccccaggcctccctgagctccaaaggatatgttctttggtgctttttttttttttggctctgtctcccaggctggaatgcagctgtggtgctcacgccatcctcccacgtcagcctcctgagtagctaggtctacaggtgcacaccaccacacccggatagtgtttagttttctataaagacagggtctcactgtgttgcccaggctggtctcaaactcttgggctcaggtgatcccccacgcacggcagctttgacacttacttgaccctttcctcctaagctctaccctgacgctggctgtgtgtcccagagacttaatcagaagctggaagaagggctgtgacgtgtgtgacagcaggaactgctggtcaacccacagccggccagcctgccgggacgccatcttggccccaatcttggcagggagaggggagtgtatcggactctggggagagcagctgcctgcacgggcagggtcctcccgtctcaggattaacgttctcaactgtatttgatttctcctcagccagagggggtaaggtggccttcccagaagcacaggtgggccgcgtgtcagaggccctggacagcctgtgcctctcccaggcctcccagcaggggtggctctcgcccctctggaggggagaccccaggaaccggcccccgccctcagccatagcctcacagggtccttgtttctcggggcctggctctgtgggtgcacaaggcatggtcgggctcccgtccttctggaagtctccagagtggcatgtgggcagctgtgtgaagcggccccccagatcttcatccagcctggcctgcagcagctccctacgccctctgctacctcccctgcctacctttgggtagacgttctcttgacccttccttctgtgataaagcaaaagcgtgtgatctcttttctcaccaaggaataaaacgtctctgaataccacagacgtgatgccgggcttttgggggccggggggtgtcctagggccccgagggaggagccctgtgggtgccgaagtcgggccgcaggccctgcactgagatgtcccctcagcctaccccaggcggctgggcatgctgggaagtcctcccgggctgtgtgtgtgaatcatgctgtttcttctctattttctctctctgtctgtttatttttgttgtgtgtcactctgcccagccggccgtcctgtctcttccctccatgctccgcttcgcccgctgctggccagaggtgaccaggtccggctctcagcacggccgccggccggggggccatggggagctccgcctcctccctggccgcagagaccgagtcggaccacagcttccccgggggaccgccctacccgggtcccccggcagcggctggctggtgtaggagcggcccaggggggcccgtctggggaggtgccctggtcagccggcagcaccagcccccacggccccgggcccgaaggtaagaggtggggaggggtggccccggagggctcccgggggcagagggcctcgttctcagggtgccccctccttggcagaggtgcttgcagagaagtgggtccctgctccttccagttgtggcagctctcttccccagggtgcaggagctgagcaggtctgagaccccggcctcggcctggctggttggtggtggggatgggggctagtgcgcccaatcccggcggccctgtgtttctcacaggctgtgctgctccacgcagagaagctgttcctgaagcttctttttgggctggggtcgctggcggctgcaggctctgggcatattgcctgctgcccacggtttcaaagctgccagcactcgctgggctccgcctgctgcccccccgggggtcacaggccacatggcttggtggccgaactccacgtgctggctcctcacagctgtcaccatggccttggctacccgctgcgtccctcaggagctgccatcaggttctgaggtgcctggtctggaggcagtccaggtggtgaggtctggactggctggaccccaccgatgctcctgccgtcaccccgtcctggccctcactggaggcagggacactcaggggcccggggcctcggggccagtgctgcagtggccgccgttgctctcacagcgggtccaggcctggcttctgaaggcaatgtgcctgcgtctcacactcaaaagggcctgccaggctgcacctggcggcagctcccacgggggacgatgtcctgctgtctgttggcccccaggtgggagggacgggcgtggagctgcaggcagtgggcaaggccatggcaggtggccaggcctgggaaccagcctccaggtggcatccacgctgaggcctgagctccggccgacaaggactggggatgcaggggattagccaggggctgtgtgggggagccctggagccctgtctgcgagttaccccgatgaacagggagacgcggcagaggcagggccggggaggggccgtgtgggggagccctggagccctgtctgcgagttaccctgatggacagagagacgcggcaaaggcagggccggggaggggccgtgtggggcctggtggtcggcagaggaagggtctgtgctcctcctgcgtgtggtggcaccggagcgcctcccagttcctggtgttaccgcaccagccgcctcccagtgagcatctccacgtgtgccgacaacagctttgttgaggtagaacttaccagactcacctgttaaaagagtgcagtttggtcactcttagtggtttgtagagttgtgcagccgtcattgcaatccagcgttgcagcattccacagcccacagggacccccagccccacagtccagtgttacagcatcccgcagcccagagggaccctcagccccagacggccactgaccggcttcctgtcttggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggatgtggggccacaggacgtggctggctgggtttgccttgtgcagaaggtgcgtggacgtggggccacaggacgtggggccccgtgtctggcctcttcactcggcaccgtgccctccagattcatgcacctgcagcccgaggcagtttcattcactgctcctttgcgggatgaaccgcattttatctattcatggacgctaggactgcttccacgtggcttctgtggacaatgctgtgaacattgtttacgaggttttgcgtggacctgttttcatttatcttgcatagatacctaggagtgggattgctggggcgtgtggtgaactttcataatgtcttgaggaactgccaagccatcttccgcagcggctgcattacctagttcccaccggcaacgctggggagggtcctggcgtctccactccctcgacagctcctgccgttgtctgtccttgtgattctggccgtcccagggggtgggagctggtgtccccttggctttgatctgcgtttccctggtggccagccatgtggggcctctctccctgtctcatccacccgtgcctgtctttttttcattcattcacttatttatttatttagagacagggtcttactctgtcacccaggctggagtacagtggtgtgatcacagctcactgcagcttctacttcctgggttcaagagaacctcccatctcagcctcccaagtagctggaactacaggcgtgcaccaccatagctggttaattagaaaaaaaaaatttggccaggcgcagtagctcacgcctgtaatcccagcactttgggaggccgaggcgggtagatcacctgaggtcaggagttcaagaccagcctggccaacatggtgaaaccccatctctactaaaacaaaaattagctgggcgtggtgacgggcacctataatcctagctactagggaggctgaagcaggagaatcgcttgaacttgggaggcggaggttgcagtgagccaagattgcaccactgcactccagtgtgggcgacagagtgagactctgtctcaaaataaaaatacaaaccctgagcttgggagggtccaggctgcaatgagctgcgatcgtgccaccgcactccagcttgggcgacacagtgagacgctagacggtgtctcaaaaaacttaaacagaaaaatgtagaaaggattgtcgttccctttctcgttttccagagggcagaggactctcggcccctgctttttgagcaccaggccgagtttcagacctcgggatggcctctccagtctgcagctcccggcagcctcgggccacactcccgggatccccagggactggcctgggactaccgggggtggcggccgtggctctggctatggggagggaggcagagccgcggggcaggcgtggggtctgctgtgccgggtatgtggggcgtgtgttagactttggacctggcctgcggggtcaggccgtggtgtatgatgacgccacgccgctctttctctttcaccctggcctcctgcctggccctcccctgggtcggcatccctggggccactcctgcccgtgcccgctgctgtggggcctgggctccaggcagctcctgtctgctgctgcaaacaggcccccaaggtgcatggtgaggagacccccaggctagagatgggcgagagcggtgggcgagcagactgcgggaaggcagctgggcctccacacgcggagccctccccaccacgtgcatgcacaggcgacccctgccgtgctccgacggagggcgccgggactggggagggtcagcgcgacagccctggcgtttactgaagagctgcctgcctggctcgctgccctggtggccgctgaattctcccaacgccccaggacagcaggtgctgtggccccatgaccgctcccccacatggatgaaggggtggtgcacaggctggtggagcctgggagagccagggcagcctgcggccatgcggccatgcggccggcgtggggctgaggtccctgtacagctgacagagtgcctggcgccctcaatcagtaagtcatctacgggccgggcaccggcggctcagcacagagaggcaacaagggtagaccccccctggcaaggctgaccggcgccgggctgtggccagaccaggagactgcagcccagctcgagggaggcaccacgcctgcccctcagagcactgagcagagccccccatggtatcccccgccctgggcacagcaggaggagctgccgaccaagtctggcaccccggtgtgccccgagagctgtctgggcacaggttgcggggctgccccggccggacggggcatctgtgtttctcggtgtggcctcagggctctggtggctttgaccgaggccccgggggacagaatgcagcttcctgctcctcacttttcctaagaaaggggccgcctcccaggactggggctgcgccagtcacaggcccgcggcctccacgctccgggtgctgctgtcccggctgcttcagggcgggctctgtcttgcacgcagcgagcggcttcatcacctcccttttgaattggagctgagtgtcggcaacgcccagataactggggcgcgcgggtcttttgtgctggatttttctgtacagttgcctcgatcttccatccagcttggcctctgtgcagtaaggagcggcccgtcgcctcccccacgtcgcctcccccacgtcgcctcccccacgtcgcctcccccacgtcgtcgcctcccccacgtcgcctcccccacgtcgtctcccccacgtcgtcgtctcccccacgtcgcctcccccacgtcgcctcccccacgtcgcctcccccacgtcgcctcccccacgtcgcctcccctcacgtcgtcgtctccccccacgtcgtcgtctcccctcacgtcgtctgccctgagcccgctcccttcgaaggtaaccatcctgcagtagtgagggctccttgctgagcacgtgtggctgcgacttcaggagcgttctgggttgagaattccaaaagggcttcgctcaggcctggctttgggtctttgggctcctgacgcgagcttttacttccaggctttggcggtctggcctcaggaggtcaaggctgcagtgagccgtgcgcgagccactgcaccatcctgggcaatcagaccccatctctaaagttcaaaacaacatctttgtaagggtttcgggtctctgagcccatgaacctgcccaggccctgcagaggtgagggtggccctagagtggctggggggttgtggagaccagaaccagggcagaagggcagggagggtgggggccctgccgaggtctcccaccgctgacccctgacccctggcccccttccacctcggcccaccgagagaggccggcacagcgcagactgcggggtcagtgacactcccctcagcgtctccagccacagaagggccgtggcctgccttcgccctcctcacccgtgtcccggggccacgtttgaactttaggccttgttctgacttcattgaaaccctcctgaagtgcagacgtcttcctgacccacctgggttttgccaggatgactccgaaaggtgtctcccagcagacacaccccgctggcgattgtttggtcctggggacccgggttctcattctcctctctggagctggtgaggctgtccttgctagtcggtgacaactacagggccaaagggagggtgtgtcccaggaggcccagcccacctctgcctgcacctgcggtcagcggggtgcagagtctgtgaaggcacctcccggagtgggggctgcaaagatcatggccactgtgccacccacaggggcccaggccggacgcctgggctgtgccgcctcggcagccaggccgaggaacgtgcaggtgcggccgggagcccgccggccacagctgcatccatgcccttctccgagtggtgatggcggggagaggcctggctgtctacgggcagattgcttgggctttcacagaagcccgctgttagagcagattcccggccttgggtctctctgctccagctggacgccctgagcctcgccgggcccagtccacccccgtccactctgccaggggcagctcagagccctcgccacgcggggctgagcgcagggaaggcagcatcacggagttcgctcggctccacagaacacccgtgttgctcgcggagactttttgtttttgtgcttcttatgaagaggcaggttttctttcttcctgaaccaaaagggtttagatggagcacaagattcaggccatatttacaagaacaattgatttttctgccaggcagagcagccagtctgtctcggaggctgtgctgtggtgtggggaggccccttgctcagatcagcctgtgccttccccaggccccggcccatgcacctgcccttccgtaggtctgagcacctgttcttccacgcccaggacgacctggtcctgagtttggccgggaccccctgctatctgccgtccacaggcctggtgacagagaaagcagtgccctggaacagcagcccggctgtggggtgctcagccctctctgtaggatcctgtgtggctcaaggggtctgctgagcctccaacgggcaagaggggccctgagccatggatccattctgggtggaggcagcccccaccgccgcctgcctcaaatgctcagccctaggccctcggccccgtagctctgcagccacagacgggtgccttccccaggccgagaggagggtggggtccagccactcaggacctcacagggtggccctgatgagcaccttcccttgcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggaggtgaggcgccccctcgccctcttcctgctcctgagcctcctgctcccgccctccccttcctaggctttgggctctggcgatgggctggggaggagcccacaaggcctaagacgtgatggggagggcagcaccctccgccccgaggctccaagctcccaatggccctggggtccagcttggcctcctgacccttggtccttgctggtgaccgagatgcacgaccttcacccccctcaaccctccaccgtggccaggagggccccgagccccgtctgatgtgccgcaggaggcgagggcttcccaggggcagcgtggagaccccgctgaagtgcgaggtcgggatgtacccgtgctccgccctctagagtccaggatggcatcacccacgggtcaactggggcgcagcctgcaccctccccagcagggccagggccagagtcgtgctgccacccactgggggctgcgctgtccccctgggcccacacgtcccctgctcctcacctgtcgccagccggtggcctctccactagggctgagggcttcctcgacacagggccggcgccaggtctgtggctgtccacgctccacccgtccctttggggctcaggcagtgcttttgggcgctctcctgggtggggtcttgtccctgccaggtggagcgaggccaccctgcccagcctgagcacatggccgtggtctctgcagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggtgaggccttctccaaggccggggtggggcgggtgggcgggcgaccggccgcggtccccgcgaggtcaccctgaggctctgcgcaggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggtggggcggcctgcagggtgggcacgggcggcaggggcagcctctgaccccagccccgaaaacaaggccggctgcttcctcttctcccagggcgggtagtgtggggggcgggcgggggtggcctctgacccggccctctgcaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggtaagaggaggggcactgcgtggtcagccgcgttgggaggagaggcgaggcggagcggtgggagatgtggggctggtggcccctgacccagttctgcttccacgaggtgcccctggcgtgggctgaccccgcgtggccaggccacagccccaatcacctccccctccctgggcggggctggagctggccttctcatgccaggaaggccacatcctggccaggccgtggggcgagaccgatgccgtcaccccggagcaggtgtgagcggcgtgtcgagtttgacctgggccgtggggcgagactgatgccgtcatccgcctcggggcaggcgtgagcggcgtgtcgagtttggccacactctggtcagcgggtctgtgcctcgacccccaggggcctcctcggagtgccccggtgcgagcaccttgaagctcccggagccctcctctcagctgaccctgggcagtgctgctgcccaccccccacccgcccgggagccacagagcccagagccagccccacaaggcctccaggggacccaggcctgccacccctgactcaggccctgtgcgcttcaggcatggtggagggggctggtccagaccctcctgaacacttcacgtggtccctacaggcaggagtgggcccttctctgctgcgcctgcctgtcttggtggcaaggtcgcggccagcgagggcactggtcagcaaggccccggtcagtgagggccccgctcagccatgcccccagtcggtgagggccccactcagccatgcccctggttagtgagaccccctgtcagtgagggttccctgtcggtgagggtccccggtcggtgagggcccccagtcggtgagggtcccggtcggtgagggtcccctgtcggtgagggtccccgtcggtgagggtcccggtcggtgagggtcccctgccggtgagggtcccggtcggtgagggtcccggtcggtgagggccccggtcggtgagggtgccccgtcggtgatggccccggtcggtgagggtcccggtcggtgagggtcccctgtcggtgaggtccctggtcggtgagggtcccggtcagtgagggtcccctttcggtgagggtcccctgtctgtgagggccccggtcggtgagggtcccctgttggtgagggtcccggtcggtgagggtcccctgtcggtgagggccccggtcggtgagggccccggtcggtgagggtccccggtcggtgaggtccccggtcggtgagggccccggtcggtgagggtccccggtcggtgagggcccctgttggtgagggccccggtcggtgagggcgccccgtcggtgagggtcccggtcggtgagggccccggtcggtgagggtccccagtcggtgagggtcccggtcagtgagggtccccggtcggtgagggtcccctgtcggtgagggtcccggtcggtgagggccgctctgccacacaggttcctcatgggtgcctcctgtggcgggggcaacatgaaggtggacgattcggcctacgagagcctgggcctgcgcccccggcatgcctactccatcctggatgtccgagatgtccagggcaccaggtagggccggcctggctgagggtgggtggggtgccggtgagactcgggcagtgtggttcagatcctcacccctgtggtctgcaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtatcggcaccgtggggcggtgtgcacgccgcccccgccctcctagggccgagtccttctctggagaacaagcctgtccctcctgctgacctggggtggggcggcttgttcgtggcccaaatgggacctggagcttcagctccaaggtgccaacctcagaattcaggtccacccaggtcagcagattccagcgccctgaagagccggccctggagggcttcctattataggcctcagggatgggcccccgggggccgggctgcaagaggacggtgacggagcagctggcacctgctggggtcaccggcctgtggttgcggtaggcgctgagccacggaggtgtgggccgtggtaggctcagggccccgtcctcccgccacctgcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggtgggtgctgcggggccccatcgggctgggctgggctaggctggcggccgtgaccacgcgtgaccctggcccgtggtgtctggcgcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccagggtacgtggcccctaccccaggctcatgccccaggcccacggggagggctgcggttcacacgcccgtccttgtagcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgaggtgggtgggggtcccgggggagggtggcgtggggcagggggagtatgccccagcacctcccctgccccacaactgccattcctgtgcccagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggtgcgcccccgcccctgcccccccacccctgcacaggtgccccctcccctaccccgctgcacccacacccaactcgtgcccccccacccctgcacaggtgccccctcccctaccccgctgcacccacacccaacccatgccccccccacccctgcagaggtgtgctcatacccctgcccccacccctgtacgggtgtttgtcaccccactcctgctcctgcccctgtacaggtgggcacagccctgcccccatccccaccctgccctccacaggtcctcaccggtcccctcccccaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 438 - DNA, 30553 bp, Homo sapiens
ctttctgggctgtggtgccagcatggtgtggaggaagaacccaagactggggttggacagcaggattccagccctgttctgccgccagtcgatgaccagtcagtcacctatcccctctcgcagaaaggaagattcggctcttggaagtgtgggaacggggtgggggatgggcagcgccctgctccgggagccgagggttttccccgccagggtcaggcctgggggcggggcggggcgggggcgggggccaggccgtgtgctctgcccagcgggctggctcaggcctcggtcagcagccgccaccgcggggccaatccggcctcagggacgcaccggagccgcctttccgggcctcaggcggattctccggcgcggcccgccccgcccctcggactccccgggccgcccccggcccccattcgggccgggcctcgctgcggcggcgactgagccaggctgggccgcgtccctgagtcccagagtcggcgcggcgcggtgagtgctggcgtggcgcgggcggcgcggggtggggcggcctttgtctgctgcgggccgggcctggatcccgcggaggtccgcacgttcccgctcagggctgcaggagctgagcagggcgccttccctccgggctcctgctcccctgccctcccccaggtccgggcggcccccctcgcacaggagtcccgggaaccgcgggcgcccctcctgccctgggctgtggggcccgcggagagctgggggctcccggatcctaccccgcccccctttcctcgggttgagaggggcccgggcgccgtcggacctgcagaccccggaagctgcggaccgggccgggtgggtgaatgcgcttttgcaggccccgggtctggagcgggcatgggggcagatctgtcccgtgttgaagcttaacgaagccaccggccggcgctgggaggttagcggggtctcgggtcctgcagaggaaaacgcccagctccgggaggggagcggcggggagggaaggcgagtggttaggcgtgtccactctgcagggcccagcagggcgaaggtgtgggcgactggtgcacttccacaggcagccgtgggcagcatgaggggtcagattccgggaaggacaggtagagacggctggcaggggccacggggtgaataggtgttgggggtggggagggaattgggatgggcagtttgggcttgggaagcctcagggaggtggggggtgaggtgggatggagaggagatgcgggcgacggtggagggaggtggggaccccgagtgggggcacactagaagggaggggattgaattccagcgcccagggccctccctgcgaccgtttagctagcgaattggcaggtttggcagcctaaggcaggggatttatttctaagccaaacctgctctaatgagaaaagcgtgatagatgactcagatatgggatctatcactgagggaaaacattaagcaaatagtaaagcaaaaaagatttgtgtgtgtgtgtgtgtgtgtgtgtgtgtgtgtgtgtgtgtggcgggtgggggggtgttagttgtcttaatttagaaaaacgatttaccttcaaattggatgtggataattgtaaatgagtctgatctcttcattaaagcccggggtccttttcttataagcatgtcttcagcagttagtttctatattagaaagtaatgaagctgctttgtctttaagagagttctttatttagtgcggcctcctctagttccctctggcctcccagaagtccctaggaaatctgatgctgtgcagccttccttgtagtgtgggggactgcaaataggtgggacagtttgaggctgaggggaactgaagtctaaacttgaagtctaaacctgtccgatgggttgagctgatctgagtgcagggcaggatggagggctatggggctgtagggtatgaagtggctcatttcaagggagtattttgggtgagtacattttcctgatatctggagttcttgagattaagcactaacacttagggtaactgttgaccgtggaaatttacatacgtcaccgtcagcttactggagtatcctgatgtgaatgaaattttccttcatgactttgggtcagccctgtggacctcagtttttgttctgaggggttgtatggcaaggggacgctggcgggagagagcttcgttcctgcattaagtggcctcagtgatgcagtcagggtcccatgactgacctttggagttcttccatgtccttatggcattactggtggtttctcctgcctgcagtaagctttccagcttactctagactcctgtgctgtgagacatgagcttgtcagaggtaaggagcctgtgttaatgcaagtctcaggtgagaaggggtgttggaatctgaggaccctgttttccttcctgtcccctcttcagctctgtccaggcaccacccgatggagggttggctgaatgtctcatgttcatatacctgacagctggcttcggtgctttaatatttatggaaaggacagttatagaagtgtggtcccttcaaagtagtcctctggggtgtctgtgtccttattaggttgacttctgaaacttcctgtgagaattccatcattaaactttggctttctctggaggggtaaatctttgttctttggagtaggatttgagtttgacaaggagctggacaatgctgtttggagtcagagatgcagtgtgataagagagctgtgagttggaattccacagcacctaaagagactcctagaaaatgttgtagaacaagtggctggatggtacttggttgcacatacggggtttggggtctgtgcagaaaaatgaccaaatccaagcagcctctgagattatgaccacatgggggctgttaagctgtggatctgagtcatagggtcagggaaagaggaaaaatggcaaggaggatgacgttactgcccatgagcttatcctctgagtgggtggcgacttctcattgtccttttcccacatccccagggcaggagtgttagggaagtccaccagcaaaagggggagggcacacccagggcctaggggagggggagaggggtgaggactggtccacatgatttttgagaaattgcctttggtcttgttggctcagaatggaccccacacctggaagggggccacgtgtacagttatgcaacccttgcctgccacccccagttctaccgcccttgcagtgtgccagataggagcattgggttttcaggtttgggagtgggtagggttgtgctggaggctaaatagacattatctcatgtaatcctcatagtaatcctatgaggtagggtatcattaacaccattgtacagttggggaaactgaggcccagaaagggtaagtcacatgcccaaagacacacagccggcaaatggtggagctgggctgttgtctgcttccagaactggctttttctgctgctctggaggtaggcacaggttttacccctctttctggagcccggtaagatgtgccaagggtctccttagtaagtcagggaagactcatctggggaaccagagaaggggcaggcctgacctgggtgacccagtgactagtggccttcacagcatagtcagggcctttgctgagagttcttctcttccagagccctggactttatcatgctggggcttccaggagttccccctccaccctccagttctgaccagtgctcccagccagctgccccctttctccctttctttctctttgtggtccagagaatgaatgcctgctccacacaccttatgccattgggaatctgaccttctctaggcatagggagcttaatctgcgggaagtggagtgagaagcatttcttgctgggagccttggagcagggagagatactgtctctgggaggcaggggtcccaagttaccctagaggcaatgcaggctcctaggaactggggctgccttgtgggagacattggaatgtgtccctgtgggaatgctctgtgctaggggctatggcagcaggacggtaggagctcatggtacttggaactgtgaccaagcatctgcgaagaggaaggggcccaggaccactagaatgagtcagagccagagatggagtcgagttgtgcatttgctactttggagctggggcactgatagggctctaggtgaaaagtagggatacagaaggagtaatggtcccagaggcccagatgtgtggcctgacagaggaggtcttggccagggagagtggggtaggggcaaagtgttcgctcagtgcagaggccccatctaggaggccttgtccccatgcttgcggcaataataacagcaataataataattattactgcagttttggtactgggcactttcctaagtcctctctctctattgtcttattttattctcacagcagccctgtggggtagggattgttacccccattttagagatttggaattgggtctcaaataggttaagtcatttaaacttggtcatgtgttcagcaaggcatcggtgtcaggattgaaacccaaggctgctggcttctgagctcatgctgtaccctgggcaggcaaggcagcctggtgattccattcaataagtgaggaagagagataggagcatcagctggctcttagtcacttctgctggtggctgataattgagtgtgggcccttggccagccggccaccactctgggtccagatttccatctgtacaatgggcctggagctaggcgctggaccaggtgtaccgtaagaggccttctagctctgaggactggtggagattgctacactccgagaggggtctggtgcttagatggagaggggtcggcagagttgttctgctaagctgagcctctttcagggtagaaaccaaaggaatttggaggcaaggaggcatttaggcagatcacatctggagaaaatgcacccttccttgagtgcagtctggaaaggcttctggaaaggataggatttccagatatgtttaggtgggcacctagcaggactcagcagatattgagtgaatgcagatgtgtgtgccctgggcctgccagtgtctgacccgaaatctgcgctctgatgtggtctcatgtgctctcatccctttccttcctctccctattctccttgttgccatcccttcttttggctggacctcctctgggcccaatgtagctttcacttttttcagggctctgtgcctcctgtgtgtgtgtgtgtgtgtgtgtgtgtgtgtgtgtgtgtgtacacatttccacatgcatgtataggtcagttttgcagcccctgcacatgcctctagttccagggagaccttagccctgctttgctggccagccctgatgacatactactgtcctgactcacacagaaatcgcttggagaggaagaactgattcctgctcttgggtgggatcacgggactggggagtggtgcccagtggacagccttgaacataaaaggcccaaactgactcagattatcaggaaaaaggaaggcaaacagggaggctgttcccagggaactctagggaccctcccatctcttttctgaggctgctgcccatttatagagcacctagtattaactaggtcagttttgataattttgctcattgagtcctataatcatcctatgagggtaaggtttataatccccattttacaaatgagcaaactgaggctcagagaggatattttcataaagtttcattactaggaagtgacagagtctggatttgaacctgtctctccaactccaaagtcatcttcttaaacactagtgctaacttcttccatgaagcttcttgtgattacaccagcccaacatgcgatatggtcacagcatgggatggtggtcaggaccctttgatggttgaggagatgaagacccagaaaggcaaggggtttggcctagggagcctggcaagtgagtgacagagcctggtctaaagtccaggatatctctgttgttgctgttttccttttttcgttaattgcaaaagaatttacatgttcatagttaaaaacagagaagtgtatcaagtagaaaacagtagcaaactctcacccttattctgacactccagagttgcattcactctcaggcatccagatcctttccccatatacaaacatccatccatccatatatctatccatctctctatctaaacacacatgcattcattcgttcactcattgaatcgtgcattgagaacccattatgtgccaagccattgctagaattaaggatgcaatagttaaataaagcagatgtggttccttctcagggaggttctcatatatcatgaagaaaacagactgggtgcaatgaatgacagggtccttcttagagtggcagatctcttacctggcttttctgtcaaggtgaccctcagaatatggaggtgttaccttttatcttagtccatgttttactgctataacagaataccacagcctgggtaatatataaagaaaaaaaggttatttggcttgtagttctggagactgggaagtccaagggcatggtgctggcatctggcgagggccttcttgctgcattatcctattgtggaagggcatgtgagcgtgcagtacagacagtatgggggcagcacttacgcttttatcaggagcccacttttcctgtgataacagcattaatctcttcacttcttacaggccccacctcttaatactgttacagtggcaattaaatttcaacatgagtcttaaagcacccatgtcatctaggaagaagaaactgtatttgcagcaacactgtgaggtaggaaagggagtcctatgttgtaggaactggaagcagcccactgtggtgaggggcaagtaggaagaggtgaggctgggcaggtgggcagggccagggcagatggggctctgtaggctatggaggagctgcgatcttatcacaaggaaagtgaacagccctatgattaactattgaaggcagtgatataatttatgcttttatattaatagcaattattctggctgttgtatagagtatagattggagaacagaattgggtgggggaactagagaaggtgaacagactggtgaagaggcttttatagttatccaggcaagagatgatggtgacttggaagaccaggaagagaagcaggggtagagagaaatggagatagtgaagatatagcagacatatttgaggagtccttcagttacagataatagaaaactagctcaagcacatttaagaaaaaaaaaaaagacttgtttaagtacctaggcagtctatgtgtgcagcttgcttcaggaataggggcttaaatgatggttttagggctctatatccttctagcttccatctctgcctctgttcatttgtttggatcaattctttagattgttggtagcagacacatttattgctaacagtcccagaccgtatccttcttagtaatctcaacaagaaagagtcttttttgatggctgcagcagcaaggctctggggaagtctctgattgggtgtggcttggcttacagctcattctcgaactaatcactgagtgggggcagggcaggtttctccatgagccaggtcttgtaacatgcccaggccctaggctgggaggacagctccaccagtacagcatggactgggctccctgcaggagtgcggagccttgctaccagaaggggccagcatagaccaagagaagggcactgtagaataaaggacatggagcaaaataactgtgttaagactagctaccaaagacggagacgatctgctcggcattgaatttgcctctttgtcaaggaaagaaggagcagaagatgttaagaaggaattgaagtttaggccatacggggaggtgctcatctgttttaactgtatttgtcttctggcccctgggattgcctgtcctggtgtggggtgaacttggagacagaatctctgagaagctgtcagggatatttcaggccagtctagggtagaagagggttggacacgtgggtcacagtattccacagtttcctgctgtgcacagattcaatccgagtccccatctacgtccctcactacctcccttgcctcctctcctgagtctcagcctctcctggagtcccatcttcccagaatatgctgtggacatctcctcttctgtgacttttcatgctgtcccctccgccagatagccgagatgtctcctcctctgtgcagtccttactgagcctccccagcccccagtgaatggcttgaccctttcatccaggtttaagcctactgcctcgtccattcccacaataccttgtataaatgtgtaccaaaaaactggtcatattctattttaatgatatatttgtttcctaaaccttttttctatttttaatatgaaaatgtgggattttaaatatgccatttagcagctctgtaatcttgagcaagttattaaatctctccatccctgaatttactcctcggtgaaataggataataatagtacctacttcacagaattgttgggaagcttaaatgagttaatatgtgtaaaagcatttagaacagagcctggtgcatggctttcaacaaaactggcctatgttattattatttgataaaagcaaaataatatatataacatgggtaacttttgaagcataataataaacatacctcccaacttgagaatgagaacccctgtagttgaatatttatatgtacgattcttcatctccattcatattgcatgcatggccaatgcctggcatgtggatcatgaataagcatttgttgaatgaataaatgaacaaatgccagaagacttgagacagggaaataaccagttttatggggaagatggtagattatgggaacaacagatcgataatcttgttcttaatccttgacaaagtcctggaaccaatgagcacttgaagaagagcccactagtaggcacttgcatggcttcactggggttttgaaaatgcacttcttttcttgttcttctccagttgattggtccccagccagaagcagtgaagcttctcatgacagccctggggatgagatgggtagatgggagctgggtagcagcacaggtaggaacactcctaaccccggtgtactgaatggtggatggacattgatcatccagggacagatggtgctgtgggctttcctattcctgtcctctccctgaggaccttgatgacacccagacaccagcagagagaggagagtaaccttttcagatgatattcattcattctttttttaatccaccaacaaattattgagcattgtctatgcaccagaacagtcaaaagagtacttcaaaagatcacgacagggttacacagcattgtaaatatagttaatgctgccgacttatacacttaaacctggataaaatggccaacttcatgttatatatattttacaacaatgaaaaaaatgttgtggcagttggaggaatggactcagtttaactgggtgaaatggaatagtaacaaatgaaatatcctgtaaaactcctccccattctgaactccatcagaagaggatggcagaggtgtggattagcagcaatgagtgtgagtgacttctgatggttggctacagatttgatagtctgttattttgggttattttggtgaatggtgtgacatggctgctcaatggtgacttcgtcaaggaagatcaaatacttgcagggctttgataaggaagggggcagactcattctgtgtggtccaaggggtcacatgaggactgttgtgggctgtattgggagacaaatttgggctaagtataaggtagagcttctcaccgatgaacgctgtccaaaagcaagtggatagcccatgcaggccatgggtgcccatcacgggagggcaaacagagattgtgtgtatgcggtgggtggggggaggggcagggaaaggttccctgttctgatacttgatcattaatttctgcagtttccccagaatttgttctcatggcatcatctccctcagtgaccccacctttggttctgtcaccaccactgcacgaatgactgccatgtccctctgttctgagctgcagctcagtgtgtctgggagtccataggacattttggtgtggatgatccatagtcgagctcagtaggaactgatcttccccctccacgtgcttcatctccaggtctccttgttatgtgtgtccatgtttgcccattgctcaagccttcagtgccctcttgacaccttcagcccctccctcaatacaaacagtccccaagcctggtcacttctacccttgacatttgtccaaagctgggctcaggcatcactcggtgactctgatgagatagtctcctgttcgtattttgagatacctattttagatgtggtttccttttgtggctctgagcagtggcaatgctcatcgggtacggagacggggaagagaaggagggaaagtaagggtgggatggctccttagttagttcagatgctgtaagaaaggcccaaaatagcaatgacttatgctggaagagatgtttatttctcacccatgtgaccatctgggtatatccagggctgatactacagtccctcagggttcttctgtctgctgctctgccgtcctcagggtgttgcctttggcagtatgatcgccacacacaccacatctatgttccagccagtgggaagggggaggggaaagggaggggagggcatgcttctctctttcagggcatgacccagaagctgtacacatcagtgtacacattgcatggccacactcagctgcaagtaaggctgggatctgcagtcgttagctgagtggccgtgtgcctaactaaaaatgctatggaagaaggggagagctgggtgtgctggcagcacctgtagtccctgttactcgggaggctgaggcaggaggatcacttgagcccaggagttacaagggtgcagtgggttctgattgcaccactgaactatgatggtaccactccagcctgggtgacagagcgggaccctgtctcttaaaaagggagaaaatgggtgtaagtggacaacaactagcagtttctgccacagtcactttgtgcatttcagtgggaactgtgtggctgtgaactggttaagccttaaggatatagtccctgaaagcttcaagtactgataaagttccactagcatccacaaagcttttcttttataggtaggaacactgagctcagagaagttgcctagttaagattgcataacaaagtgtcagagctgggaccagaaccccacactttgggctcattttctagaattccagggtgatctggctgaggggcagacaggcagtgtcaggaggacgggtctctggagttcaggaaagggttacctttcccagcgcggctacctggggagctgctcatgacttttcagggatcatctctggggttatcatgcctctgaggtgcctccaattcgccctgaccatatcataaatagtatactataccaaactgcagtgatctaactgcatgtcccccttccctattagaatctgctccttgaggacagacgtgtaccttagttatctctctgcccctagtacgtccctaccaggaactccgtaagtagtgaaatgaattactaaagacatgaatgcatgtggattcaaggactccttcggttgcagacaatagaaacttagttcaaactggtttaagggaaaaaaaatgattggctcaaatatctgggcggtctaggtctgcagcttgcttcaggcatagctggatccagggacttgtctgacattttcagaactttgtgtctttctgaccctttttgtccctttgtgggaagtgttgcccaaggagcccctgcggggattgggaggaagtagggggttaggaggaagtggagtgatgtgggtgattatggtggggggcaaggagaccctcttgggcatccccaggcccagggcattttggccctgagcccaggtgcagtctggatttgttgtagctttctgagggcacatcttgggtcatctcttgggagcctccctgtggccctgcttctgcagggttggatgcccttgctgtaccttaggctgaggacagcctgacccctctctcctgctgctctgtgaaagccgaaggtgctctgtggttttgggatagagcaggaaggagaaggacgaggagtgggcactggcaggtgactcaccgggacgggtggcacatgctgactccagggcaggtcccggctggggatgagattcccctttgtggaaaacatgggtggagggggtggtacgcaggcagcatgaggcctgcgtggctccacgtggctctgggtcccgggccgaccagctctgtgttcacaggacactctcccattctccagggagcacttcctttctgagctctgtctctttctcctgtcctcagctcctccaggcccagctgtcagcgtaggggtctctgggtgccgtggactcttctggtctctttgcttctgggctgtcaaactgcttctctccagggcaggtttccaggatccagagtctaggaaaggaatgaaagggagcaagtccagggcgcagccctggaagtccctcatcttccctctggagggaagcgcagctcggccctgggagagcctgggtaggtctgatcaggggaggtgccctctgctccctgtacctgcccagagtggcaggaattagcctgatatatgaaggagacaattatatgaagagtcttgagtaccaggcagaggaatggggtctgacttctatagtgaatggggagccatgggaagttcttgagcaggggagggacatgagcagattcctgtcttaggtcctaagagaaggcaccttagagaatggggctggcagggaaagagaggagcaagcagggccagtgaggggggtgatgggtcagggtgggagatggaagcttgagaagcagtgtggagagtgagggaggcggcccaggaagaacccacaggccttggttctgtctggggttaaagagaggcagggagatgtggaatctgggcgttcgttcatccttagccctggtgcttcccgcaggggttgggcaggtcctgcaggcagctgcctgctggatcttcctgtgggcctcagggtggcccttgtggggcaggatgtggtgcctgccaaaggtgctttatgaatggagccggggaaggctgctgactcagcaggcagtaaggctttgaggccggaagcgtctggaaaggaagtggctgctcagggcttccccactgtagacagctgggagagaaggggggctggccaggatgcacatggtttggctgagggactcccttggcccagctgctgggggtgtgtgtgtgtaggagtggagggtggcggggggcgggtgtgcctggctgggattggaaggattgaggctgggcgcctggaatggaattgaggctagcagctgttgatgaggtttgctccgtggaagggtggaaaggtgtagcagaattggactctttttggctgtgctgactggcaaattacttgacattaacaaagtcacttatctgggctttaatttttttttttttttttttgagacagagtcttgcagtatcgcccagactggagtacagtggcgcgatttccactcactacaacctccgcctcctgggttcaagcaattctcctgcctcagcctcctgagtagctggtattacaggcctgagccaccacgcccagctaatgtttatatttttagtagacacagggtttcaccatgttggtcaggctggtctcaaactcctgacctcgtgatccacccacctcggcctcccaaagtgctgggattacaggcatgagccaccacacccagccatgggctttaattttttaaagtcctgcaaaaataggaccaagtgttacagcctatctcccagggtattaggaggacgtgaaatcatttctattcttgttgatcagtgttggttggcatagatgtggcttgatcaggacatggcacaaatgtttaggcagcagctgtgggactcagggacaaggtgtgtgcagcctggagggtggctgggattgggagcagggctggatttagggatgtctgcccttctcatccccagctcaggcctgacctgcagccacagacttgcctcttactcagtcctgactccagccttgaggtcatccccaagtccttgcctcttccacttctgatctgtcttggtcactcaatacagatgtgttaagctagcaaatgttctctctctgcattcccacactcatacacctagtcgcctcctaaaactctgtcctagaagcttctttgcaaatactgctgatttcacacaagctatactgaacccttccattttctctgcctcagtgaatgctccaccctgtcactgaggctcaaaaccacggccaacctgactgctctttctctctacccaagtcctcagatactgtcacttttacccagacatgctttgtctcctgtctggcccttcatttattccaccactataccttcctacagggatggctatattagcctctttttttatttttattttttgagatcgagtctggctctgtcacccagtctggagtgcagtggtgcaatcttggcttactgcaacctctgcctcctgggttctagcaattctcctgcctcaccctcccaagtagctgggattacaggtgcccaccaccatgcccagctaattatttgtatttttagtagagatggggtttcaccatgttgttcaaaccggtcacaaactcctgacttcaagtgattcgcctgcctcagcctcccaaagtgctgggattacaggcatgagccactgcactcagcctgaaatagcctcttaactggcctctcccttgccctgatacaatccagtctatgctgaggagctagagtgggttttaaacattgttacctagattatgtgtgattaaaatgctccccagtgattcccattactcatagaaaaacccaaattcctcactggtctctcaaagccctgcttgatctggctgaaacataccctcccatcagatagcgggtggaggtgctgtcagattaatcttcatgaagctcagctctgaccgtgtatttcccttattcaggaagcttcagtggctctcaactgcctttaggatacatttcacacctgtcagcccatctctaagtctggcccccacaggagctcctgctctgccctaccagctactgtctgccaaattgatctgcacacatcctagccccagagcaagccaaccttgccttcacttgccgccttgcctcctcttccttatatttggatactaacatcttagctgaaagggtggatcccagctgccccctaccccatcttccctgtcaggcctccccagggactccctgccaagcatctgtcaccaagattcctcagcagggggcccggtgggatatgggaatgaggacctcccagtgggcagttgcagccttccccactctggtccaggagagatgaggcaagagatggtctggggagaacctttggagacaaaggccttgcgtcctctttctcccaggcaggggcagccttccaccacggggagcccagctgtcagccgcctcacaggaagatgctgcgtcggcggggcagccctggcatgggtgtgcatgtgggtgcagccctgggagcactgtggttctgcctcacaggtgagggtagcagcatggggacgggaggggagggacagtgattgtggcagttggggagggggtgcccacgcctgttaggggtcctgccaagccagctctggctagcagggccataccttacttccacctgtgggatccagtaggcaactcacgttactgttcttagcctccatttccttgtctgtaaaatgggaacatgagtgctaaatgagatcgtgctatttcttgaatacactgtgtgcgccccctcccaggacctttccacttgctctttcctctgcctggaactttctgcccctaaacgtctgcatgactggatcccatattttgtggaggtctttgctcaatgtcacctcctctcaaggctctcctagctcccttgtataaaatagcacacctccgctcctccctccctatccctggcctccctgcgttattctgcctagattcgcccccacctggcgtttgcttgcttcctccctgttcaaagagcagggtccatctcagggccagagcggctgttgcatagtaggtgcccaataactgtgtagaataaacgatgtgactctccccacacggtgcttggcacacaggaagcactcaataataatagctactttaataacaatatcctcatcacatttcaaattctcatcagcatctctgctctgagacggcttcctccgtggggaagacaaagctgagggtctggcgccatcttgtggccataaagaagtgcctgtctctacccacggctgctctgatttctctagagcaagaaagggttttgtctgggtgacttaccaggtttcattcccccaaatgtcccctccaaggggcaccctggttcgactgacagggcatgagaactggcctggggcaccaggggtttcagcaagagatccaaggctagcttaagaactttagagatctctaggtactgcaaagattatgatactgagtatgattcacaataaaaataataaccataaagtcaatgttatttttctaaatgcaggaaacctttaatgagtgctgtattcaattagcattgtttcaaggttgatcttcccacattttgagtgtgcctgctttgctagtgctcgaagcacacaatctaaccattaccggagaatggtagtgccagggtgggggggttcgcttcccctcctcccctcctcctcctcctctttttttttttttgagatggggtcttgctctgttgccaaggatggagtgcagtggcgcgatctcggctcactgcaacctccacctcccaggttcaagcaattctcctgcctcagcctcctgagtagctgggattacaggtgtgttccaccacccctggctattttttagtagaggtggggtttcaccatatctgctaggctggtctcgaacgcctgacctcaggtgatccacctgcctcggcctcccatgccgggccttttcccctcacttctgactcatcagcaagtcctgttgattccctcctaaataaaccttgaatctgatccctctcttcttctctactaccaccctttgaagccacaccaccctcacctcttacagggacagctgaaaccgcccctaactggcctcccccttgccctgccacagtccagtctccacagaggagctagagtgagttttaagcattgctactcagattatgcgtgattaaaacactccccagtgattcccattactcatagaaaaagttagattcctcactggtctcttcaagtcatctttggtctgggtgggacatgccctcccatcagatgtgtctgccacactggacgctccccgatattttcacacagcaaggccagtcttgcctcagggccttccacctgctgtttcctctacggggttctctgtatgtcagctctttttcattccctataaatttcagcttaattgctttaaagagcatgtgcctcaccaccatatttaaaggtacgggtattctttcttgtataaaaacaaatcgtgtttcgttaggaaaagaaaaaaaaagaaaaaaagaaaaagcacttgtgattctctctcctccagagaaaccactattgacatttttggtggatacttttttggactccccaatttataacattacttacgctcatggggaaatgcacatggtgcaggcaggtgtaaagtacctgccagatttttgaaaagctgttgctttacttactaacctgctggctccttttcctcacataccttagtcacatgctgacgagaatctgtgtgcccatttgtctctctctcccattaaaatgtaagttctgtggggatgtgaccgtagtattgctctctgttgcatttctgacttttatgcttggcacctgtaggtgctgactatattcttgactgaatgaggtcctaagacaataaattactttgggtctcaggcctaaaaggaggggtggacagggcctggggttagcaggggcagggagcgggactagggaggcccacccctcctcagtcccccttatatgttctccactccccctacccccaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccggtgagcaccaggagggggacgccttccccttagttcaccctccattccccctgcagcccaccccctgctgcaccactgctcccagaaccccagtgctgattcctgtactcagccccatgcatccttttcgtcctctgccattgccctgcccttgacccctgccctctgtcacctccagctccctactcgaagcccagcatgaccctggagcccaacaaggacctgcggccaggggacacggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtcagcagaggggtgggcgaaggaaaggagtcctgatggcaggattcaccagggctggagctggtgagagtcacctgccccaggcctggccctgggattggtctggtcaggccaagacccacctgctgtgattgttctcagaagattggggagactccatatctgagagtcctcagacttaatctgcttttgcatctaagaagaaaataggaagatggaacagggtctgggaattgatgggggaagagtttgggggactcgggtggtagcctagagagtcccatttctcctcaccaccctgcccctctgaccccgcccccaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccggtgagcaccaggagggcgacgccttccccttggttcaccctccattccctctgcagcccaccctctgctgcaccactgctcccagaaccccagtgctgattcctgtactcagccccatgcatccttttcctcccctgccattgccctgcccttgacccctgccctctgtcacctccagctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacaggtaagggcagatgaacagctggggaaggacggagcgagtaactccctctttactggaccctaacgtggaatttccataggtttgggtggccagaagactttcaaaatccctttcatagacttcaggtgctcacactcttccccacaagtccttaagggactcgagctgataagaaccatttataatgtttgccttcctaagagtgcttttcgtggcacttatgcttcttatgcagaggacaaggtacctgcccgaaatttggaggcatgggcaggaattctggggcagccacaaggtgtggcccaggggacttggtgtgggtgtgctttccagcaggaactcctctgagtggtaggaaggtattctgggtcagtgggcgccatctgattctgaagcctgagtgacagctggccctccctagttagtccccaacacctgagtcaacgtcagctcttcttcctgcagacttgcgctccacccaggcagccgttggatgggcaggggctgtctctgctgcccccgtgtggtcaaacaccagatagaggccacccctttagtgattgttagtctctggtttccaggttctagcctcgtgggcacctcttgtgcctgagggtgtgaagagggttgaggtcaagagccgcagtctccatctgtgtttggccctgagaggcctctggtcagtcacttcctgggccgacgtgctcagtctggctcttcagtatctctccctggccaactgagctttcccagggacctcgccctggtgcacagtgaggtcaggacagcaggttttgtctgtctggttctcctcttgtcttctgatgacttccatctgcccctcagcccatccaagttctgatctcaccccaagtttccaggtctgcatgcacctcaggactcacttattcctgtcctctccctcttgagacctatgtggtccccacttctgacaagctcggagccagggcccgtcacatcgtctgcttggagttcaggctcactcctccttctctcttacgtgtttccttctggcaaggttgtgctccttctgcccaccccttccccaagatggaaaacactcccttcctgtgctctccaggagagagtagctgccctgagctcttgaatgttctgagacatgtccttgaccttttagagaacagcatatggtttggtggtgaaaatgctgttcacaggcgaaaagaagaaatagaagatagagtgatcttggcagaggatatgaagctttcagaggagggagggtggtagtgaggacacctccaggggcaaatgggagctgagaaggccttgaaggataaggggtctttgtggtcatttgcaccctgggctgagctggatatttgcgatgctgtgcagaaaggacttatgagtataaatgtgattgcaaagagaatgtttatctcacctaagagaaaattctctattttaaacttgagtagctaacatttaaagtgatttcaaaaaaatttagggctgggcatggtggctcacacctgtaatcccagcactttgggaggccaaggcgggtggatcacttgaggtcaggagttcgagaccagcctgatcagcatggtgaaaccctgtctctactgaaaacacaaaaattagctgggcgtggtggcatgcacctgtggtcccagctacttgggaggctggggcaagagaattgcttgaacctgggaggcggaggttgcagtgagccgagacagtgtcactgcactccagcctgggtgacagagcaagacactgtctcaaaaaataaataaaataaaaataaagtgatttcattgaggccattgttgccaagcacatttcacagacgaagaaactgaggtccacagagaagggggaactttcccaaggtcacagactggcacagcggctctcaatctttgggggtcagacccttctttgaaaattggataaatgatcaatgcagcagtttgcacataactctggagggttcgctgcctctctaaactcctccgtgggtctgtagacctgggctccagtgccctgcagtgaggagatgagccatgatcagaatccaactttggcctctcagcctaatttcctctccttcccaccagccagcctcctgtttctgttagagcaggtctggcctactttggagcccttggcctgtattttgcttcgggcagctttgtatcatgtcaaacattctgggattcagactttcagtcctccagctggtctctcccgtacctgatgaagttagtgaagttgtgtgctgtgcagagcctcttggagggggatttatggagcaagccctagagacgtggcctgagcctgtcctttcttgggtgaacagggcaaatgtaatttgtgttccagggacaccaccagttaagggggaacatagagaccctctgcttgagtatttccatggctctgccccctcctctgctgtcagagccccatgatgggatttccagggtggttattgttttttaatgtgtgctctgtggatgggccctcttggccacatcagctgctgccctccttttctgcacacctctcttcatcactggggtgatggatccctgtgcttccaatggccagagcagcagttttgccagcagtgcctattgaaggtgacatctgcagatccatgcacgaggtgcatctatgctggggtctctgccgccaaagggtccatagcaccgcgcactgcactgacagggcctcctgcagaagctgctgaggccctgggtgtgcatcgtctccagacagcaaaggaaagcagcactgtcttttgtcaggcttttcctctcaagacttctccctaggacccagctgggtgcaggggctgggctagaggatggtatgtaagatggagtcacacaggctgtgctcagaacagctcctggccctacccagctttgggtcctcaacttcatccctcttgacgtgacagctctaagaggaggggcctcagtgtttcatgttaatatccccctggcaaggcccctgcagacctacctgactccttggggaaactccaagccctcactccagccccgtcagtgacctcatctgtatgtaggactcagcgaacattttctgtaaatggccagggagtaaatgtttttaggcatcgtgggccacacaccatctctgttgctgctgcttctccttctgttcctcctccgccttcccccatctttttttggtaaccctttacaaatgtaaaaaccatcactagtttgtggactgtacaaaaacaggccacaagccagctttggcccatgggctgtagtttgctgccttctgatccatagaatgggagatgtcaccaggtagggctgaagcagtcaaaagagggcctctggaggaggtgaatattgagctaagcagagaatttgggaaactgatagcattagtgcagaggctggaaggagccagttgcttctggagagaatggttaggacaccagtttggctgaagctgaggctcctacagtagaattagaaaacttaggggagggtaagcagcagccaacttctagaggtccttgaatcacgcttgaagcttgaagcattattctaaagtcactagggagccatagaaggtacttgagcatcaattcaaccacaggctcttcagcccttcctggttgaggcgtgtccacatcagccagggttgtatcagggtttggggagtgtatggcgaagggactgtaggaacttaagtgagctttattcatagtgttagggcccagtgagggtgggagcccctgttcacacttggagccaatggtgctgtcctccgggacatggggccaggcatgacagtctcactgttgctacttttcctctcagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatgaatgtggatgagtgtgactggaaggtggtgggagtgtaaggccaagtgctacaaagggatgagtgtgtgccaacaagtgtgcctgtgaaagtgtaagtcagtcacgtgtgtgtgagagagcaggccagagcatggaagctgtgcggcacaaatgtaggcatgccaggggcgtgcatggcactgggggtgatcgtgcctgccttggagtgagtttgaagcagctgccatttgcggggctgagggtcagcccgagctggcattggtgactggtaagtgggtgagaggacattggtgggtggtgagttgaccctggtgggtaaacagatgcatgagagtagatgggtagtcagaggctggggatggctggaggttgggaaggagagggaagaagagtggtcagttggcagataggtgagtacttgtgaggtagacaggtggaaggatgagcaggtagacggctggttggttacatctgttggaggttgatggttggcagggctactgagcgagcggatgggtgaggtgatgggtgggtgggctggtggagggtaggtggatggtctttggctgggtgtgtggcgggggctccaggttgagtggatggtctttggctgggtgagtggtgggctccaggctgggtggatggtccttgactgggtaagtggtgcactccaggctgggtggatggtctttggctgggtgagtggtgggggcgccaggctgggtagtttttggctgggtgagtggtgggctccaggctgggagccccttcatgttgtcacaggctcggctctgctgtgctctgctctcgggctctaacccgtgtctagcatttggtccgcaggtcaggcccactcaggccctgttcaccagcttcctgcactctcaggtgggaaagtgctggcatgaaaatgggcttgcaaaagatttttgtttattctgagttcttgcctttgcaggagctgaggaccaggatggggagggagaaggctccaagacaggtgagtctgaacttggagctggccctcttggctgggagagggacatatgggaaaggagagaggactctaggatctggaggggccagatttgctgtaaggtttgaatgaaatgtgttctgtggactcagacctccccaccccggtgagtctgctctttgcccagagttaggcaggaagtggatcacccagttccctcccaggtgtggcttcatttctcctgccaacctttacccatctgccagggccgattccacctgattggccccacaccgtggagtctggtggcttcctaggggtgggagcaggggctccggagatagggagtctgggtttaagttcctgctccatctcaggtaaacagagtggccttgagcaagatgctttgcctctctggcttcggtttcctcttatgtaaaatgaggataatcacagattcataggttgtttgaattattaattgagataatgtatataaaggacctagtatcatatctagtgccaagtgcttaatactctggagtcctattactattaggcaaacagcttaagacaatactgttctagttacagactgtgtagctttgggcaaggtgccttgctcctctgggcatcagtttcccatctgtaaaatgtcatcctgaccctgccctgatggcaccagagggctgttttgaagctctttcaggtgactggagagggaggtacttgcaaaggacataggagcatggcacagtaagctgggggcccagcttgggtgggtgccaaggcactggtgcccatggccgactcccaggggatcctgggctgggagaggcaggtttccgctgagccatttgggatggttccagttaatgccagttccctccccacccccgcagaaggaagggcaggagattgacacttggggactgctataaattatgccaattaattctttgcctgttggtgcccagcgtggcaggcgtagagacagctctgggatcagacctcattcttcatgctcagaggcagatgtagttggcagaagggagggagtgaggagaagagtgtgggtgatggagttggtcagtctcattccacatggtcccaggcccacctgcaaatctgccagcctcctttagcttctcacatcaccctgtgtgtacattgggctcagggcacttccgcatctccagctggaggtggagggctcgagggttgtcccattctatagatgcagaaaactaaggcccagagaggagaatgacaagccacagagtggaactgggacctgggactggggcttgggacagcaacctagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcacacatctgtgtgtgagaggctgagagggtgggtaggcatcatcctttcactagtgacctgaggccccctctgcagaagagcagcctcaacttccccctggtgagatggcagagggctgagtaaccaaggtcccagctgctctgatgggacccaaatacgacagaggcttaagcaggacaggagtttattcctccttcctgtgatagtgtgagcataggtaatcgtaaaaccactgatgacctggagccaggttccacttacctggattctgccctcttcaacttcaagctttcactcctaggtctaagaggctgtttgtgctcccacgccccctccagagccaagagggagagaaaggaaggatatgtttccttctagagcttgagtggaagtagcctgcatcacttccgcttacattccattggtcagaacccaggcatatgagccctaactcaggggaggctagaaaagtgttcagctgggtagccatgtccctggcgcacagtgggtggttagtaaatgtccatagtcattattgggcctattgttataatgtcagtgatgacatttggaaatacaggagataggtcatttccttcctgtttttcagaatcaaataaccatagaagagctgggcagatggagataaaaagtgtcagcttaggccaggcatggtacttcacacctgtaatctcagcactttgggaggccgaggtgggtggatcacttgaggtcaggagtttgagaccagcctggccaacatggtgaaaccctgtctctactaaaaatacaaaacttagccgggcgtggtggtgcatgcctgtaatcccagctacttgggaagctgaggcgggagaatcacttgaacctgggaggcagaggttgcagtgaactgagattgcacctgtgcactccagcctgggcaacagagcaagattccatctcaaaaaaaaaaaaaaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaagctt

SEQ ID NO: 439 - DNA, 23354 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcagctgccgtcttggctgcagcctgagaggtgcgctgtgttccagtgcgcacagtgtcacgcagtgctcgccgactcggtgcacctcgcctgggacctgtcgcggtccctcggggccgtggtcttctccagtgagtgcagtgaagcgttcgggaaaggcagaggctagcccgagagggtgttcccgctttctccaccgggtggcggagaaccacctggggaagaaaacgggatgaaaagttggaagcaaataactccttggcctggggatggggcagggaatcggggagtctcctgatatttacggccaggatgagtctgtctagaggagagattttccatttcaaggcccgcagagtatgggttctgacccgtgtttgtcttcctaggagttacaaataacgtcgttttggaagcgcccttcctagttggcattgaaggttcactcaaaggcaggtacgtattgataattacattggtctctagtccctgactttatgagactgaggatcgtggaactgacatgtacgaggagaaaacagtttgggatgctgcttttacctgtttgactcttatatgaacttgatgtattaatgaaatgaaaaagttgtatttgtgtattggttttaggatcttcctgagggccacttctcccaggtggcttgtacaagtgaagtgaggctaagaaagatgtatctagtagtggacaaaagaaaaaaataaccttttggtttacagtgagaataacatactataaactacaatccttttagatattagaactttttgatacagggtcttgctctcgcccaggctggagtgcactggtgcgctcatagctcactacagcccctaccttcctggctcaagctatcctcccaacctcaccctccggagtagctgggactacaggcacacagcaccactcccggctaatttttaaattttttgtagaggccttagtatgttgcccacgcttgatattagaacttttaagtttgcgattatggttagtttgtaataagctatgccagggctaattcttcagtaaccccagaaactggagaaaaacacaactagaatgttatgtacttgaatactgcctggtaaactttgcgacctgcctgtactatgatttacaagtgacaataaagtagtcagtgaatttggtattgcaaggctcctcaattttgagttttggctttaacattgagacaattcatttcattctgaccagtttgattcaacgttacggttaaaatataggaattcttagttgctttgtccagtaaccaggaagatttctgcagcttggacaaacttcaaaaacggagttagacccacagctccctttctttttcctgaataaaagacactccctatcgctataggagtccccttcccacccaaaggggacaaagcaagaaggagcaattgcctgcttggaattgggtgtattctggggccagaggcagaaggttcctgaatgtgctcttggagaggaggctaatgaatctagacccgtgctgtcctatactgtaatcactagtcatatgtagctattatatattattaaatctgcattgagatatgctgtgaacacagaatacacactggatttcaaagacttagtacagaaaaattaatcatttacaaatactgattacgggccgggcgtggtggctcacacctgtaatcacagcactttgggaggccgaggcgggcggatcacaaggtcaggaaatcgagaccatcctgactaacacggtgaaaccgtgtctctactaaaaatacaaaaaattagccaggcatagtggcgggcgcctgtagtcccagctactcaggagactgaggcaggagaatggcgtgaacccgggaggcggagcttgcagtgaccgagattgcgccactgcattccagcctgggcgacagactccgtatcaaaaaaaaaaaaaaaaaaatactgattacggctgggagcggtggcttacgcctataatcccagcacttttgggaggccatgacaggcagatcaccagaggtcgggagttcgagaccagcctgaccaaaatggagaaaccctgtctctactaaaaatacaaaattagccgggcatggtggcacatgcctgtaatcccagctaggctgtaatcccaggaggctgaggagggagaatcgcttgaacccgggaggtggaggttgtggtgagccgagttcacgccattgcactccagcctgggcaacgagagcgaaactctgtcttaaaaaaaaaaattgattacatggtgaaatgacatttttgatatattgggttaaataaaatatttaaaaactaatttcacctgtttttattttattttttaaagcaaaattaggccaggcgccgtggctgatgcatgtaatcccagcactttgggaggccaaggcggatggatcacgaggtcaggagttcaagaccagcctagccaagatagtgaaactgtttctactagaaatacaaaaattagctgggcgtggtggcgggcgcctgtaatcccagctacttgggagactgaggcagagaattgcttgaatctggtaggcgggggttgcagtgagccaagatcatcccactgtactccagcctgggcaacagagcgagactcttcctcaaaaaaaaaagcaaaatgaatagaaaatttaaaattacatatgtgactcacattatattcctattagacaatgcttgtttagatgctttgtaaaaaactggaggaaggccaggtgcagtggcttacacctataatcccagcactttgggaggccaaggcaggcagatcacaaggtcgggagttcgggaccagcctggccagtatggtgaaaccacgtctctactaaaagtacaaaaattaggggggcgaggtggcaagcgcctatagtcccagctacttgggaggctgaggcaggagaatggcttgaacctgggaagcagaggttgcagtgagccaagatcgcaccactacactccagcctggacgacagatcgagactccgtctgaaaaaaaaaaaaaaaaaaaactagagggaaagccccatgtgtttctgtatttgtggagtaagatgagctatatgggacttacgaagagggttatgaaatggcacagctcaagacaacttgatttttttctaagtgtaggttcattacctagatggggtcagagaatgaattaagaggatgattaatgatgcagctaaaagagcataaattttagagacagcagactcgggttctttttattcttttttttttttttttttttttttttttgagatggagtcttgctctgacccaggctggagcacagtggcgggatcttggctcgctgcaacctccgcctcccgggttcaagctattctcctacctcagcctcccgagtagctgggattccaggcgcacgccactatgcctggctaatttttgtatttttatatttttagtagagacggggtttcaccatgttggccatgctggtctcgaacttctgaccttgtgatccacctgcctcagcctcccaaagtgctgggattacaggtgtgagccaccgcaccaggccttaactttactcttaatgaggcatgtgaaataaattgatccctctcaatctgtcatatttgaatactcctaaaatatactccctccgacatttatttaaacattctacaattggcatgaacctcttagattcaaagtcataaagtagacagatacaaggttacttccgtctacattttattgttctcttactggtagaggatttattgtaactaattttaaaaaggattattatagtatgttgacacttagaaatagcttttttaccctgagcttttgttgtgctcaacagcatatttaaatggaattttgtttgtattataagtgaagtacatttttttctaattgttatggcaaattcaaacccgagagaagaatataatgaacctctgtctacctgtcactaaactagagcacttatcaactcttggccaatcttgtttcatctaaaatcatagttggcttatcatgctggctcacgcctgtaatcccaacacttttggaggccaaggtgggaggatcacttgaacccaggagttcaagaccatcatgagcaacatagcgagacttcatctctaaaacaaaacaaaatatctatcctccacaatgttttgaagcagatacctgaaattacatcattccatccataaatattttggtaaggatctttataagaaacttttttctatttatttattttttgagatggagtctggctcttttacccaggatggagaacaacctccgcctcccaggctcaagccatcctttcacctcagcctcccaagtagctaggactataaggcatgcaccaccatgcccagctaatttgttgtagagatagggtttcaacatgttgcccaggctggttttgaactcctgaactcaagtgatctgcccacctttgcttcccaaagtgctggcattacaagcatgagccactgcactcagcctttcttttcaattattttattttattttttatttttttgagatggagtcttgctctgtagcccaggctgaagtgcagtggcaggatcttggctcactgcaaactccgcctcccgggttcaagtgattcccctgcctcagcctcccgagtaactgggactacaggtgcatgccaccacatctggctaattttatgtattttagtagagacggggtttcaccatgttggccaggatggtcttaatctcctgacttcgtgatcctcccacctcagcctcccaaagtgttgggattacaggcgtgagccactgcgcccagcctcttttctttttaaagatatatcccaattctggctgggtacagtgactcacgcctgtaatcccagcactttgggaggccgaggcgggaggatcacgaggtcaggagttcaacaccagcctggatgacatagcgaaaccccatctctactaatacaaaaatttgctgggcgtggtggtgggcgcctgtaatccctgctactggggaggctgaggcaggagaatcgcttgaacccaggaggcggaggttgcagtgagccgagatcacaccattgcactccaacctgggtgacaagaggaagactccatctcagaaaaaaaaaaaatttaaacataccacaaacactataataagccccaggtacccagtttcaacagttattaatattttgacaattattttcctctatactcttcacttttttttttttttaattcctggagtattttgaaacaaatcacatacagtaaatcaactcttcatcactttggtattacttcctgttgtcttgtagattcacagactgttataaccaaaaaaataacataatctagttgacctcattctactgataaggatatggagaaacagttgtatttggtagtgtattggaagtattttcctcctataatattctccagtgcccatgatccaatgtaatgatggaaggcccagcaagctaggtgatgctaacccttagtggcagagcaaggcaacccaaagcagctcagcacggatggttagagacgtagtacctactgtggtaagattgttaaaaacatggggccgggcacggtggctcacacctgtaatgccggcactttggaaggcctaggtgtgcagatcacctgaggtcaggagttcgagaccagcctggccaacacggggaaaccccgtgtctagtaaaagacaaaattagccaagcgtggtggtgcacgcctgtaatcccagctactcacttgggaggccgagtcaggagaatcacttgaacctaggagacggaggttgtggtaagccaagatcacgccattgcactccagcctggggaatgagcgaaactccatctcaaaaaatcacaaacaaaaaacaataaggagccacagactatacacatgatcagaggcaaagtgtgggaatgaagttctttttttcttctacagtggtcaacttaggataaatttttttaaatcataaaccatggtttagccactgaggcaccgctatatcattaatctcactatctgaacttattgcaattttcttttccttgttttatagtaatattcaataaaatatactgtgttttactgcacttgcagatactgcttttttgtttgtttgtttttttgagatggagtcacactctgtcacctaggctagagtccagtggcattatctcggctcactgaaacctctgccccctggcttcaagcaattcttctgccttagcctccctagtagctgggatgacaggtgtgccctaccacacccagctaacttttgtattttcagtagagacagggttttgccatgttggccatgctggtcctgaactcctgacctcaagtgatctgcccaccttggccttccagagtgctgggattacaggtgtgagccactatgcccagcccaggtaatgcaattttttttttttttttttgagacggagtcttgctctgttgcccagacagaagtgcagtggcatgatcttggctcactgcaacctccacatcccgggttcaagcaactctcctgcctcagcctccctagtagctgggattacaggtgcgtgccaccacgcccagctaatttttgtatttttattagagatgggtttcgccgtgtttgccaggctggtcctgaactcctgacctcaaatgatccacctgccttggcttcccatagtgctgggattacgggtgtgagccactgcgcccagcccagggactgcatttttttttttttttaacaaattgaaggtttgtgacaagcttttgttgagcaagtctgttgacaccatttctaacagcatgtgctcactttgtgtctctgtgtcacatgttggtaattctggcagtttttatttttattatttatttattttgagacggaggctcgctctgtcacccaggctggagtgcagtggcgtgatctaggctcactgcaagctcagcctcctgggttcacaccattctcctgcctcagcctcccgagtagctgggacttacaggggcccgccaccacacccggctaatttttttgtagttttagtagagatggggttttaccatgttagccaggatggtcttgatctcctgacctcatgacctgcctccctcggcctcccagagtgctgggattacagccactgcgcccggccaattctggcagtttttaaaaccttttcatcattatgtctgttaacactgatctgtgatcagtgatctttgctgttactattgtaattgtgggatgccacaaaccgcacccattgaagatagcaaacttaatcaatacatgcctgtgttttgacttccaccaactagccattcagtcttgccttctcaggccaattaataacccaacaatggcctttaagtgttcaagtgaaagaaaaagttgcaagtctctcattttaaatcaaaagctagaaatgattaagcttagtgaggaaggcatgtgaagtcatgccaaattgtgaatatgaagaaaaaaaatggggttaggcgcggtggctcacgcttgtaatcccagcacttttgggagactgaggcgggtggatcacatgaggtcaggaattcaagaccagcctgaccaacatggtgaaaccccatctctactaaaaatacaaaattagccgggcatggtggcgcacacctgtaattccagctctttgggaggctgaggcaggagaattgcttgaacccgggaggcggaggttgcagtgcaccaagaacacaccattgcactccaccttgggcaacaagagcgaaactccatcaaacaaacaaacaaataaataaatggaaattaaaagtgctattccagtgataagctgatatggagaaagtttgagtggtatgagtagaagatcaaatcagccacaacattcctttaaactaaagcctaatccagaacaaggccctaactctgttcaattctgtgaaggctgagaggtgaggaagctgcagaagaagtttagagtatcaaatgttggctcggtgcaatggctcacgcctgtaatcccagcactttgggaggccgaggtgggtggactggttgaacccaggagtttgagaccaacctgggcaacatggtgaaatgctgtctctacaaaatacaaaaaaatttagccggatgtggtggcgcacacctatagtcccagctgcttgggaggctgagaaggaaggctggcttgagcccagagaggtcgaggctgcaatggagctgtgattgtgccaccacactccagcctgggtgggtgacagagcaagaccatcttaaaaaaaaaaaaaaaaaaaaaagcagaggttggttcatgagatttaaggaaagaaaccttctccataacaaaagtccaaagtgaaacagcaagtactgatgcagaagctacagaaaatgaaagtgggtacactaaagaacatattttcagtgcagatgaaacagccttctgttggaagaagataccatctcagactttcataggtagaaaggagaagtcattacctggcttcaaaggagctggtcacagtgactcacatgtgtaatcccagcactttgggagaccaaagtgggaggattgcttgagcacaggagttcaagaccagcctgggcaacatagcaagaacctgtctctacgaaaaatttaaaaattagatgggcattttagtgtgtacctgtggtcccagctacttggaaggctgaggtgggaggatcacttgagtctgggatgtcaaggctgtagtgagctgtgattgtaccactgcactccatccaaaagaaaaagaaaaaaaagcttcaaaggacaggctttcttgttaggggctattgcagctggtgactttaagttgaagtcaatgctcatttactattactatctatagctactatagatagttattcctctgatggatctgggcaaagtaaatcaaaaaccttctggaaacccagctaaattttgtatttttagtagagacggagtttcaccatgttgaccaggctgttctcaaactcctgatctcaagtgatctgcctgcctcccaaaatgctgggattacaagcgtgagccattgcgcccgaatggaaattaaattaatttccactgagacatttgtttataagtactgtgctttgtctgaattaattaattcctacgtggaatttcaaattaatgacactttatttcatattttgctttttggttaactatattcacaagattacattactatatgtgtggtgtgggtgtgggacttcatttaccaataaactcaatatattgttatttgttcttttttagtatccactgacatgaatatttctttttagctatgtgatttttttttttcttttttaagatggagtttcgctcttgttgcccaggctggagtgcagtggcacaatctccgctcactgcaacctccgcctcccaggttcaagcgattctcctgcctcaccctcctaagtagctgggattacaggcacccgccaccaggcctggctaatttttttatttttagtagagacagggtttcgccacgttggccaggctggtctcgaactcctgacctcaggtgatccacccgccttggcctcccaaagtgctgggattacaggcgtgagccatcatgcccgggctagctatgtgatttttatgttgtattttgttaatagaattctcctagcctgggaaacaaagtaagaccccatttctgccaaaaaaaaaattagtagggcatggtagcatgcacctgtagtcccagctttgggaagctgaggcaggtagatcagttgagcccaggaattcaaggctgcagtgagctatgattgtatcactacgttctaacctgggcgacagagcaagaacttgtctcaaaaaaaaaccaaaaaaaacttcatactatatattaatacaatttatttttcctttaccaaaccactttaaaattgcttttagcacatgcatgatgaaatattttcttaaagtgcttttcttgtaaaacatttatttattttttaagacggggtattaccatgttgcctaggctgctctcgaattcctgggctcaagctatctgcccactttggcctctcatagtgctgggattacagtaggtgtgaaccactgtgcctgaccaaaatgtttctttctaatatttaaatatgtcttatataccagcaaatatgatgacttgctcaagaattgtaatgagagctaaaatcaacatctgactcttcatcagtaatcttttcagaggataaggaaaacaaaatagatggcttgctagggtaataggattcccttttctttctcttttagtctgcgcatttttttcttttttatttatttatttatttatttatttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacaggattgggggtaaggtcatagatcaacaggatcccaaggcagaagaatttttcttagtacagaacaaaatgaaaagtctcccatgtctacttctttctacacagacacagcagccatccgatttctcaatcttttccccacctttcccccttttctattccacaaaactgccattgtcatcatggcccattctcaatgagctgttgggtacacctcccagacagggtggtggccgggcagaggggctcctcacttcccagtaggggcggccgggcagaggcgcccatcacctcgcggacggggcggctggccgggcggggggctgacccccccacctccctccaggacgggacggctggccgggcggggggctggaccaccccacctccctcccggacggggcggctggccgggcggggggctgacccccccacctccctcctggacggggcggctggctgggcggggggctgaccccccacctccctccccgacagggtggctgccgggcggagacgctcctcacttcccagatggggtggctgccgggcggaggggctcctcacttctcagacagggaggctgccgggcggagggtctcctcacttctcaagatggggcagccgggcagagacgctcctcacctcccaggcagggtcgcggccgggcagaggcgctcctcacatcccagacggggcggcagggcagaggcgttccccacatctcagaccatgggaggccgggcagagacgctcctcacttcctagatgggatggcggccgggaagaggcgctcctcacttcctagatgggatggcgggcgggcagagacgctcctcactttccagactgggcagccaggcagaggggctcctcacatcccagacgatgggtggccaggcagagacgctcctcacttcccagacggggtggcggctgggcagaggctgtaatctcggcactttgggaggccaaggcaggcggctgggaggtggaggttgtagcgagccaagatcatgccactgcactccagcctgggcaccattgagcactgagtgaacgagacgagactccgtctgcaatcccggcaccctgggaggccgaggctggtggatcactcgcggttaggagctggagaccagcccagccaacacagcgaaaccccgtctccaccaaaaaaatatgaaaacctgtcaagtgtggcggcgcgtgcctgcaatcgcaggcactcggcaggctgaggcaggagaatcaggcagggaggttgcagtgagccgagatggcagcagtacagtccagctttggcttggcatcagagggagaccgtggaaagagagggagagggagaccgtggggagaggagggagagggagagggcgcatttttttcattaactttcttttttaatataagcaaaagacaaaccttgattttagttctatgaacaatttgtttagtaaggccccagtcaacttgattatttttcaacaactgtgaatttatataatgatagccattttacatgatttgtagttttaaatgtttaaatgttaatcagattagttagctctttttgtgtttattaggggtaaattacctttctcttctgaagcgacaattatacatccatgattgctttgaccagaatatacgagggtatccgcaatccagcatgtaattaaattacaatctgagttaccctttcttgaatgtgacattctttccgtctcattcctattacaatgtaattttcaccctgacttaggtgttaggaatgcttcagagactagttattttttatttcttatatgattttttattcttacccatattgtgtttttccccacccctagtacttacaaccttttattctgtggttcttgtgggattcccgttggtttccatctgtattctacccatgctgccctggctgccttgagaggtcacttctgcctttccagtgacaaaatggtgtggtgagtagacttagatattgatcatcaaatacattttattttatttattttgagacaaagtccatcaaataaattttaaaaggtttttcaggaaagacaaagtaggctgagcacagtggcttatgcctgtaatcccagcactttaggaggctgaggcggtggatcactcgaggtcaggagtttgagaccagcctggctaacatggtgaaacccatctctacgaaaaatacaaaaattagccaggtgtagtggtagacgcctgtaatcccagctactcaggaggctgaggcacgagaattgttggaacctgggaggcagaggctgcagtgagctgagatcacgccactgtgagatcacgccactgcactccagcctgggagacatagtgagattctgtccaaaggaaaaaaaaaaaaaagtagctgggcatgctagtgcacacctgtaatcccagctacttgggaggctgcggcaagagaattgcttcaacctgagaggtggaggttgcacagtgagctgagattgcaccactacactccagcctgggtgacagaacaagactctgtctcaaaaaaaaaaaaaagaaaaaagacaaagtgtttgtaccaaaaagatgctaaagtcaggcactgtctttgacaaaaagatagcagtgggccaggtgtgatggctcgcgcctgtaatgccaatgctttgtgaggccaaggtgggaggactgcttgagggcaggagttcaagacctccatgggcaatatagtgagactcctgttttttttttatacaaaattttaaaaaattagctggatgtggcggcgtgcccctatagtcccagttacttgggaggctgaggtgggaggatcacctgagcccaggagttcaaggttacattttgctgtgatcataccactgcattccactttgggtgacaaaaaaaaaaaaaagcagtgggaccaaaatataatcttataacattatgattatcttccatgtcttatcataccatatcttaaaagtcataccatgggaaaattcagagggtattctttcattaaagaaacttgttgccagatgtggtggtgtgtgcctgtaattctagctacccaggaggctgaggcaggaggatcacttgaatcttggtgtttgagaccagcctaggcaacatggtgaagcctcccatctcaaactgctcccttatgggccgggtgcagtggctcacgcctgtaatcccagcactttgggaggctgaggtcgggggttcacctgaggtcaggagttcgagaccagcttggccaacatggtggaaccccatctccatttaaaatacgaaaataagccaagtgtggtggcacacgcctgtggtcgcagctactcgggaggtgaggcagaagaattgcttgaacccaggaggcggaggttgcagtgagccaagatcaagccactgcacttcagcctgggtgacagagctagactctgtctcagaaaaaataaaaataaataaaagataaaaagaacattctagaaggcaagcttttgcaaaataatgttgcagtagataccttttgggtttgtgcccagcctctctctccctctaataggtggggccttgtatatttgtatcatgtgtgatttgtatcatgtgtgattcccactcccaggtactggatcaagaatgaatacctggccaggcatggtgggtcatgcctgtaatctcagcactttggaaggctgagttggaggattgtttgagcttaggagtttgagaccagcctaggcaacatagcaagactctgtctctacaaaaaatttaaaatattaactgtgtatggtggtgtatgcctgtagtcctagctactctggaggctaaggtgggaggatagctacagcccaggagttcaaggttacagtgagctatgattgtgtcactgtattctagcatggggagcagagcaagaccctgtctcttaaaaaccaaaaacggtgctgggcgtggtagctcacgcctgtaaccccagtactttgggaggccgaggtgggcagatcatgaggtcaggagatcgagatcatcctggccaacatgggaaaccccgtctctactaaaaatacaaaaaaaattagctgggcatggtggcgcatgcctgtaatcctagctacttgggaggctgaggcaggagaatcacttgaaccggggagtcagaggttgcagtgaaccaagatcgcgccactgcactccagcctggcaacagagcgagactctgtctcaaaaaaaaaaaaaaaaagaaaaatggatacctgacccaaactaagccaaccagttttctaccttaggaatttgaaacaagggcccagaaataccagttacgtgtagatagtactagtgttgaagtttggaagtgaaagctctatgtatgggatagctatttcccatgtgatgcatgtagctgcagggaagtcttctctgcagtaaaacatgaagcagacacagagaaaagtaaaaataatgatcatgtagcctcatagtgtcagaaaaactaccctactggttatcctttctcatgaattacattggctatttcattattttcctaataaattgcacttttaacttaagcttttttacttattacaagaaactgaaacatccttagaagtctttccttgaccattaaaaaacaaaaacaagcattgacaacctagtttatgtaggcattatgcttatatcactgagttcttaatatagtttaagaaaactagggctcaaagaggtggaagagctgagatttgagcatgtcttaactcaaaagcttattttcctttcataaaactaaaaggtttcctttttctcatgtctttttttttttttttttttttgagatggagtcttgctgtggcgcccaggctggagtgcagtgacgtgatcttggttcactgtaagcttcaccccctgggttcacaccattctcctgcctcagcctcccaagtagctggaactacaggcgcccaccaccacgcttggctaattttttgtatttttagtagagacggggtttcactgtgttagccaggatggtctcgatctccttgacctcgtgatccgcccgccttggcctcctaaggtgctgggattacaggcatgagccaccgcgcccggccgctttttctcatttcttatgcttagatagatgtttttagctgagttatggttgactaaacaataaaacttatcagccagtcctttaccatgggttgctcactgtgcattaggtataccatttgttcttcattgcaaatttccaacacaaaatatatacctgagatcctgagatggattgatcattctctttttttaaagacggagtctcactctgtcacccaggctggaagtgcaatggcatgatctcagctcactgcaacctgcacctcctgggttcaagtgattctcctgcctgggcttcccaaaatgttaagattacaggcattaatcaccatgcccagcctcaatttttagattctttttttttttctttgagacggagtcttgctctttcgcccaggctggagctggagtgcagtggcaccatctcggctcactgcaagctccgcctcccaggttcacgccattgtcctgcctcagcctcccgagtagctgggactacaggcgcccgccaccatgtctggctaatttttttgtatttttagtagagacggggttttaccgtgttagccagcatggtcttgatctcctgccttggccacctaaagtgctgggattacaggtgtgagccactgcgccaccaatttctagattcttaagcaatttctatttagaattaactttaaagtgggaaaaaaaactgtaaatgtgtgctgttagtaatcccacatcttttttagaaatcagtacaaaagtaaatgttctagagaagcaataattgcatttttgttagggcagtaagcttttagtaacatatttttaacataaatttgaaaagcattatgggattttggttaatttcttaatctttaaaatgagttggataaaaggtcaggacattctttttgattaagtagaaactttggccttttcctcttggattcgggatggctgctgcaattacagtcattacatctattgatgatagcatcctaaacatgaaggaaaaggatatggagagtatgggaacacaagaaaattcccccttttcatcagcataaattttttttttttttttgagacagagtcttgctctgtcacccaagttggaacacagtggtgtgatctcagctcattgcaacctccgcctcccaggttcaagtgattctcctgccttgcctcccaagcagatgggaccacaggtgcgctccaccacagcctgctaatttttgtatttttattagaaatggggttttaccatgtttgccaggctggtctcaaactcctgacctcaggtgatccccccgcctcggcctcccaaagtgctgggattacacgcataagccactgcgccccgccagcataaattttcttaatcttttttttattctttttttttttttttttgagacagggtctcactgtcacacaggctggagcgatcatggttcactgcagcctcaaccttttgggttcaggtgatcctcccaactcagcctcccaagtagctgggactacaggcatgccaccacatctggctaatttttgtattttttgtagagatggggtttcgctggccaggcatgttggctcacagctgtaatcccagcactttgggaggctgaggcaggcggatcacttgaggtcaggaattcaagaccagcctgtccaatatggtgaaaccctgtctctgctaaaaatacaaaaattagctgggcatgatggtgggcacctgtaatcccaactgcttgggaggctgaggcagaagaattgcttgaacctggaaggcggaggttgcagtgagccgagatctcgccattgcacttcagcctgggtgacagagtaagactctgtctcaaaaaaaaaaaaaagagatggagtttcgctatgttgcccaggctggtctcaaatttctgatgtcaagccatctgcctgcctcagcctcccaaagtgctgggattataggtgtgagccagcacacccatcccattttcttacccttgttggccagaactatgtcacatgatcacctcatctgagaaagcaaatatgtaacagtaggctcatggcaaaaatctggattctgttggcaataaagaagtgaggaaggctgggctcggctcacgcctataatcccagcactttgggaggcccaggcagggggatcacctgaggtcaggagttcgagaccagcctcgccaacatggtgaaaccccatctctactaaaaatacaaaaattagctgggcgtggtggcgcaagcctgtaatcccagctactcgggaggctgcggcaggagaatcgcttgaacccaggaggcagaggttgcagtgagctgagattgtaccactgcactctagtctgggcaacagagcgagactccatctcaaaaaaaaaaagtgaggaacagctactgggaataggtgaccaacactatgtctcatactgggattactttctttcaaactgtgctacaggatcctactgatgaagtgtaaagcttataatcatcgtaattattcatatgagcctggtttttgtctttaatttaccctgagataattttgtctctggtgggatgcggcagagatcctctccaatttgtttatttttgaatttgtttttccaagaaaatgcagtcatccttcagtatctgtggttccaggacctcaccagataccaaaatccatggacactcaagtttctgatattaagtggtgtaatatttgcatattacttttggatatcctcctttttaaagtataaaagtatatattttatactttaaaataatctccagattacttatgacagctaacgtaatgtaaatgctatgtacattacaaatttacataggaaatttacaaagttgttgtaatgttaagggaatgatgacaagaaaaagagtgtacctgttcagtacagacacaatccagtttttttttcctgaatatttttagtctgtggttgtttgaatccatggatgctatacccatggatatggtgggccaactgtaacatcatgagtcttgaaatgaaaatcattaagaagccaggctttttttgacacatactttctttagaaggtaagtttggttcttttataatcttaaccatggtatgacactaatatttttcttttttcctatctagctatctcttaaaaacaaaagccatagtaaatgcatcagagatggatattcaaaatgttcctctatcagaaaagattgcagaggtaaaatttcatgatggttgtatgcttttttaaaatacagacaactcttgataacttctaccaatgaacttggggatgatgaaatggcatgatgctcaataatcctttttacttgatttgaccttccctattgaatttgtaatgaaaaacaaaatactaaaaccacactgtaaggtatagttcaggaagaaaggaaaagctgctcaactgctgcactcctgcattctcctttgtgctgggaatggatatcatcatcttgccatagaggtgtcttctttgcaaataccttgtaattgctcaactgtctcagacataagagtgatgaaacagttattaagaattcctggccgggcgtggtggctcacgcctgtaatcccagcactttggtaggccaaggcgagcagaacatgaggtcaggagatggagaccatcctggctaacacagtgaaaccccatctctattacaaatacaaaaaattagccgggcgtggtggcacgtgcctgtagtcccagctactcgggaggcagaggcaggagaattgcttgaactgggaggtggaggttgcagtgagctgagattgcgccactgcattccagcctgggcaacagagcaagactctgtctcaaaaaaaaaaaaaaaaaaaatttagccggtcatggtggtgggcgcctgtaatcccagctacttaggagactgaggcaggagaatcgcttgaacccaggtggtggaggttgcagtgagccgagactgcgccactgcactccagcctgggcaacagagcgagactgcgtctcaaaaaaaaataattcttgcctgggcgtggtggctcacgcctgtaatcccagcactttgggaggctgaggcggatggataacccgagatcagtagttcgagaccagcctgaccaacatggagaaaccctgtctctactaaaaatacaaaattagccgggcgtggtggcacatgcctgtaatcccagctacttgggaggttgagacaggagaagcacttgaacctgcgagatagaggttgttgtgaggcaagatcatgccattgcactctagcctgagcaacaagagtgaaaatctgtctcaaaaaaaaaaaaaagaaaaaaagaaggctgggcatggtggcttatgcctgtaatcccagcactttgggaggctgaggcaggcagatcacctcaggtcgggagtttgagaccagcctgaccaacatggagaaatcccatctctactaaaaatacaaaattagccgggcgtgttggcgcatgcctataatcccagcttttcgggaggctgaggcaggagaatcgcttgaacctgggaggcagaggttgcagtgagccgagagcttgccattgagagcgaaactctgtgtggaaaaaaaaaaaaagaattcttattggctgggtgcggtggctcacacctgtaatcccagcactttgagaagccgaggtgggtggatcatgaggtcaggagttcagcctggccaagatggtgaaaccccgtctctactaaaactagaaaaattagccaggcgcagtggcaggcgcctataatcccagccccagctactcaggaggctgaagcaggagaatcgcttggacctggatggcagaggttgcagtgagccaagatcacgccattgcattctagcctgggtgacagtgagaatctatttcaaaaataataataataataattggtatgggaaatgactttggaatggcagtatgaggagttccatggataggatccaggaagaatattataaaggaaacaaccatcttaagtctgtggaaattttcttcaaggtatatggcaaatacagaaacatttatttgtttatttatttttgagacaaagtctcactctgcctcccaggctggaatgcagtggcacagtcttgggtcactgcaaccccctcctcccgggttcaagcgattctcccacatggagaatccttgtctctactaaaaatactaaaaagcctcctgagtacctgggactacaggcgcgcactaccgtgcccagataatttttgtatttttagtagagacggggttttaccatctctgctaaaaatgatggccaggctgttctcgaacttccgagctcaggtgacccacccgcctcggcctaccaaactgctgggattacaggtgtgagtgccaggttcaagtgcttctgcttcagcctccccagtagctgggaacccagttgcccttgcccccagcttgcttgtagggtggaaatcctatgctgggaggggcgaatggagattatcagaagccactgctcttgccctgctgagtaacaacactaaatttcatgctaaatatagctgtaagaactcttaaaaattacctaattgcaacagttatctgttctaaacctaataaccagagttaactttgcagaccattagtagaatgttaaagtcagagaggcatttgttactgttaacaaagtgttaaaagaaaagctaaattcttgccactggaaaaggaggagaagcctgtctccacaaagcactgtgaccagactttattcatcttcacagtagcagtgctgctcagcaatgttttgtcttttttcacacgaaactttacatctgaggatcttttttttttttttttttgagacggagtctcgctctgtcacccaggctggaatgcagtggcacgatcttggctcactgcaagctctgcctcctgggttcactcattctcttgcctcagcctcctgagtagctgggactacaggcgcccgccaccgtgcccagctaattttgtttttgtatttttagtagagatggggtttcaccgtgttagccaggatggtcttgatctcctgacctcgtgatctgcccaacttagcctcccaaagtgctggggttagaggcgtgagccactgcgcctggccacatctgaagatcttactgtgcgctacgttgttgtataaagttcttccagaattagaagaaatttattcctcaaatgcatttagacattgccagctcccaattactagatataaactagcttaaatttgaaatggtgtttgtgaccagcaaattgacagttaagcttaaaatgcccagatatccatcttggtgtggtggctcatgtctgtaattccagcactttgggaggatcactgactgccaggagttcaacaccagcctgggcaacaaagcaagacccccatctctacaaagaaaatttaaaacacatgactgtagtcctagctaatcaggaggctgaagtgggaggatcacttgagagcaggagcttgaggctgcagtgaactatgaatgtgccactgtactccagctcaggcaacagagtgagaccctgtctcttaaaataagtaaaaataaaaaaagatgccctgatatctatatatttctcttcctagctgaaagagaagatagtgctaacgcacaatcgcttaaaatcactaatgaagattctgagtgaagtgactcctgaccagtccaagccagaaaactgatcctgtaccaaagcttgagtgtcaggttcaggctttattgctgtcttcaacaacaggtgctgcttagtcatttcttgaaaaagattggcttcaagaatggaggggaaatgcagtttctatttacctttaggctgattttccaaattatttgtgaagctgtttttagaagatgagagactaaggattcttctcttttatagctatttgccttaagaacttactttagattcttattgaattcataatacttatctctgaaaatgtctttgactgtaaatttaggaattaagatgcagagtcccatgtgtcctctgatctaaagttgcatggttggtctgaaaatagagttgggcttaatgttgacttctattactcctgcatggagcagttgttatgaatactaatacatcactttttaacttctgtaaaatacagatcataatattctataggtaatgtttaataaattgcctgaataatatacaa

SEQ ID NO: 440 - DNA, 39090 bp, Homo sapiens
aggactggtccagccctcccaggcaggtgtagggccgactgcagcaacagcggccctgaccccagctcccatggctcccctccccccgcactcccaccccccgcacccggcacacaccatctcccagtcacccagtctcgaccggttctcgcgagatccgggttactgagcgctcggggccttttcaaatcgggatccgttaccgcttccccggcagccgccattgtcgcgctcggagcccctcagctcaggcggccgaggcggaggcagcggcggcgggatggcggacgccaacaaggccgaggtgcccggggccactggtggcgacagcccgcacctgcagcccgcagagccgccgggcgagccgcggcgagagccgcaccccgcggaggcggagaagcagcagccgcagcacagcagcagctccaatggcgttaaaatgtattgtcttttcctccgggaaccggggcgaggtggggggcggggagtctaccgggcggctagaggccgggctgtgccccgatgggggacaaccacccccagaccccggcccgcccccgggccatcggcttcctgaggagcaggtgcagctgggccgctcccaggcccttccccgcccgccccaggcctggccgcctgtggtctgggagccggggctgggggcccggggaccagcgctcttccctgatttctagcccgagacagcgaacacccctcttccctgactttggttaaagaatctttgagcaaagctcagcgaccgccacggtttgcaggaaaatggtccccctttaaggaccagtagttagtgttcatcactagggagtatctagggatgacatcatcggacatttcctcttaaccaccgagaacatatttaaaaggaatattcctggcttctttctgagcttcacaagtttagtgttttgttgttttctaaagtgtatgttcatttttaaactgatttataccgagaggaagtttaataatgtgctgttagactctatgttttgtgttactcttgaattggctagacgtactttaaaaagggaaatgtgcgatgtgcgtggcttcccttcccactgggtaatgtgcgtcagctgtggagagtatttttttttttaactcagtgtatgattatcttaagtttggtataatagatggttaagattttttttttcccaaatgaaggaagacttttaaggtcgcagctgtcaccagtgcctataaagaatttagttgaccccaatccataataatttctggttctagggaaatgttatgctctcctttgttcctgtcctgtgggaggatatgaagttaagcgcttactttcatatgcctacctccttaaacctgaagttgaaagtatgttaataattaagtgaaaacatccttttccttctctgttatgcctcagagcagaaagcaatagatatatgctcacagtaaaatagacaagggaaaggtctttctgacctttgtataagcatgtttgaaattgtatggtaagaactggaccagtctgtgtaaaagttggtggcaaaaaagatggggtagctctccccagctctttgacactcttgctctcaaatgagtttgaacaggatcggcagcatcttctaggagaatagaggtgcaggtataagagattggaacttagtggagtttattcctggatgaagagtggtgcacctcagtaattgaggaaccagaaagggaatgaagtgctttctaccatgcttgccaaaatgtgggctttctggaatttggcattaaaaatagaaatgaaaaccggtggaatgataaacttaaaaatatgtgctattcatatctaaacacgagtatacatgccaccttttctcctgaacaaaaagtgcagccttgaattacagagagaagccctcctatacttgggtatgattagttttgatataggggaagtttggtatctaaacctccatcagattttctattcccttctaaagtctcttcatgatttagcaagacaggaaaagagaaaggagaaaggtggagaaagaatccttttctaatttaggaagagaaaaatataaggtgaagaaatgaagaaatattactagtaaatacagattatttccatattgcttataattcgcctctccctttctctttttcccagaagttgaatcgagtccaatttactctcagggatttctcttactgtctattccataagaagatttgtgatggtccagcatgagtcattcaaactgaataactagcgacctagtcctttttttttttttttttttttttacttcgtgaactagtaggagtggataacaaccccaatacataaaccttgagttgattaccatatacttttaataataaaaataattcattgttgattataaaaattaccataatattgccccaaattatgtattggttggaattgaacagagtactgcttgtcatcaggattgaaataatatttgctgaggttaatccatagttattgagggtgggagaccactatgtcttattcttctttgtattcttaaggcctagtaaatatttgtggaagaaatgcagaagtgaactttcatgcttatgaaactcatatacagggaatttagtttgcatattcacacctttagaaaagatccgttttccaactgtagtcttcttctttaacgccaaatggtatactagctctccttttcttaaaaatgaataggagggaaaagagcagtattattataactttattattcatgtgtaattaagtataactttggagtaggtagagattgagagttatattagggtactataaaatattaagcattggagcaaggtaatgtgttctttagctgagtgatttttattaggaataaagactagaactgtttcccccagctttattgaggtaaattgacaaaaattgtatattttgaagtgtacagtgtgatggtttggtatacaaataaattgtgaaatgattaccacaatcacgctaattaacgtatctgttacctcgcatagctaccatattttttggtgttgaaaatacttaagatctattctttaagcaaatttcaagtatacagtaaatatgttaagtatagtcactatactgtaccttagatctacagaacttactcatcttataactgaaagtttgtgcccttagaacatttccccatcccctgctgccctccacctctggtaaacacccttctactctctgcttctgagtttgacttttttaaaagtctgtgtgtaagtgagatcatgtagcatttgtctttctgagtctggcttttttcacatagcccaatgtcctctaggtttatctctgttgttgcaaatggcaagattttgttctttttgtaaggctgaataataatattccagtgtggatgtgttgtgtaaacataaaatataatatatatcatgtttcctttaatcatttatctgtcaatggacacttaagtcgttgtttccatatcttgggtattgtggatgatgcagcgaacatgggagtgcagatatctccttgagatagtgatttcattttcattggatatatacccagaagtggcattgatgaatcatgtggtagttctgtttttaattttttgtggacccttgatgctgttttccataatggctgtaccaatgtatattcccaccagcagtatctaaaggttctttctccacgtcctcagcaacagttgctatcttttgacttttcgataagtcatcctaacaggtatgaagtgatattgcagtctggttttgagttgtatttccctgatgaacagtgatattgagcaccttttcatataccttttggccgttggtatgtcttctttggaaaaattatctgtttggatccttttctcattttttaaattgggttgctattgagttgtatgggttccttatacatttttgatattaatcccttattggatatatggtttgcaaattttatctctcatttcttaggttgcctttttattttgttgagtttcctttgctgtgcaataactttttactttgatgtagtcccagttgtttacttttgtttgtgttgtctgtgcttttggtgtcatatcaaaaaaaaaaaaaatcattgccaaggccaaggtcatggagcttttctcttgtgttttcttctaggagttccatggttttaggtgttataagtttttaatccattttcattttgttttgtatgtggatatctagttttcccaataccattttttgaagagactgtcctttcaccattgtatatttttggtgcctttgtcaaggattagtttaccatatattggggatgtgtttttgagtgtttgttatgctccattggtctgtgtgtctgtttttgtaccagtaccatattgttttgattactatagatttgtaatataacttgaatcaggtagtgtggtacttttagttttttcttcttgtttaagcttgctttagccatttgagatcttttatggttcatacggatttcaggaatttttccgtttctgtgaaaaatgctgttagaattttgatagagatcacattgaatttataggtcattttgggtaggaaggacattttgacaatattaattcctctcatctgtgaacatggaatatctttcatttgtattattttcaatttcttttatcattgtttgatcgtttttcagtgtatagctctttagctttcttggttaaatttatttctaggtattttattctttctgatgctattttaaatgagattatgttcttaattttttggatagttcattattattagtgtgtagatatgcagtggatttttgaatgttgactttgtattctataactttactgaatttgttctaatagtttttttggtgttgtctttaaaattttctctgaataattttctatataagatcacatcttctgcaaacagagttaattttacttctttctctccaatttggttgccttttatgtcttttatttgcctaattgctctggctgtgaccttcagtacaatgttgaatagaagtggtgagcatgggcatcttctctttttcctgctcttagaggtaaaaccttcaaattttcactgttgagtatgacattagctatggggttgtcatatatgacctttattgtgttgaggaacattccttctatactgaatttgttgagagtgtttatcttgaaaggatgttgagttttgtcaaatgctttttctggatctattgagatgatccttgatttttaaaaaatccttcattctgttaatgtggtgtataacatttattgatttatgtatgtcatccttgcgtccctgatatagataccatttgattatggtgtatgatccttttaatgtgctgttgaatttagtttgctagtattttgttgagaattttcacatctgtgatcatcagggatattgctgtaattttcttttcttgtaggatccttgtcttgcgttgttatcagggtaatcttggccttataaaatgatttgaaagactttcctcatgttcagttttttggaacagtttgacaaggattggtattagttcttaaatgtttggtagaatttaccaggtcctgggcttctctttcttgggagatttttgattactgactccatctcccttgttagtggacagttcagattttctaatttttcatgattcagccttggtgagttgtatatttccaggaatttattaatttcttctaagttatccaatttgttggtatataattgttaatagtagtttcttatgattctctgtatttctgtggtatctgttataatgtctcctctttgatttctttatatatttttctattttttcctctttgatttctgattgtttttcccccttaatctagtttgatctttgtcagttttgcttatctttcaaaaaccaacttttaattttattgatcttttctattgtttttctagtatatttcatttatttttgccctgattttcattattttcttctttctactaagtttggactgagctcttttttctagttccttgaggtgtaaagttaggttgttggagatctttattcttttttttttttttgatacagagtcttgctctgtatcaaaaaaaaaatgtgcaatggtgtgatcttggctcactgcaacctctgcctcctgggttcaggtgaatctcctgcctcagcctcccaagcagctgggattacaggcatgcatcactacgtctggctaatttttgtatttttagtagagacggggtttcaccatgttggccaggttcatctcgaactcctgacctcaagtcacccacctgccttggcctcccaaagtgccgggattacagatgtgagccactgcacctggcctggaggtcgtttttcttaatgtagacatttactgctctgaactgccctctggtagttttcctctggaactgggattaatattggatctcatactacaccattatacttttaaaatcacacattaaaactatgtttcttcttttgatgttggagcttgatttttttcagaaatgtatgttataatttagatacgcatagttcaattttaagaatagataacatttttatgactattttagggtttttattttaagtacattgtgggagtggttgtctaaatgaacagtttgggaatttagtacttggaattctggatgtagtaccaatattttggaattatgtagcatcatttccttaagagttttcacatatatttttactttctcttccaaagtatttatgacttggaaatagttcagaaattatataattatggctcagtttcttaataattagatcatccctgtagcctctcaactgttatgccttttatagttttttttctttttttgttatacactgggaagaaacttaagataaattttaattctacatcatagatgagcagtttagcagtatttttaagatgcttcttatgggggaaaaatgaagaaatttactttctctgatcatctttgagtaaatattttaaagaaaatattatatataatgttactgtttttaatggaattttcagattgttgtaagcaaatatttaatctatgtaaccccacctaagtcaagaatagaacattgtaagtacttcagaactttgtgtaattttcacaattggtttaatccaggaagaaaataggcaggggaaggggtattaatctagagactatatagatatctgcttactgaatagagtcttagttactttacaaacattcactgaattcatctaagcctattatgtaaacaggccctttgggaattgaaaagaaaggtttgttcttctatctgcggtactcagaaaccagagaaaaggcctttgtgccttttggctgcttgctgccattttcaaaagtgtcactctgtttagacaggtaggtactttctagatttagacagttgagaagactcccccctaggccatgccatttctgatgaaggaatatgtttgatagtgaagatgtcctttttaaggtctaaaaaaaatggcaaagcaagtttggtccaaatgtctctttctttattctagcagtttttctggcaacatctgtgctcagatgagtatggattcttaattgactgttaattcattaaaaaattatagcacaatgttatatgcagtcaccgtgcgaggtgctgctgataccaaagcagatagtttttgttctcatagagtttacatactatatttatggctgtgttacctacaaagaagagtagtgttcaagaagctctgtatatattatgtaacaaatgactgcagttagaggtgtgtggagcattgcaatgtgtggatcaccagaattgctgggcttagaagataatttagagcctggctcatgaaacttggtttgttgtcagaataatccagaaagctttaaaaaaaatttagattcctgggtgtcatccacagtgatattattagtaatgtttgtgaaaaattgctttaaaattgaagttttgttattaaaatagttttaaattgactagagcacttatttaaataagaaatctattggccgggcacggtggctcacacctgtaatcccagcactttgggaggccgaggcgggtggatcaccagaggtcaggagtttgagaccagcctggccaacatggtgaaaccctgtctctactaaaaatacaaaaattagctgggtgtagtggcagacacctgtaattccagctacttgggaggctgaggaaggagaattccttgaacccaggaggcggagattgcagtgagccgagatcttgccactgtactccagcctgggtgacagaatgagactgtatctcaaacaacaacaacaacaacaacagcaacaaaaacccccacaaaaaaccctattgtttgtgctgtaaaaaagacttgttttgaaaagtaaattgcattttaaaatagaaatccaaatttttatctgtagggtttaagtgtatgcctacatcttttggatggttggcatatgacatcatagagttgcattgtgattacggtattataaattacttttttttctagttaaggcctcattaaaaatcaggtttggccaggcgtggtggctcacgcctgtaatcccagcactttgggaggcgaggtgagtggatcacgaggtcaggagttcaagatcagcctggccaagatgatgaaaccccgtctctactaaaaatacaaaaaattagctgggcatggtggtgggcacctgtaatcccagctgctcaggaggctaaggcagagaattgcttggacctgggaggcggaggttgcagtgagtcgagattgcaccactgcactccagcctgggtgacagagcaaaactccgtctcaaaaaaaaaaaaaaaatcaggtttataaaattttggcttacgttgcttttatgtactgcttctgtcctacattacccattgtaggtaatattaatgaaactgcataatttgatgaagtaccctattctagtttataggttaaaatgtaacataaaatattaggatactttataagttttctgtgttgatcaaaattgggaatagaagaaagtttgagagtcttaatgtgagtatattcatatatagatgtggatttatatacataactttgtattttaattatgcttctaattaagggaggagaaagttctgagaagaaactattaacctttaagagatgaactttttcagagtatcactgtgtaagttagtttttaaaaaagtttttaatgatgcccagaaagttaattctccatcaaaggtggcagttttagataccttagaagtaaaattatctgctcttccctctgttccagtctaatagcatttattaattaagtagtgtgatgggaaaaactgggtgattgtttggatgcttacaactatttaatgtgggaaaaaaatgaggactgttaaatgagaaaccaaatccttgctttgaaatagcattgggtaatttcaaagctctcaggctgattctccagctactttgctgaggtctagcttagtggagagttttgtgaggtgataaatatggaatacttatttaatatagacttccattcttataagcacaactgagggtttttgtttgtttgactttttttaattcacagggagaatgatgaatcagcaaaagaagagaaatctgacttaaaggaaaaatctacaggaagtaagaaggccaatagatttcatccttattcaaaagacaagaattcgggcgctggagaaaagaagggtccaaatcgtaacagagttttcattagcaacatcccatatgacatgaaatggcaagctattaaagatctaatgagagagaaaggtaactatctctgaaataacccactgttggataatcttcatataggcaggggagggaactacacaaacatttttattcctctgagccacacagactcaaaaaattgatttttatttcttgacatgtgaattaatcttttcctcttctttctcttgacacaatttcattacaaggtagtatggatatttttctttttgccattttagtgggatagtagcgagccagcatatgcatgccaccaagaattttgttaaagtgattgctttgtctagttgaagtttttatagattttaaaagggctattgcattagttaagcaatacatttagcgtgttaagaatgaataataaggtctgattatttattttttttccaaaagctgttttgttactatcttggtggagtctggaatctggctgtggaatttattttgtttgcattgtcatgactgccatgatgctgtctttgcagttctaaattaaaattgcattactgctgttgcagttttgttttcagaataatctgaaaaccttcatcttatatacatggttggttttggggaaaaataattttaatacttgatcttgtaaaagttagttttgttatctcttgaaaaattgagtttcaacagtcctgcaaactatgtacttggctttgaggctgatctcttctaataaatttttttttttaaattgcattggtgtatctgttgtaaggtgacaactatttgattggttttattcattgactttatttagaaagtgtgtggcttgctgtgaagcatgatttgtaaatttagtttactgatggcaaacatgattgaagacattcaggtagaaagtcaccttaaaacagctgttgtgtgtaggctgaccaaagttatttgaaaagtgctaatgttgatgttttttaatatgataggttaagggaccatttgtatgtatatgtgcatttgttcaccaactatatcatgctggccaaaatatgatctgtagtatgaattaggttaatatggttgttagcttttttttagagaatgtggatgatgtacatttctgaaaattagttaaatttacatagccattgataggaggtatgttggtctggttttgattgttggtgaataataggtgcttctctgtagagttgtgcacaggtgtgcagtaaagcaagatactggtgtttaaatgtattgtttcttggtatcttccttttgtatgtcttatgtagttggtgaggttacatacgtggagctctttaaggatgcggaaggaaaatcaagggtaagtgctgtgggcaataatctgcttgaggtttaaaagttcctcagcagtttactttttgtataatacttgtaccagtttttggaaacttaagtttcattttgttttactttattatgcaagatttgaggctctataccagcaagtctgacacttatacaaacctagctgcctggaagggatgggttttgtaaacactccaaaggggcattcacttttccaatgctctaaggtaatacttcttcttagccaataagattttagcataggattttttttgttgtattttgatgtcttcaaggatactttaaaagtcactgaattgataatattcctgagttttttgagggctatagcttaaaggtgttagttcagaatgtatttttgaaattttactgaaaagttaaatttggtagcctgcaggactacatgagaggcagtgctctgaccaattggtatgaatgacatttacgattatattgacgtagaaggaattggttgatagtatattttgatttttagcaataagaatgcagtatactgaagaatacaatggaaaactcttagcaatgtttcattatgttagtaaaactagttgggtgcatgatgaataaaaattttgtcattacattcatatgggactttgaatggcaatcacagggaattattttttaaataactctccaaattaatttattattagtttatagatgatttttacatacttccaactgggtgctgttaaatgtgcagccagttttaatctaatagagaacttgttaaaaataaaattaatatttattcactattttgattttaatagagttgaaaaatatgtcgtagacaatacattttttgaaaatatttgtaactacagaaggataggtctattggagcctttagttatttccttgaattcctgttgatttaatttgtgcagtgacattaattttaacttaatgaaaagtcacctaaaagtgaaaaatgtgctccaagcttgttacatgttagagtctactatctttaatagatatatttaaaaatttagagaaaatttgtggttacttgcctgttatgttctggaggtataaaagatgaagtgattctaccatattattaattgccttaatgattgaaatgttagaactgattattaacttcatgtactgatctaaaactttttttcttttgcatattttgacaaatctacctggatatagggttgtgggtaagaaattttttctttaagtatcttaagtcaaattaaactttggaaaaaaattagcacataaacatttcctataaattttttccctattaagtgtggttgaattcaaagatgaagaatttgtaaagaaagccctagaaactatgaacaaatatgatcttagtggaagaccccttaatattaaagaggtaagatttctcatatttagaatttaaacatttgactataaagacatgttttccttggattttcaatttggtaatatatttgcctgactacaacttttttttaaaacataggtgttcattaaagcattatatattgacgaaagttttacttgtacatgattttatatttgctgttaagcagttatcctatatacttgattggttccaagttgttaaaaataaaagcacataatttaaaaaaatttgaggacctagaaattcaaaggggataaactttaggtgctaagtttatttggtacagacattttcaatatttagattttgttatttgagaaatataatatccttgtaattgataattaaaggtcacttaatgcaaatatgttatggatttgaataaaattgatattcactttttatcagagttacttggaaactgtactagattaaaatttaagaaaaattataactttgttagtgaaatttataactagaagttggaatcccctaaaatggaaatgtcttctttgtacaaaattgtagcagtgtaaacaggttgacaaaaaatgactagaagatacaaacaaaaaatttacagtttaaccttgagaatgattggcttgaatagcactcatcttcataggttcctttattttgtattgttaatcttaatagtttgattacagacctgttatgtacatatacttgctaaagtctgtgttaaaagagataaatagtgtaactttgggaccctgaagattttgtactaatactgatgctaatcattggttgtagagcagtactgtcacccatggcatttaatagtatactaatgatttgattcctggctttatcactttctagtgggtgtctagacatgctacttaatttctctaaactgaagtaatggtagtagtactactgataatagaggcataccttggagctattgtaggtttggttccagactactgcaataaagcaaatataacaataaactgtgtcatatgtatgttttggttttgcagtacacataaaagttacgtttatactatattctgtttaaagtgtgcaatagcattatgtctaaaagcacaatatacatgccttaatttaaaaatactttattgctgaaaatgctagtgatcatttgaactttcactgtaacctttttgctggtggagagtcttgcctcagtgctgatggctgctgactgatcagggtgatggttactaaagtttggggtggctgttgcaatttcttaaattaagaacaatgaagtttgctgtatcagttgagtcttcctttcataatagatttctctgaagcatgtgatgttgtttgatagcattttacctacggttgaacttccttcaaaattgaagtcagtcctctcaaacctgctgctgctttatcaattaaatttatataatattctaaatcctttgttgtcatttcaacagtgtacatagcatattcaccaggtgtagattccatctcaagaaatgactttctttgctcatacaagaagtaactcctaatttgtttaggttttatcatgagtttacagcaatttattcacatcttcaggatccacttctaattctagttttcttgctctttccatcacatcttcagttacatccaccattgaaatcttgaagccctcaaagtcatccattaggattagaatccacttattccaaactcctgttagtattgatattttgaccttatgaatcacagatgttcttaatgacatctagaatggtacattctttccagaaggtttttaatttactttgcccaggtctatcagaggaatcactgtctatgacagcaatagccttacaaattgtatttcttaaataatcaggcttgaaagttaaaattatttcttgattgatgggttacagagtggatattgtgttaatagacctgcaaacaacattagtcttcttgtatatcttctttagcactcttgggtgacaagtgcattgtcaatgagcagtaatatttcaaaaggattttttttttgagcaagaggtctcaacagtgggcttaaaatattcagcaaactatccttaaacaggtgtgctgtcatccaggctttgttatttcatttacagagcacagacagagtagatttagcctaattattaagggccctaggattttcagaatggtaaatgagcattggcttcaagtcaattaaggttaccagttgcattagcccctaataaaagagtcaatgtggcctttgaagctttgaagccaaacactgacttctcccttctaactctgaaagtcctagatggcatcttctttctatagaagactgtttcattacactgaaaatctattgtttagtgtagccatctcatcaatgatcttagctaggtgttctggataactttctgtagcttctacatcagcacttgctgcttcacttgcacttttatgttatagagatggcttctttctttaaatctcatgaaccagcttcaaacttttcttctgcagctttctcacctctctcagccttcatagaattgaagagagttaaggccttactctggattaggctttggcttaagggaatgatgagggtgctttgatcttctgttcaaaccactgaaactttcagaccactgaaatgttataagcacaaacaagtgaagtatcttaatagttcaagaagcatcttctgtgttgtgttatccttcttccccaaaggtaaccggtatcttaaattttgtgtttttacctgtttttgaaacagcattaaggctgtttcactttctcatcattcgtgcgttcactggagtagcactttaagtttccttcaggaacttcgatgcaagaggcccggcttttcacctgtctgaacttttgacatgccttcctcactaagcttaatcatgtctaacttttgatttaaagtgagagacttgcaactctttcttttacttgaacacttagaagccattttagggttattaactgacctaatttcaatattattgtgtcttggaatagggaggcctgaggcgacggagagagatggggagcggctggtcggtggagcagtcagaacatttattgattaagttcgctgttttatttgggcacggttgatggtgccccaaaacaattaaaacatcaaagatcactgatcacagatcaccataacagataataatgaagaaggttgagatattgcatgaattaccaaaatgtgatacggagacacaaagtgagcacatgttgggaaaatggtgctaatagacttgccggacacggggttgtcacagaccttcaatttgcaaaaagtgcaatatctgcaaagcacagtaaagtgaagcacaataaaatgaaatgtgcttttatttacctaataggatttttatgaggattaaatgagatacatggtaaagaacttatgttctggcatcagagaacctctctaactcagggcaaattacttaaactttctcctttgttttcataattactaagatgggagtaatgatagcacctacctcatagtgctatcaggactcgaagagttaatatatgtaaaccatttagtgttggctatttattatgcttgtgatattaccagtgtacaaagcactaagcacagtgctcaaaatattttagctacataataaacgttagctttagtaatgatgattgttactcctgtccaagagtcttttgttcctgagtgtgagataatagcttgaaatcaaaggccatgctaccaacatataacatgtatcccagatacctttatttgagcttgcttccaaattattctagtcctgtttgagtctggggtttattattaaaaaagttattaacaggaatgtatagaattagcagagaaaattttgactgttgtggtttgtgtcagccaattattggtggtttttatgcataagccagggccagtgcttcagaaatatattggtatcttaattttctttaaattataataatcagaatgattattttgaggattaaattaggttggtgcaaaagtaaatgcagtttttgccattaaaaaaagctttgaattaaaataatggcaaaaactgcatttacttttgcaccaacctgacaattttctgttttatgttttctgtttctcttcaaaggacatgtactacagattcttagtgtctttttcttttattggaaaaaaaagtttattggatgctaaatatcatccaataaacttccatataatattggatgctaaatatcatgttattgtgttcttttaagtttcagcacattgtagatcctcagtaatatttcagagaccctggagttatataatccaagttgaaagaggatgccgccatttttaacttttttaagagaaaaaaaaaaggctaaatttggcctagctaaatgatgagggatttattcagttgacttttttgaattaatgtcactttggcagtccctttcctgggatatctaatttatagaggggtggatggaatgaatgcttagaactgctactgaggaaagtctaaggaaggtgtatttccaatgttccttaacagactttagagttacatttttttcatttaattaaatgcagaatagtagcagttataaactgctattgtaggccctccaaaagcaatagcagtcagtaaccagcaggctgacagcaaggggaaaagaagagtaaaagtcatgttatatagtaggtggtttgttttatataaattttattttatatatgttttatgtatgtatgcatgtattgtatgtgtatatatttctgtcatatatatgtatataaaagacagatcaacacagcaatacatcttgttaatgttataagcacaaacaaccgaaatagcttactatactagttgaagaaatatcttctcttctgagttatctttcttccccataggtagccactgtcctaaatttcgtatttttacctctttttgaatcctcaggcctaaagaatttatttattaacttatatgttttgaagcattctttgatacattttttttttcttttgtaatcctttttattccttcatagtgaagaaatatgttgcaagccagaatggttttattattttaccttttcaccttttattctccagccatcctagagaatttattaaaatcacttgactttctttttattagtactgtattcccagactgaggccagcaaagtagatttgatggttacctttacacttcatcttagcctaaagatagagaagtgatgatggggtgattacctttaacataatcatttggcattgcagatgatagtctatccatgtgtttatgtggtttttgtttatttatttttgttttttagtattccacctagtgggatgagtgagaagtacatttatgtttgtgtgtgtgtgtgtgtgtgtgtgtgtgtgtgtatgtttggttttgtttaaaggtagggtgtttctcttaaaaaattaatgaacctaacaaaaaaacaatgtttaatatcatttctcacttggacatttagccctcctttatctctcctctcctccatctcagattataatcattgttgaagaaggtaagagtttagaaggtgggtaactgtattttgttcaggaataaaatttacagattacagtcggccatcctatcctctaccccagtatttgggttttataacagtctgttccagtattgaaaagctttgaattagtctgaatttggcattccattgggcatccaatagtgagaaatgaccattcctacattttggaaagaaaagttgcagtgagtacttcgctcttctttgagttacatgtatgtatgcatgtaccctagtgtgagagcaaaattaaactaatttcaagttcttaagtggctttagtgattggaaaaaaaaattaactgacatctctggaggctgaaatattttgtttatccacaggtttttatgggactcaattctctggatgagaaaaaagctcactcttcaagagggtcaataatttgagccagacaggatagctactgtagaatttaaattgttattttaattttgtagaattagtgatgtatttagtggaatttaacattcaatgtgtgttataggatcctgatggagaaaatgctcgtagggcattgcagcgaacaggaggatcatttccaggaggacacgtccctgatatgggatcagggttgatgaatttaccaccttccatactcaataatccaaacattcctcctgaagtcatcagtaatttgcaggccggtagacttggttccacaatttttgttgccaatgtaagttcaagctttagtctaaaatttgtcattcagatagatagctaatttgattaaatgaatgagttataggtttatagaacattttgcttatttttaactaaagtaagtgaaatagtaattattgtaaactcaaaatcaattgacgtatatacatatatatacacacacacacacacgcacaaggttagagtttaaatacaactatttggattttttaaacatggaactgtgcagtttatacacattcaagcagttcttgaaattatatgtgttttggtttatattggtaaatggatttctttttttagtcttgatatttgtgaatatgcatgccatagttggtttgttatttgttctaagcatctgaaagtcagtgaaaacaatacttttcaaaatctggatttctcttggtaaaaatagatatgcaagtttcaaatgtacaaaacaggtttgagcagttgagagatgattttggaaattaaaaaaaataaggataaggaacaatgtagacgtagcttaaatgattttaagcaactgaagatgttttaaaatttgaacattatcaatatattgttgaactagaattatggttctttatggttttaagagtttagaaaagattttttgtatttacagatggggagatggatttattaggtatgtaactttatacaattttatattaagcttgacttcaaagttggttggaagaagctaaaggaagtgttcagcatagctggaactgtgaagcgggcagatattaaagaagacaaagatggcaagagcagaggaatgggcactgtcacttttgagcaagcaattgaagcagttcaagcaatttgtatcctgatttacatttcagcattgtttatgaggttgaagaagcataataccacctttgttttggcggggggtaattgaatttaaggttgcctggcttagagatgtgtgttagactttagtctccagcaaataaaacccttagtaggtccaagtattaaagtcactcttaaaacttgaattggccatattgtacagggctggtatgaagttttttcttttctttcttcctaccacaattaattgtatacatggatttaacaattgtgtaatctattgtatattaatgcagttactttaagcgaagccttacgagtttacttttttcaatggttgaattaaaaatacatcttattgatgaaataaaaccgtaaagcaaagaattgaatatttttttgagtatatgaaagtggctaatatcaataagtattaaagatgttaattaaaatatcagagagttggactctaagattattaaaaattagtttgtgttctgttataattttatagttatcttaactgactttccttgactgaaccaacagctatgttcaatgggcagtttttatttgatagacctatgcatgtgaaaatggtgagttcctgtatatcacttcaacctccaacctcttcagatcttttattggctctcttctacattacagttctttgtggtaatatgttaaccatattataaactttcttgcaattaggatgacaagtctgttcctcatgaagagtaccgttcacatgatggtaaaacaccacaattaccacgtaagtaaaagctattatgagaaacaacataggctttttttggtttgttttattatgtgctaagcaacactttgtttttgtgcctacatcctagtttctcacaatttgggattagtttggagttatgaagatagtttggcgctattgattaggaagactgagaagataagtgttacgtgccattttttttttctctttggtaacttttcctgactaatcagcaatacattctaaaatgtttggtaaatttatacacttgaaggaaaaaaagtcctctgtaatttcaccatctgtgggtaacctcattataacatttttgtgtattttcttctagcctgctatgtatattttttacatagttgggaacaaaaataattttgaattattttttgtttaacattagagtataagcattttttcatgttgaagattcttttcaaatatttttattggtagtataatagtctatcatatagatgttccataactatttcactgttctgtattttaggtgttttaacttttcttttgagtaaccacagagtaacacatgcctttttgttcacaaatctttgtaatgtttttgagtacttccttcagacagatattctgaagtagatttacagttctcatgggttagtattatcaaattgttttccaaaatgactataacagtgtaatatacttattgtattatgtgtctcagtgcctctgtgtctcagtgcctcctttgaaaagtggggagaataatattgtctacgtcatggggttgacatgagtattacatgaattaatatatgtaaagcacttagaatcattttggcataatgtaaacactcaataaatattagctattgtttttactatttcactgcatcttctctggtttttaaagtattcttataagaaatcttaaatatacagacaaaagtaaaattactcatatagttatcatatgccatatttgttgtagatttttttctttaaaataaataaaattttatggtaaaatggagcttccccatctcccttgcccatctttcaacttatgccttatccagaggaaacaacttatggatagagtatttatcatttaggttttaataatttgactacacatttgtacatccataaacatagggaattgttttgttggatttaaaattttgtttgagtgatatcataatgtattatgtaacttgcttttttttttaaattgtttttgagattcatttatgttgatagatgtagctctagtttcttcattttaactgctgataccacattttatacatttttctgttttttaggttattttaatttttagttattgtgtattaagttggaaagtatttgctattttttatcagaattatatgttctctttatatttgctagaaattatgtgtaaaactggccttcctctgttgtttctgggaagtttttaactactgatggtttatattttctgtcttttttttttgagtcaatttttgtaatttctatttttctaaggattttttctgtttttgttcattttcaaatattttggcttaaattatctcttaagtttttgctacatctatgtttctgttttaaaaattctgaatgcaatttttatttttttcttggttaattttgttagaaatttgtcggttttaatagagtattcaaataactgaatttggatgttttgtatttctaatttctgcacttagccttattattttttccttctatttattggggtttagtgtgtttttgtcctaactccttaagttgaatgcttacttcaaattggtagcttttcctttctaatataagcatttatgactataaagttagtacatgggttttgctatggagcatttttatgatgggtcagtttttagagtatttaaaaattaccattatgggccgggcatggtggctaacacctgtaatcccagcactttgggaggcccaggcaggtggatcacttgaggtcaggagttcgagatcagcctggtcaacatggtgaaaccccgtctctactaaaaatacaaaaaaaagtagccaggcatggtggcgcatgcctgtagtcccagttactcaggagactagggcaggagaattgcttgaacctgggaggcagaggttgcagtgagctgagatcgtgcccctgcactccagcctgggtgacagagggagactctgtctcaaaaaaaaaaaaaaaaaattaccattatgatttcttattgagccatgtattatttgaaaatggaagttttcaatttccaaatgtatgagtttttttttttttcctttgtactttttcattttaatgtggtcagagaacatggtttatatgtgagtgtgattctttggaattcatttggacttatggatggcctaccatatggcacatttttcttaagtattctgggtacagttggtgagtgcagtgatctatatgtgttcattaaatcaagtttgctaatcatttaaattgtcttagatccaatactttttctgctgtaacactgtttatcttattatcttatgtgtctggtaaaattgcccaatagaatagtggatttgtctactttttcttgtttttacttaaatatttttaagctagcttagtaggtgcatctagattagaattgatatattttcctagtgaattaaaaattttattgggtgattttttttctctagtagttactttgagtctttggtctcattttaatgtaagtacagcagctttattttgtttagtacttgcctggtacatttttcctatttttttactgtttcaggcatgccccttataaagggtgttattgctgggcttagactttttaaaaaaatcactttgatagtttttttcaccatgaaattgaagagttcaatttcttcacatgtattggttcatttggattaatttccattatattgtgtcttatttttttgtcttacaaatacttattttactcctatcttggattcttctggatattttaatatttctgtgaagcctgaagttaatataattattcttttatgtaatagtagagtgacctttggatacagtcactttcctactgaattatactatcattgctcagcattttagttctgtattattagttctgtactatttttttttctgtcctgcaaattagacaatgttatttaccattttcttgtgtcatcactcctctgcttttatagactctggcactaatttttttcccctgaagcatatatgttagaagctcttttaagtgaggatcttttattagtaaattctctcaattttgggttttaaatgttttcaaagatagtttaacttgtataaagattgataattattttctctaagcactttgaaagtattctacagtcttcatgtttacactgttgctattaagtcagctatttgttgaatcgtcctttctttataagtaatctgtccttcctgtgcagtttgtgcagtttgacagcaaagaccaaagtcttaaaatcagctacatgtcattatgcaagcaacctaaggtctcaaaaatttcctcttctatggacaatagatgtggaaacacttaaggtgccatataaatataaataaatatttatatcaatgagaaaactaggtaatataatatttgccttattcagtgttatactttcatggttattgactttttagtttgatttgaaccatttaaaaagtaattatcaaattttaagtgggtctacaaatttgggcaagatactcattttcagatatgtgtgccatatataaggtgatatgatattattcaaaatcctctaggtattttattattcctctcagtgtacctttaagtggggtataaggtgtactttgtattatatcatgttttatttcataaaacacttctcattaataaatggttttatagtcgggcttcagtgtgctactttctagacaaaaacaagaaccagtgcttttatatgaaaatttgcagaaattttacagatactactacaggtatatagctttttaaaaaattttattgccaattagttaatcatatatggatctttgtaatgattgttctcatttttgttttaggtggtcttggaggcattgggatgggacttggtccgggtggacagcctattagtgccagccagttgaacataggtggagtaatgggaaatttaggtccaggtggtgagtattctaacttcctcttttctttttaaatgatacatatgctagctaataaagcctccattgatgtggtctgtaataatgtttaaaggactctaattaatagttagatatttacggtgtcacttcattctgaaaaaggaatgaaaccttgagcacagctaacatgaaagagataggcagaagtcaggagggtttctttggggccagctatgttgtagctagccttttagcattttggattttgaaatgtcttgaaggcagaaggagaatatatcatctatgaacagtatttatggagtagctgaaatgctaccatatcataggcagctaaaatctgtttatccatttgggaaggtggcttttcaggtagttatttggctgctcacctggaagaactcacagttcatttttagagattggtttttaaactttggtgttaggacccttttatattttaaaatttgttgagaacccgaaaatgctttgtttatgtagttataattaccagtatttactgtattataaatgaaaaattagaaattaaaaaaattacatattaaaaaatgataaactcattacatgttaacatacataaaagttttaagaaaataaactatttttcaatgcaaaaaagaaattggtgaggagagtggcattgttttacctttccacacatctttttaatgtttggcttaatattgctgttatatctgtttctgcactttagttttttgtgatattgtacatcatatagtgtttggaaaattacaccttaaactcaagagaatgagggtaaaacatcaaataatgtcttagtagtatttggtgacttaaatagttttgacctattgaaccctcaagagtccctggaccatactttgtgaattactgttttaattgatggactaataaatgctatcagattcctattttgtcaagatgctgtagtcacactttaaattatgaggctcattatcataatcattctgatccaaacaagttttctcccttacccttagactctcacacctacctaccctctcctaaatacatactatttatattttgaaaatttttactgctcttttaactgcgatgtttagagagtccttacattctggcctgatctctaaatctgctgtaatgctatttctgtgtctatgctggaaaaaaaaaatcattgatagtagtatttctgtgtttattgtggaaaaaaaagtgaatgattacctagttcaagatattctctaactgaatgttgtgggtgttactagtgaattttgctttcttgtctgataaatgttcaaagaaacccttttgaagattcatgattagacagctgctatggcatagcactttaaaccatgcctcctgtaccctaccgcttctctagtgtttcattgtggttataccagtggtatctattttgctataatgcattatatcatcttttagtcataaaaataaaatatacttaaagtacatactgtgtattttatttgaggtatgggaatggatggtccaggttttggaggaatgaatagaattggaggaggtatgtataaagatttgtttttttgtatgtacccatcaccatttttaataaactagaaactgtgttgagaattccatgaaaaaaaagtcatggtttattgttggctcatgttctaaaggctgctagcagaaattgagcctggtacatacttaaaggaaggtgatgtgttaagaagtagctgcacaaggtagggtggatgaagagcttactggtgagatttaacatttacaaaacgtacctttcagctacatgactgacagttggatctcaaaattaatctttattccataggaatagggtttggtggtctggaagcaatgaatagcatgggaggatttggaggagttggccgaatgggaggtaggtaaatgtatgcagtgggaagtgtgtgcatatttagttttccctattattaatatttcccccctataacttaggaatgtgtgctaaaaatgtcttcagaaggcatataggcactaggggataaggacaggcctggggaatggggatgatatgtgtggcatgtgaggtaaattgggtaaatgacagactattttatatttgtgacttacgcgtcttttcataatttagatacattcctgaatgttttcaacatgtattgatatatttgaaaaggttaatttgttgcacaattttttcagagctgtaccgtggtgcgatgactagtagcatggagcgagattttggacgtggtgatattggaataaatcaaggctttggagattcctttggtagacttggtagggctggctgcatacttctccttttctttttgtaggctataatttttgaaatttggtttctctttttttgtgaaaaatcagaaaatcataatgttttatacaacttattacctgaagaaaacactttaaggattttaatatgctagctctctttttcaacatcttacatatttgaactctattttcagaagactttatgcttttcatttattgtaaatcagagcacatagtaccttgggaattttaaagtatgattatttaaaattaattagtatattatctttccatccttgtttaggcagtgcaatgattggagggtttgcaggaagaataggatcttctaacatgggtccagtaggatctggaataagtaggtttaaattttactagaatttattcagtaatatttgagtgcttgcaaagactttgcaagagtagttatcgtagtatagtaatactttgttcttatacgttaatgtgtcttgctataatttgagaaaccttgataattgagcaaagcctttctgtttgattattgtttgaaatttctaaattaactgtttgaattttacttttttgatatttctaaactatgtgttaacagccaatccaggaaccttctttccaactaaggaatctggggatttctctgatcatgtttcaggagcaacttttgctttagcaccaactttgtttccttgcttattttctataatagctattagtgactagcttattttatttgtaaacatctatgtcttttggtaaatgcagatatagcactcttaggcatctcctgagcttgagtcaggctaaggttgaaagaggtacttaattcttttcctcttgaacctttcccgtaatagcatcaagagtagttgcaacactggggaatgctgaatctcccatccgtctatttccactcctaccttttaggccttatattaagcctgaatacatggattatttatttatttttttaacctcttttgcttactgggacatgtctctgagctctccatactttattgacttcctttaattgatcaaatttcacaaatagaaaatacaacctatttaaactattctaaaagtaaattctaaaatcctgtcagcttaagacgtctacttccattgtatcttgctccttttattcctccttccatcatcttttagcctcagccatttcctattagtcctaacttccttaccttcctcttttatctcagtgtttgtacttctgtttccctgattttatattggttattcacaaaaagccaatttgagggtgatgttaatttttagaatttccatgtttggggatattacatacaagacaaaaggtttgataatgagtaagatgggagcaattgaaaaggacaggaaatcgagtcagtgcataagaatgaagtaggtatgagttcggagctaaattcttaagctctggctaacgggaagtgatagcattttttgttcccttgacaagttccgtgtaatattgagattaaaagttatgttttgctatgagtattgaattaccatgagaataaaaactgggaaacagaggtgaagatgctgaggtgaaagataagctaggaaaggagtatttacttgtaggagagtatgatgagagcggcttgagtgctagagttgtaataatttgcatttatctctgtgtatctttattttagcaattattatgcttgatattattggaaaataaaaataaggatcagaacaactgtcctgttattggaagcagtgattggtagaggatttatatatttatatgatatatttagtgatcagaatacaattttatacagttatatatgcataatgtatttatacagtggctagaatttctcagctaactaaatgtatatgtaagcaaattctgttctttggaaagttgttatctgtatgaaaataattttatgtttttatattatttaattatataaacaaattaatttcccccttctttctcaaaaatgtttatctccttttcctcctttctcctcttctccttttccttatgtttttgaaacaaaaacacaaaattcccaaatccccccgtcctttcttgaaaatccaggtggtggaatgggtagcatgaacagtgtgactggaggaatggggatgggactggaccggatgagttccagctttgatagaatgggaccaggtataggagctatactggaaaggagcatcgatatggatcgaggatttttatcgggtccaatgggaagcggaatgagagagagaataggctccaaaggcaaccagatatttgtcagaaatgtaagcaaataaatattaaggataattcaaattcttttttttcttgtatatatgttactaatacctcttttcattctagctaccttttgacttgacttggcagaaactaaaagagaaattcagtcagtgtggtaagtatgcaaatgactgcagatatgttgatattgattatggaggaaaattggttttaaacttttatacactgtgtttagacctttgcctgtccggatgcctattcctggatagtcttgatagcgtgccaggtctaattccacttcaaataaatgaattatttcactatcttttgacttagagcagtgctattactactaggtaataacaaggtttaggtaacaaggtttaggatataccctatcattgttttctgttaataaagatagggcttattttattacctcattttaaaaagataaatatattatcattctttgcattaaactttttttctcatgagaaatattaataaatggtatatttatttccttgtttatagtatagtgcaggggattatcagcataaccaactgagatgctgatgtccaattgataaaggagttaataggtgagacccattctacatacactgtattcctacccaacacaggaaacctagctggtagcatacaacccactgtcaggaatgccttggacatgggtacattttggttgcccttcttattcttttataaactgttcttaactataatgatactacttatacaaccttaatgtgttccacaggtctgtggaagattaggtggtttatcacttttaaaaaagagctttttatataccatacttaacttttgttacaaatatcttaattgactaaattctcactttttctttcttttgcaataatgagagaattcatgtgagtgttataaagtaaaatattttttgctagtattaatatttttctgctattgcatggaatctcagcgactgtagtcacaataggaaattacataagatagcatatatataatttctgaggtcatgaaggaataggtttagtgttctgtcacaaaatagcctttgtggccactacagagataatattatctcatatttctttatatctaactcttttgtagcttttattatattaatagttatttgttcaagttttcttccatcctacgtggaagctcttgaaggcaagaattgtctttttatcttagctccttttattgcctctgtacatatggtaagagtttatgaaaagtttataagttaagcattctgggtagatgttcatttattcagtaatttattcattaaatccacaaacatatttttggcagtctgttaggccctagaattttgaaggtgaacaaagtgagatgctcctgccctcaaagaacatacaacatgaatttgtctaggatgttctgttgactctctttcttgatcatccttttattttgaactaatcaaaaattcaagaaaaagttgttgaaaacaagttaactggttaatagtcaccactaagagaaagcaaaatagtaaagtggccttgaggtattggtcttctttgcaggagtaagaagatctaccagaatgagtaagcagtgtctggccatgaatcctgtagactacagaggaaagaatgtatatagggtcttagtgaaatacatcaaatgaggaacagtggcagcaagtataatctgtgttgatttagtttgagtgaaaaaaaaaatctccaaatgagatatgacattatgttaaaagtagaaatgaaacttagcaagataaagagcaaagcaggacaaagaaatgacaatgaaaaggtgaccattgttgagttgactgttctttattctttgtaggctgctttctgtttgaggttagatatgagcaaggcttgcagcaaacttcaagtgtttggtgggcttctggttggagtggcattgttttgacatgaggacatcagcaattgcaagacattttttgaaaggaaaaaacattcaaatctacatagaaaatttttatagtatgttagccatataaaataatggttaaattattattctttactttgctattttagctctattcttataatcctttttcgattataattatattttaagattaatgatttttgttttatcaattcttttgtaaaagtttctgactcttagattttatattaagataataccatatttacacaattccctatatctcccttatttttaaccttgaactacattgatggaaaagttataataatatagaattaagtgtccagctattgacaactatacaaattatctagctagtatgaactgaaccatccatttttctgccatgtcacttatttataaatctttttcttagtatgagacatttctttttaacatgctgcaagccagtaatggcctcttgggcagtaaaaggcagtcttctgttgttgtttttcttgtaagcccaaagagagtaagtatattctcttgcttgcttcttagtaagaatctagtagtactccttgcatctcccataaacaatatctgtcagtaaagggtgccactggcaaccccctctgcttataaattatctctagtgattaactgttcttgatggagtaattacaaaggctgagtaaatgttatattatgggttatattaccctcaatagaacattttctcagcctttgtaattcagaaaagattgttttcagatctttccaaatataacaagatgagaaataagtgaatataactgctattttctggttccatcaagcccctaaaggtaacatttttgaccccaggctggtaagatacacatctttcctgtagcaaaagagatctatctttttatcttgccttgtgtaattcctcagagagatgcattttcaaaaaggctgagtataaataaattaacctatttagtattggaccccacatcatttcagcttgtgctaatagggtcaaatgggcatagtcttttaaatgtgctcccatgtcatctgtatactttagctgcattctggccttctggctcagtatgatgcaagactataacattttagaacttcagcacaaggaaaacccattctcagttattcctgctataagccatataaacagatataactttgttccacagatttccattatgtagtatttctacatcagtgtgcttgtcaactgcatggaaaatggaggcttatggtagattttattgattaaagtacttgctgcttcaagcattttgagtggactttagaataacttaacagtaaaattgcagtaatagtacaaatgatatatgatgagcattcattgataggctctgtcttttgtttgtaaagaaacaacagaatactttgcttttctatcccttatatccttattatgttttcttatcgtagaatttctgattttcctgttttcatccgtggttgtgttaacttcatgtaggcagtagattttattgaacatcctttaatttggtctatttttacatgtgtttttatactggcatatcccaaaatataccccacaagatgtttatagactgggttaaataaaacagaaaggtttcttttactgtgggacaaatcctttttattactagtatatgtaacagcaatatgtttgattattctgtgatactgatttctcatggcatactattttgtcctgtgctgttgccaaaatatcagtcctgtttttgttttcttggaatcgtacaagattattagatatttaacttagttgaggaagttctcagagcatgtaaaaagtcaggcaggtttgattttaatcagctatttgaaactaatttttttctcctcaattatttatctttagaaaagaaaatatttcagttggtgtttttataggatcaggaagaaacttagaacatctataactctttctggttctgtactgctgggattctttttaggggagcagtctaaccataaaacaaatatttatgggctactgtccatatagcttgaacatcagaactgtgaggaagttgaagtatcttagctgagggaacttgtcaactagaaaatttttgaggtcattgtgaggtcaggaatttggaggtctgagtgctgatttctaaactgaaagaggcaatttaagagaaaaacaaaaaagagaaactgtcctgaaagatcgagagacagattatgcaagaaatagtgacatattttcttttgaggttttgaagatttcttgcttaggtgaactttactattgctgataaatctatgatgggatacttaagaaaaactctacgtttttaggtaaaattaagataaggaagaacctttaaccttaaaagcccttgaaaatcctccacagttcttttcaaaataactgtaaggtgctgtcatttaccaacagcttctttaattaaacttgctttttttcaggtaccagcattcaagatattaagaggactctggaaattgtgctgcatttatctttaaattgttttaaaatgtgttttccagtttcattttatgatgtttattagaaagtgtgattgctatgtttttgctttttttccccatttcattccagttgtgggctaaatattatttggatctactttaaccattatcatgtaatttctctggagattagcctattttataacttttcagaacacatttaaagactatctggcctgtgtaacaagatactggttttgtctcagtatgacatttattatcctagaccatttaattagtgtttagtaggtgagcagttgactaccagttggttttcaaaaagaaatgcagtaatagggagtggatgaaaaagtgaaagtataaagtagtccatcatgttataggtaagagattattcagatcaagatttcaacagaaaaaaatcttccttatggattgatattaaagtttgatcttatcatctggaaagggcttatgcagtttttcgacaggtcctcttgcttttacctttctccttttttttctcctcccttcctagaactaaatatgtctggctgtctgatttggttgccagactaaaattagcccatagtgatctggcaactataatatttaaagtcttctaacttgatttgttttgacatgtacatctagtggggagggaaatattttggtaagtagtcacaccctaaatttatgacctgtttggattgagtgaccatgtattccagtttgcctggggatagtctccctttacatctgttacttatgtgtaattattgataactcccccttttactctcaaaagtgttctattgtagtgatgaattcttatggccactttttattttgataaatggtattgatttacttcaaatacgagtctctagagttagcaatgatattataactgcataaggacaggtttctggttttcttcctctttcctgaagcttctctgatattctccttgacatcactgtttttacctttattgatttaaatctgtgctatctcttcccatgactatttccgtagcatatttggtgccattcttaagactttgagctcaaactgtgatattgaataaacggctttggcactgtggttgcaaagcagaattagtggggccctttgtagcctgatagaaattagatttctggtcagttgcacttgtttgcaggggataaaggagtgaaatgaggataaaagggaaggaagagagattagggagactgagcagtaagcaaccgtttattctaaaaataattttgtttaaatatgtaagtttgttatagggcatggtgagttggcggcattttgtgctagcttgacttattgcttataaaattaacctcaggaattagggatttaacataaataaaatacattaaatcctaagaaaatctttcctgattccaattttgtatattctaatatgtatatatttattactttgtatgaattgtattttagtccaaatataatgcttatattatttattttaaataattaatgtttttaatcaaattaattatcacaattggctatgaggaatttcaaacctataaagtgaaatagaacttatttaaactgactagtaattctgtaacttttattttacaggtcatgtaatgtttgcagaaataaaaatggagaatggaaagtcaaaaggctgtggaacagtcagatttgactccccagaatcagctgaaaaagcctgcagaataatgaatggcataaaaatcagtggcagagaaattgatgttcgcttggatcgtaatgcataatttcaagccatggttggaacattcctacatctgttttgctgaatctcctagtaaaagtcatttttttaaagtaatattgtatgcttacaaaagctgtaaaaatgaacttttaaaactcccaccagcttttaacagtataatgttaaaaatatactgtaatttttgttaatctcaagtttgggtttttaaagacagcaagtctggtcattcagtttaaatgaatggttatactgtttttaatgaaataagccattttcttgttgttttcagtactacatagttggatttgtttgttctagtttctccagtttttgtcaacttattgtatggtaaaacatagattttttccccccaaacttctgttttataatatgtaatttttcatgaaaagaaagggctcagaaaaattaggatgtgattttggttggttttaaattactgtaagttttagattctaaggttcaagatttttaaaatttgatttaaatgaagaaatggatttttctctctgcccctccctgccattcatattttctgcataacactattaataatatcaacctccacagccccttattttattatttccaataattccaagttcatatagaactgataatgtagcaagccccaagtatgataataggcagactattcccaactttctgtctagtttccagccattgaagtgaactgctaaaaaaagaaaaataattgaaatgttgagagagatggttatgtaagttagtcctctgctgtttacttctgcaggagctgatccatttataaatgcagttttaataaaccatggaataccaaggcacaacatatcaaacacattggatcccacgatgttagacatagccatatctcctttccctacaaaagaaaagcatactgttaaaatgtgcttaccaatactgtgttttattaataatcttcataagaaaagaaacactggatacttttttgttgttgattcgttttgaaaaattgttgttagagcaaaagtcttactgaatttgtatttttaaatttttcttgggttagtatttaaagtcttaacatttatttaataattatatttattaaaccatttttcaataaggtatatagcttatttgttgcttttcattgtaatttaacatggttaatggttaattactatttaacacacatttcaaatgaatattatttgggggattagattgagtgaaattaacctgctattaaatagtaaacttttcctctggagtcacttttttcccccttcaaagtatgttactgaggaagtaaacttttttttttttttttggtttttgttttttgagacacagtctcgctctgttgcccaggctgctggagtgccgtggcgcaatctcggctcactgcaacctccgcctcctggattcaaacaattctcctgcctcagcctcctgagtagctgggattacaggcacatgccaccacgcccggctaatttttgtatttttagtagagactgggtttcaccatgttggtcaggctggtctcaaactcctgacctcgtgatccacccgcctcggcctcccaaaatcctgggattacaggcgcgagccaccacacccggctggaagtaaacatttttaaagctacttttactcattctagccttgtagaatgaccattgcagcttgagggacctagttcttaccttttcttgcaaccaacacacttgcaattgtgtctggtatgcttgttcctgctgctaataaagtaaggcccattactgtatcgggaatttctagtgtttcccctgtaataaacagatatttcaagttacaaatcttaaagattcactaaccatcctttgcagttattttggatatttccttcgtgaacaaaaataaaataggcacatttagaattcagagccaatatgtgcttgcttattagttttttagctagcaacatatttgaatcaggctggtaattcgggtaacccaggtagcacagatttttaatgacatatctaaagatacgtaacagctaaaattctgccagtgagaaattttcctgtttgatattcttacaaaagatgtttatgtccaccattatctcatcagggctgtgctgaatatttgataatgagactgatcattccgctttttctttcttaaaaatattagtcagagttaagcaaattaattatagctatctttaagctataaatgtgttaacatgtatatataccatttattatgttctactttagtgatataccttaatttagtgggctttggcagggcgggggagggggaacgttcattaatctctgaggaaaacaaaacctgttttctacttgagtctaacatatggtcccaatttattaatacttctgttaaatttgatgtcaggtcaacatttttcagaaatgtatttattctcagaaacagaaccagagagaagttaaacaaaaggttatgtaactgttcctttaatgttgtaattgaaaacttggtttagcgtcttttttttctttctctttttttttcttaaaatgccaactaaaataattagaaagtagcttatttattgcatgcttatacattgatattggaattggaattggttgttaatttctgttactggctttgctagaattcatatgtgcataaataacactaatatttatcatcttgggggctgttctgtgatctattacatgatttttgctctctttttatttttctagtatcaaatgtgttctggctgagtgaatttggatagatataatatgcaagctaattggactttttcatttttctcattaaaaaaaggaagaagtagtccactttttgctagcatactattctgagacttacattaatttgggaaaagtcaagggtcaacaaatttttgtgtctgtgaggggccagatagtaattatttaggctttgcaggctgtgtgatttctgttgcagttattcagctttgccaatgtagtgtgaaaacaatcatagataatatgtaaaaccttactaataaaaacaagctgggttatgttggcacacaggcagtagtttgttcacctctgctgtaagttaatttgggttaacctttgtaggagaaattacagattatttttgtctttgttcatagtttttttgtttagggactgtagtggattatggccaagcagcagtagctagttaagtcttaatcatgaaggtagtagaaacctagaataaaattattatgcccttttcactcatttcataatatgtttgtattgccgtgttgaaaagccaaataaaatacaatccagttaagcagtgagcacccattgttttcccaaaaatagagctccttgctttgtttttgtttttttgttcttttttttttttattatggaatggaattcaatataaagagtttattgtggaccccatggaatgtgattaaattattagcataataaaaagacatcctatgaatttg

SEQ ID NO: 441 - DNA, 53719 bp, Homo sapiens
ggaatgttagcgggtgggaggtgcggctgggttgctacagccagagctgggcggtggcgggcgctgctgaaggagtctcgctgagctcgaggaggtggcgcgatggagggactggaaggtgaggcgatgaagggatgagggcaggacggctagagcgggcccgaaacagctggggaccctggacaccagtagcaggaaggcgagggctggttcggtgcggcggacctcgccgcgtcccgccgcgcctccggaggctggggccgaagggaaccggacagtccccgatgcggtggagctaacgctaccaggctgccccgcctcagacggtcttcaactgggctttcccgcccggagccagatcctgcccctggcaagacgcctgcacgtctcttcctaccattttctgatcttgcttgactcctgagtgcccttttagtgatcccagtctctggccagattttgttttccttgtactggactctctccattattgtccacggccttaacaccaacaggccactttgtgctgcagccccggggtgtgtctccagcctcgagctcctgacattccttggccgatttccctaggtaaccggctttttacatttcgacagcatcttctgtcggagggatgtcagagcatctcctaaggaagtgtcactggccagctttagagccggtacaatagattacccggaggatttgatgacttattcacggccgctgtgtgaggaagagcctgtattggttccttatctttgggtttatctttgtactgtaaccatgactccagattttgctttgttcccagttctttcactttttctctattctgtttacccattttatcctgtgtaatgaaagcattcacctaaaaacaaaggaaggacaaaaaccacaataactagcattggcaacaacagtttcaagattttttaatttgttatgatgaagaacaaaccttcagaattgaaagatcctattgtcttgatttagctcctttcccccgtctcctagtttacacggattcagttggaattaagaatgagcagaagcttttgagtcttgtgtattgttgcatgccagggagtaaaatattctacattgtgtgatgaagtgcaaagtggtagccggtaactttttcagtcacctattcaccaaaaagcagatgtaataacatgagtagaagtttatttcgtgcttttgctctgataaatgattctgataattttccgtttgtggacagctgcagtatgctatggcctaatgaaggtcttgttttttgcttatgtgtttttggaagataattcaagtttccatgaaataaggaattgtaatgatagtacagtatattttactttcaagatacttttgtatcttggtgggattaaagcatgggttatggaattctcatgagattatcatatataatatgataaggttttattacatattatctataaagtgttttgaacagtttgcagatttttattattttattcaacatttgttattaagacaaagatcatcatctgatttttcacttatgtatcctaggcacctaaaacaatgtctgacacaaagtaggtactcaataaatatttgttgttaaataaatgtctattatgggcatctttttaggttctaggttgcagcaaagaataaaaatgataaagctttactctcatcgaacctacattttagtggaccttacattttaacagtgctaagatattactattgaaaccttactacgaatgtttttaaaatataatggaaacctattatgacactcagttgcataggtggacaaaggtaggattctgtatttataggcatattttatgggtccagcttatgatgttatagggcccagcttatgatgttaatagtgcttgccctttacttttagattttttttttttacaaaataagatgctatcattaactataatgtgtttaattgtgataaactgagttgaaatatgtgaagttgccctaaattatgtagggcaaaacagttgaattctggtaatttcaagcagttcaatctaataaaagctcttgagaattttctgttgaagttaggatggtgcctttctctccttcctccttctcccctctccctcccctaagagatcacaccttgcaaatatcaaactctgagtcttaaggttaccgttcattaattcatccattctttcattctagaaacattgatacagtgatagattaggtagtttcttacctctattggaagttaaagtctagtactttgaaggtgtttaataaatattatattgcagtatccagtaagaaatattcaaaagtttgcttaatgtgtcagagtaattgcgtaaatattgtactctggcattagacatatgtttctagttgaaaccagttaccagacattaatcttggctataaaacaagaaaatatatggactcttgaaaatttctattaaagataatcttactctttcttataacttacgttatttgcatgtaatcatataccatttgttttacttttggtcttcagggtctttatgcttcttgaatagtcaatagatgaggtattaggctcaaacactatactttgaaatgaaatataagttatctgtttttgtagaatcaatatctgagcacttctacattctgtagatagttatagcaaaaccttttaattccttttcatctaataaaatttgtgccccacaaaatctatctaaggataatagaagtagttctagacttgagagagttccaatctcttataagctttttttatttgtaaaatggagagatggtaaaatctaagcagattttatccttatatacagtattgtcattcccttcatatccctgataaatggttataaaaattgtggcagagatcagactgtccgttcctcttgtggattgttgaaattattagatcttagtactgccctctaaaacttgattagaagactgattgctcttcagtgtagcccttggtttaaagatagtcgtgtctcatcaaaatttctgttttgttttattttttcgtagtataaatgtatactagtttactgtataattctttatctttattaatttatctagcatttactgctttttggtagtgagttggatgccagatattttaatagacagtatattggagaggactgtgtttgaatccttgctttgtttctttttagctctatgatttgggcagtttacttaatctgaacccttattttccctgctatgaaaaaaatggagctattaaatatgtaactacctaaattatattaagtattaaataatgtaatatatgtaaaacatttagctaagtacctagtgcataggaggccctctcagtgtgtgtttgttagatggcgaaaatcacaaaaagcatgttagcaggtccagtataggtaaaacatagcatgcttgggaggagcgaaggaaacattgaagccaagagagaaaggactttaaaggtgaaagagatttgtcagcagtggctcagactgtagaaaggcccagtaggatggggattcaaaagagagcttcagatttgacaattagtaaatagtaatccgttaccttcctttttaatgtcattattgtgtccttattaaacaaactttccctgattatccatacttctccaagacagcattatgaccatctcttctccccttactttgttctaccttcattgtggttatcaccatgtaacattttatatattagtttttattcattttttccctgttagatcagtgaaagctctataagatcagagtatttgttttttatcatccttatactcctacctcctagaacagtttctgcctcatgctaggtgctcaacaaatacttattgaatcaaggaatgaatgtatttctttctttctttctttctttctttttttttttttgatacggagtttcgcttttgttgcccaggctggagtgcagtggcatgatctgggctcaccacaacctccgccttctgggttcaagcgattctcctccctcagcctccggagtagctgggattacaggcatgtgccaccaagcctagttaattttgtatttttagtagagatggggtttctgcatgttggtcaggctgatctcgaactcctgacctcaggtggtctgcctgcctcgacgtcccaaagtgctgggattacaggtgtgagccaacgcactcggcggaatggatgtatttcaatatagtgcttggcctgataatgtctccctgcagttcagacagtgagtgaatgagaggcagagaaggactaagcagaaaatgtaagttagtgtttcaaaaaatgtgctcatcaggacattggtggagaacattggttttgggagtacaaaggatttctgataaaataaatttgggcaaataacaacatactaagcttctttttttaagactaagggagttctgctctaagagaacccatttaacttaggttaatgtaccattttccaaacatttggccatgtagcaagggattcgtggataattcctagtataaatgatgggtcatgttcagactgggtaggaaaggacatgcagccaggaatgaacttattaagaaaagcaagtcactctgagatcaagatagtaacttagagaaaggtaggaggtagaattctatggttaaagaggaaacttgagtgttttaaagtccagagttggttgttttggcagtagttttgctgaactagagtgtaggtgactaaaatgctgtgaaggatgaaggttgtgtgttgagtcgggtaggcattgactaggttaagacaaaaactcttctaggatgagctgaaaagggtaaatcttctgagacactggataatattgatctgaaagtaattcgattttggaaaggatattgggaagaaagtgatataacatatttagtgcttcagaagaaagatttgttgagtgttaaaggagtcaaatgaacggtgatagaatataagacttaccagcagtgaggagatggacatgccacaagggaggccagaactgttcttaatttccaagatttctttgaaaatgttctctcatagttcttaaatgtatgcattttaaaatgtcacaactatttgaaataaaatctttatttctcatcacttatagtgttagataaagataccatttcaagtcttaccatcatgcaggttttgaagttgcaaaacataagcaactcataacagaatcaacagtgtgtgccagatagattttgtaaggagagattggcttcttaaaagttctagaatattaaagtactttattgacttggttgtatccatcaccttgagtgcttatttcaacagtatttgctctctgatataatattcaccaataatcacccctctgaatatcatctttctcttgtatttttataagctgcaaaatttgctagtttttgccacttaggaaaggttagtggagattgcctgcatgccttggaaagtaatattttttatttctgtaggttatgaaacatttttatatgtaataattgatcctctgaaattttaaagtaaattgagcagatattagcctcatttaactgttgttaaactgagtctgcctatatgattatcatatatttctttctaattcatgtcttaaaggcttctctaacaaggagttctttgctgtaggtcctttcaggttctcagttctctgtgtagataagtggaagttatttccttaatgtggtgtacactacctgaagcattcgttctaccatctgcagttggtttaatcattcttatatataaactttatttaaaaagtcagtaagaaagatgtcttccatgtacttttcttgctaatgtagtcttaaggtagattttgttaaattaccgtacgttacagataaaaagggaccgtatgtcatttaacttaacttccttattttatgtaaggaaatctaaaccttagagagcttaagtatcttgcctgaggactcatagttctcagtgacagagctggggacttgaagttagataatgtaagacaaattccagtgctttttcaactatactgtcatgtcttttaatgaatttaattagagcaaaatgtggcttttgactctgaggcctaaggtatttatcatgatctgggtagaagattctattaatatttttttaaaaattattttagtaataaaatttatatccaggcacatgatgattattttaattgagagaaaggtacagccactttattatttaattagttgtgtgtgtgaggtcagaatattttaaccccttggtccaattaatcttaatataagtatcatatgtataaaataacaattcaaataatacatgcggtttgcataactaggtgatcttaaccttatagcagtatgctttctattatctggtgataaagagaaaacgattttttttaccctacactctgcagatcaactcagtatgtcacttaactgatcaccagcagtatttcttcatgccttggagattaataagataaattttgtttttaaggtttagtaatttaccgtagagataacctttaagataaaagaacatgacaaattgatttggttaaaataattacaagaaaactacatatttccaactaatcagcttggttatccttaaattatgacttttctgtgtttattctggtctttttgcccactggtaactcttaagcccattttaattgataatttttcttacttcaaattacagtaagaaatttgttttacagcaactgacaacttaccaatgaaactaaagaaaacattataatgtgaagtttcacaatttaaactacataaattatttttaattttttttttaattttactttaagttctgggctacatgtgcagaacgtgcaggcttgttatacaggtatacatgtgccatggtggtttgctgcacccatcaacctgtcatctaggttttaagccccacatgcattaggtatttgtcttaatgctctccctccttttgcctcccaccccctgacaggccctggagtgtgatgttcccctccctgtgtccatgtgttctcattgttcagctcccacttatgaataagaacatgcggtgtttgattttctgttcctgtgttagtttgctgagaaagatggtttccagcttcatccatgtccctgcaaaggacatgaactcattcttttttatggctgcatagtattccatggtagacatgtgccacattttgtttatccagtctatcattgatgggcatttgggttggttctaagtctttgctattgtaaatagtgctgcagtaagcatacgtgtgcatgtgtctttatagtagaatgatttataatactttgggtacatacccggtaatgggattgctgggtcaaatggtatttctggttctagatccttgaagaatcaccacactgacttccacaatggttgaattaatttacactcctaccaacagtgtaaaagtgttcctatttctccacatcctctccaacatctgttgtttcctgactttttaatgatcgccattctaactggcgtgagatggtattctgttttagagaatgaaagcgttgtccaaattggagaattgttaccttgctaccgggtagaagttccctccgtaggtcttgacatcaacacacatgcacatgccatattttgtcaattatagtgctatgctctatgaccagctaatattagaggacattataaatttatatatgtgttttatatatatctttattttgggtgaagtaatgacattcttctctaaacaatatttctttgggggataattgcttttaaattatccccaaatagcattattttaaaatggtattgtatctgtttatgccttatagtgataataattttcgttttttaaaaaaacattttaaacatgtttgataacttgtggaaattaatgtcaagaactggatattattatatggtaatatttggttgctttatgttttaattttttgtatgaaaaataggagttgatttggttcttagatctatttaataagtaaataatatagattatgttagctttatgagagcaataattgtgttattctgtccttgtgttaatattacttagtacatgcttggtacgtggtttttctatgtgctgaatccatttttgtcaatagttaatttttataagattttgctttgtcatctaagaagtagataagcaaatacacttttaagcaagtataatatgtggtgctttttaatattttgtattgatgaattttaaaatcattgcttagtatttaaaggaatacgttaaaactataagcaagcttaatagattagttagcgtgtgatgttactgagaccatcattttgaagactgtcttatctaaatgaacctaatggtttccatttagtaactctggattgttagtggacttaagtgatccagataaatgagattgccctccctaaataacttagctcctggtgttggagaaggacaagtcaggcaaatcttagctttgcttttgtagtgttgactgcttaactgctactacacaacattgcctccatctgagatgaaaagtaatcactatccaccagtcaagtagggcagtggagtaagaaatgagaaaacaaaacagttcttctgttactgtatttgaatgcattcttaccaatatctattttggtttgcctgtttagttctctgtgaactcactaaatgtcttggatcaggttatatggagttatataattgtactttttaaaattagtttgttacttctaaagaaaaatgtttttctatttgtctttcatatgataaaagaattttagcatctctaaaatattcagcagaaactatggggaacatgttacatgtttaagtatcatttttaggaaattatagctatgaaaacaagtttatgtttgatatttggaaataaaataaaatgacaaaatgaattatgcagaatcacaaagaatgcagtttctttttttgtagtttctttttttttctttttagtaataacatttgttgtattcagttacatgatagttatattaattttattaataattgagtgaaagttgtagctacctctttatttaattttgtttgtaaggtcagaatatctccatttactagtccactgactcttaatataagtattatatgtataaaataataattcacataatacatgtaatttgcataactaggtgatcttaatcttatagcattgtactttctattgtttggtggtaaacagagtaagattcgttttattctagattcttcaaatcatctcaggaagtcactgaactcatcactaatggtatttcttcatgccttggaaattaataagataaattttgttcttaaaatgtagtaatttaccatagagatagcctataagttaagagaatatgacaaattgatttgcttaaaataattacaagaaaactagatatttccagcagtatcagtttggatatctttaaatcatgactcctccatatttatcctgacctttttcaccactgataactaagtattatgctccttttcatagataattttgcttatttcaaaatgcagtaaaacatttttcacaaaaactgataatttacctataaaactaagagaaaacattaaaatgtgaagtttcacaatttcaagttatataaattatttattaaattccttcctgttttagagaatggaggtgttgtccaagttggagaattgttaccttgcaagatttgtggaagaacattctttccagtagcattagtgagtagactgattttgtacctttatggttttacagatctgtaattgttcaataattctggtcaattctcatgggaagaatttacgtggaatagtttttgaagagttaatgggtactattctttgttcaagggtcttgatttcagctatgccattcttccagaatgctttctttccttcagagtttggtcttcagaactcttctgttaaagtttaaaggtattcctcattttacgagactcttaccaaaaacaaacaaaataaaaaaaaaaaaacaaaatcagataccttagaaataagtaattatttacagatacaaaataatataatgtctgtaatttgctttatagtacttcaggaaaaaatcagggatagatgaaacaaaatagctaaaatgttgggagttgttgaagctgggtgatgagtagtaaatggtagttaattatccttttctgtcagctcttatttatgtttgagatgtttcaaagacaaagactttttcaatgtaaaagtacacctaaaatttattatgcattcttaagatatgttagctacttagtaagtacaaataaaaacgcttttaactaatcttaataaagttagctaactaaatagggaataataaaaattatgcctatgtaccttacgtattttaacttcaaacacaaatacacatttattaatactttaatgtaagacagaatttttctgtgaatgtatatctgctgattaaagttctgccatgatccactgtgcatcctcttactatttctagtttgtttctttaaagcaaagtgaggaattaatgatccaaagtgtccttctgactgtaggcaccttttaaataatgatggcttttttgtaatcttttaaaaacatcttgcccacacattcaatgatttttttcttatcaatttattatttttcagagtgttcagctgaatttcacagcaaaaaaaaagtgccttttttggctctcatttatgtggtatttaacttaatgatgttattataacacctgaaacttgaattatgttgggaaacaagcaccacatacacttgacatatataacttaataaggaacatatgtacatgggtccactagatagtcatctgctatcctcattttttaaaaatacttaagagctgtaattacagtgcttggttgttgaaatgaaaactgaaaataagtatgtaaaacacttgattgctaattgtgtactgaaagcctaagaggctgcaagacacgaaataatccagttttgaggttttattttttcccaaagtttgacagttctaccttctttagtgtttgtcaaaatacaaaagaaaaaagagtatttagtttaccgatgtcatcaatcatcatgcttaatatagtggagggagaatgtttatccagttggcttattggaggtcatttaagacagcttccattctaatgtccctaaactgaataactgaataaatgaatgaatggacaactctttaaaaaaaaaaatctgaatagtagtagaacactagataagctcaagaaaaatcttaggcgaagaaaactgcaaagtttgagttccagaagggaggaaaagaattagtatgggagaaggacacaaatcagaccacctgtcctattattttgtgttaactttatattagcatattactattatgttaactttagtaatccaaactactactcttacattaacttttgtaatcctaaaactaatgtattctttgtattttctttttctagtatctatgttcaggcatttagtggagacttttttttttgcagtgtagtaactttgactttgttactttttcttattcttagtgttacagggcagataaatattttacagaaaaagggtcccaatccagacactaagagagagtttttggattttgcacaggaaacaatttagggcgagttcgcagtgcaaagtaaaagcaagttgattaagaaagtaaaggaatgaaagaacgggtactccatagacagagcagccctgaaggctgctggttgcccacttttatggttatttcttgatgatatgctaaacaaggggtggattattcatgcttcctctttttaaaccatatagggtaacttcctgatgttgccatggcatttgcaaactgtcatggcgctggtgggagtgtagcagtgagaatgaccagaggtcactctcgtcaccatttttgttttggtgggttttgcctggcttctctagtgcaacctgtttttattagaaaggtctttatgatctgtattttgtgctgatctcctatcttattctgtgacttagaatgccttaactatctgggaatgcagtccagtaggtttcagcctcattttactcagctcctgtttaagatggagttgttctctttcacacacttctgacattagtaatgtacaaactaggagaagagtattaaataacttaatgacatgttagaagagtgtttataattttttttagtgagaaagataacttagagcgtgcattatatatacgttttacaacttaacatttggttaaggcaaggtgtatcttatttatttattattttgtattcaggtttttcatttggtctcagatttttaaactggtctcaatgtaaataaagttctgtagtcttaccttctgtagaaaagaaaatgataggctgcatttctttatcttaacagaaaaaacatggacccatttgccagaagactgcaactaaaaaacggaagacttttgattcaagcagacagagagctgaaggaactgatattccaacagtaaaacctctcaaaccgagggtaactatataaccttttgaacagtatgaactttggtgttatgtatgttgaaaaatattatattatctgttacagtaaggttaagaataaacacaattatctgctacattaagattaaagaataaatacaattctgtgttatatgttcagtttagaaattatctgaagcttataaaacaaattttattttaaaaaataagcttctaaacttcaaagaagagaccaaggtgctgtttcaaactccatcaattacagtgagatttttatagcattggagagccaattgctgtcccacattcttttcaagtcattattaaaaacttttgatataacttaagttttgattcatttcatcttctaccattatgataatctctacatccaaaaagttaagccattatttacagacattttagcataatagatactgcttattttgacatattgactgccaggatttgtaatctatattatgtttctaaggaaaagttttatctgttgttcagtgtccagatatagttattgtcagcttattttctttcttgaaaccaaagcaatgaatctattgtgataatctctccttaatatctgttatatattatagtaatcccttggtatctgtgggagattggttccagggactcgcctctgatatcaatatctgtggatactcaaactccttatggcatagtatttgcatataacttatgcacatcctcccatgtgctttatgtctagattacttataatttaatgctatgtaaatagttgttgaattgtgtctttaatttatgttactttttattgttatatggttatttatttttttcctgaaagtttctgattcatggttgactgaatccatggatgcacaagccatgaatatggaacccatgggtagtaagggccaactgtgtattgctaagaataaattacttaagaacttattcagcatagttgaaaagcatcatttcagtgaagtgatttaagctaagtacctgattgaataggttttttaaacagaatcctactgttaatggtaataacttcttccagtggtataagaacatttttctagggggaaattaatcttactaataaaaaatcatttgatgatagaaaaattagatgttcatttttgttttttactgtgaacatttaaagtaaggatggtggggtttgaataagctgtataaatcaatatatgacgtttttcttagttacctgctgcctatattagctttaatttgcttcggtagataaaattgccaaatctttggaagcagtgtaatatagtgggtgttaaaattggctcaagagtcagactgtctgaatttaactttcactttgctacataccgtattattctgggcaagttatttaatgtaattatgcttctgttcactgtaacatggtgatagtagtagtatttatcttgtgtggttattgtagggattacataagattatccatggtgatttcaatgaatattagtcatcctgtttcttttataaggaattggggttgtaaacttaaaaattgaattctagaaaaaagcaaagtacagtccgcagtccggcctgggcgacagagcgagactccgtctcaaaaaaaaaaaaaaaaaaaaaaaaaaaaagcaaagtaaaaaccattgctttgtattaagtggtttattgccttgttacctaaaactgtggcccacagagcagtaatagtggcagtatttggaaacttgttagacatacagaatctcagcctcctcccaaacatactgaattagaattattttaagaacatccttgggtgagtcgtatgcacattaaagtttgagaagcagtgtcttagaagatttgaatgttgtaagtgtagttcttaatatatttacctgtatcaagaaaatcctacaaaatcataagcagagtggggcaaagcaactacaaacttcatttttggaaaaacaaaaggtaggcataattcatagattatcaaatatatgtaaggattgccccaaagcagttgaaatccaggagaaattacccgtaagaggaggtataggaaattgcttgggggcctgtggctggattctggaaatctgctaccttaaagttgaggggtttcctcatcttaaaagtgattccttaaaggtgagagatcttatcagatagtatctttatctcttgtttagtataggcaagacagaaactgggaggagctgtaggaatttggatagctaccagctggaatgagcagggctgaaattgtataaaagtcaggagggagagaatggtgggagtaggaacagagagttgaggaggcctagtggcagaggcccttagaaaacattagtgaaaatccctttcctgaagatgaggggcctaacataaaaggctgtgaccttttttttttttgaagtggttctcataggatctgagggaagcagggtgtaattacacagagacgccttatttgcaggaactagtctgaatctgttgcaacagagaggagagctgctagtttgtatagctaccctgggcctctcctccctaaaacttcttgcaaatagctgtaccaggaaatctatgctgaatagtagaaatgaataatagaagcgatgaataatagaaaatatattagctcagcattgataaaagatactatgagaaaaaaggtagaaaagaacagcagaacatcagtagatgagtaataatcacagagcagatgaatgttgtgatcagatattttgctgtaaaataagaaatgttaaagagtcagtaatctcaaacatctaaatttgctgacgtttaagatttttgcatttatattaatcagagaagtagataatgtcattctttttgtcagagttttgctgctctcggaacactgtttggaaagttgtttcgttgttttctattccctgaaagagtttgtgtaatattgatgctagatttttcttatatgtctacaaaaattaaaaattaaaggtagctgagccaggaggtttctttgtgggaaggaaaatattttctaaaataaatgacattttgattttatatttgttctggtatctgttttgttgtgttttccaaggacattgcccattttgtcataattattaaatttattggcatacaatttctttataatatcttcttgtctttttcatatttgtgtattatttttaattccttcataatttgagttctcttttttcctttttctttcttttttttttttttcttttttttgagacagggatcttactatgttgaccaggctggtgttgaactcctggcctcaggtgatttctgccactttcacctcccaaaatgtggggattacaggcatgagccgtcatacctagccatcttttaaagtaccatcttttgactttgtggattcaacacataattcttgattttaaaaatatagacatagtaggaatagttgggtatctcaataatattacaaaataaatctttgtagcatgtgagccagcatcatgtttagtggaggacactagaggcagttcccattaaaatcaaggagaaggttaaactgtaaccaataccataagtgccagccaatacagttagataagaagaagaaattggatgcatagatgtattagtccattttcctactgctattaagaaatatcggagactgggtaatttataaagaaaaggaggtttaagggacttaaacttccatgtggccgaggaggcctcacatcatggtggaaggtgaagaaggaacaaagtcacatcttacatggcggcagacaagagcaggggaacttccctttttaataaaaccatcagatctcgcaagacttattcactatcacgagcacaacacaggaaaaacctgcccccgtgattcaattacctcccaatgggttcctcccacaacctgtggggattatgagaactacaattcaagatgagatttgtatggggacacagccaaaccatatcattctgtccctggccactcccaaatttcatgccctcacatttcaaaaccaatcatgccttcccaacagtcccccaaagtcttaactcatttcagcattaaccctaaagtccacagttcaatctgagacaaggcaagtttcttctgcctgtgagtctctaaaatcaaaaacaagttagttacttcctagatacaatagggatacagacattgggtaaatacacccattctaaattggagaaatgggccaaaacaaaggggccacaggctccatgcaagtctgaaatccatgagggcagtcattaaaccttaaagctctgaaacgatctcctttgactccatgtctcacatccaggtcatgctggttcaaaagatgggctcccatggccttgggcagctctacccctttgtctttgcagggtacagcccccctcctcctggctgctttcttgggctggcattgagtgtctgcaacttttccaggcacacaatgcaacctgtcggtggatctaccattctggggtctggaggatggtggccctcttctcacagctccactaggcatgccccagtggggcctctgtgtgtggactccaatctcttatttcccttttgcagtgccctagcagaggttctccatgagggccccgcccctgaaacaaacttcttcctggacatccaggtgtttccatacattctctgaaatctagtcagaggctcccaaacctcaactcttgatttctgtgcacctgtgggctcaacaccatgtggaagctgccaaggctttgggcttgcacctctgaagccatggctcaacttgtaccttggccccttttagccatgcctggagcagctgggacgcagggcaccaaatccctacgctgcacacagtaggggggccctggacctggcctaggaaaccatttttcccttctaggcctctgaacctgtgatgggaggggctgccctgaaggtctctgatgtgccctggaggcatttttccctttgtcttggtgattaacattccattacttgttactcatgcaaattttttcagcagccatgaatttctccccaggaaatggatttttcttttctgttacatcattaggctgcaaattttccaaacttatatattctgcttcctcttgaatgctttgctccccagaaatttcttccaccagaaaccttaaatcatctttcccaagtttaaagccacagatctctattgcaacagcaaaatgctaccagtctctttgctaaagcataacaagaatcacctttgctccatttcccagcaagttcttcatctccatctgagaccaccttagcctggactttgttgtccatatcactattagcattttggtcaaaaccattcaacaagtttctaggaagttccaaactttcccacatttttctgtcttctgagccctccaaactgtttcagcctctgctcgttacccagttccaaagttgcttacacattttggggtatcttaatagcagtaccccactccaccagtaccaacttactgtattagtccattttcatactgctatgaagaaatacctgagactaggcaatttataaagaaaaagaggtgtaacagactcagtttcacgtgtctggggaggcctcacaatcatggtggaaggtgaagaagaatcaaaggcacatcttacatgatggcaggcaagagcgtgtgtgcaggggaactgccctttgtaaaaccatcagatctcatgagactcattcactgtcatgaggacggcatgggagaaacctgcccccgtgattcaattacctcctaccgagtacccccataacaggtggagtttatgggagctacaattcaagatgagatttgggtggggacacagccaaactatatcaatagatatttgaaaagactagataaaatcatctttattagaagatatgatatacctggaaaacccgagaattaagtaagaaattactacaaacaacaggagtaaagggaagtaatgtggtaggttactatgcaaaaataactaagcttcatatactcagcaaacaggctcttgagacatagcaatgaggaaaggaccctctgcaaaagaacaacacaaagtatgaaatatttaggaataagctttataataaagatacaagacttccacaaagtaaaaaaatactactgaaagataaaaatgaactgtttttcaaatagaaatatatcccatattcttgtataggtagactcgacctaataaagattttaagtttctcaacttgtttataaatgtgattcttaatttttaaaaattagacaagttgattcaaaagtttacatcaaaaaatttatatacatgaactaggaaaagattaaaaaagcttaataaaatattagcctatcagatgttaaaatataatgtctcaatattgaaaatactggtactaacaaaggatagtcagaaccgtggaatggaagagaaagttcagaaataggcccaaattcagaaaggaatttagtgattatacaggtgttatttcaattctgttgtggggggacagggaggggagagtcactaaaggataggacaactgcatagccatgttaaaaaaataagcgaaatttgattcaatttgtcactccacacagcagaataaattccacatgaataaaatatttaggaaattttaattgaaactggaagttgtagaaggaagcatgggaaaattttatttttccttggtgtgaggttgcacctggctaatgcagatccagaggccataaaagatcagtaaattaaactgtaattaaaacataattatgcatagtaaaagactacccaaagacaaggtcaaaagacagattgttggtgggagggagggaatagtttcctataaacaattactagaaattattacattaaaggccaataactcaacaaataagttgagcaggaatataaatagtccacagtaaagacaatacattaaatgattcttagtaatttaaaaaggtgctcagtctcaatcattataagagaaaatccaattaaatccacaaagtgaggactatttttcatatttctaatcggttcaaaacccaaatgatagataatatattctgttagaggatctatggaaaaacagggaaatacactgtgttagtctcttttctgctgctgtaatagagtaccacaaactggataatttataaagaaaagaaatgtatctctcactgttctggaggttgggaagtccaggagcatagtgctagcatctggcgagggccttcttgctgcataatcccatgacggaagggcaggtgtgcatgtgaaacagaaagtggggtccagacttacttttttatcaggaacccactccctcaataactaatctgctactgggataatggcattaatccatcatgagggcggaaccataatgacttaatcacctttcagatgtccccacctcgtactactgttataatggcaattacattttaacatgagttttggagggaacattgaaccacagcaacagtcttagtgggaggataaatagatgtaacacctacagaaggcagtttagtagtgtctttcgcgatgacacttacattaagaaattgaatataaaattgcaatgtagttgcataaagtttctctttaaaattataaatttgagaaggatatcatttaaggactcctgataagagaacatttaaaatgatatggaattatctgatgttttatttcaatatactaaaaagatactgtttgtttatttatttatttatttatttatttatttatagccagaaccaccaaagaaaccatctaattggagaaggaaacatgaagaattcattgctaccataagagcagctaaaggccttgatcaggccctcaaagagggtggcaaacttcctcctcctcctccaccttcttatgatcctggtatttggaatattgttgacagaaatgttcatgtggaaagaaaataatgatagagtttttataaattttcacttgttaagcttaacttacaatcatggagtgttatgaggcataatctttaaaatttggtgtaaaatggtggtggtaatctagtcatgtaggcttataaagacattaatttagaacatggaagtgtattatgtttttattttaatacttttatttaaacaaggcattataatatcatttaaaaattattatagtaactattaaatgtgagtattccaggaaatattttaaccatgctcactgcggattgaaatgtagtcattcagcaggagtcatataattatgttgcctggttccttggtatcttctcatctgagattgatataaaaaaaatcataattttcctaaaatgtataattcatgtggctcgactacatttatggcttaaatttgtatattgttaaattttttctcattgagcagataaaagttgcttgagtcattgttactaaaagcaaagcaagatttttgcaaccttgtatgagatactgagataccgaaaaacttaaagtgacaaagttgacactttgacattccttattagagcagcctaaagaggttgttaatgtaacagggtagccacattaatgctatgttagtactctagattgggatttattttctaacaaagagaaagttctttagcaaatctagatatgatcgtttttgacattttattgtagaggagagatatagtatatctacagatatagtaaatatcttagattttatatgccataaggtttctattgcaacaaataagccatagactatatatacataattatatatatatttatatataattatatatgtttatataataaattatatatatttatataataaattatatatttatataataaattttatatttacataataaattatatatatttacgtaataaattatatatatttacataatacattatatatatttacgtaatacattatatatatatttacgtaatacattatatatatttacgtaatacattatatatatttacgtaatacattatatatatatttacgtaatacattatatatatttatgtaatacattatatatatttacgtaagacattatatatatatttacgtaatacattatatatattcatgtaataaatatatatattcatgtaataaattatatatatatttatataatatatatctatataataaatatatatttatataataaattatatatatttatataaatatataattatttatatctatatttttatatataaactatatctatatttatatataaatatatataaattatatatatataaatataaaatgagcatggctgtgtttccgtaaaacttcatttacaaagacaggcaacaggcaggctggatttggcccatgggccatactttgcgaaaccctgttctagagtattaataattaacttatatgaatgaatgtttctggtatgctttaactgatcctgggcctcttttaatactaccttttattttcttcatgaacttgagttttctctctgctttgaagatatttagatattgtgtcttaactctacatagctacatttctcatgtctaatataagagagtgagagggtaccagttcttcaggatcgtttgggctttagaagtttttttaatcttttgggcctgacaaaaacagcttatttctttcttatgagaggtttaagacctactccagtagtaaggaggacaaatttttgagctcagatgaatataaattgaaaagggcaaactctgtatcaaaaaagtaaacctgttaaaataagttgtaaacctgttaaattaagattcttttttgacactaccagatttttacatttattcccagtgtctcatttagttattttacaatgctacaaaatatggttctggaataatttcaaaagaagtttaatttacagtatgctttgcattttgggaagatattttatcttggaaacatttgctgtttcttaaatttgaattatgtcagtgagatatattttaatcacttcttccatctgttgggacttttaagagaaaatagcactttaaagataagtaaactatttcttgacagttttccatttgatgaaataaaaaattttaatagatgagcctgtattttaaaatgtattttaacgtcatgtattattacttcctaactagtctgctatataaagtatgtatccattataaatgaaaacataaaggcaaaaaagaaataacgtttttcctctgcttactcttttgtactaaggatttatcttttgttttttttccttcacacatttgattcaaagctagaagaaaattggaagtcatgtaccagcagactttttttttttttaactctttactaagtttagacaagtaaaactgggtagttataaggatatgggaatttttgcttatcagatgttattacttatattttttgaatgactgcatagaaacttaagattttttaatgtccgtttcaagtactatgctattaatctgtttccgtttttatctgttatagattatattcaatgtccatattgtcagaggagattcaatgaaaatgcagctgatagacatataaatttctgtaaagaacaggcagcacgtattagtaataaagggaaattttctacagataccaaaggaaaaccaacttctcggacacaggtggtaagttcagttttaataattgctataaacgagaaaatggctcatggacattcatagattattgtttatgcttttcatgacattagactatatttttctcacctgcttttatagatatatagttttatatatctataaaagttgtatgcttttagctcttatatctgtaaatcatttcaagctaattgtgtatagtgtgaaggggcaattgttccctttttctatgtggatattctattgtcttagcacgttttgtatatataaaatatataaaaacattatatatatgtatacatgtttttagattatcgagtgaaagaccttgttacatattcttggtcttttctcagatgtatattaagaatattttctcccatcctgtgacttggctttccattttcttaaggatgtcttttgaggggcaaaaattttaaaatgtgattaagtccaatttattaattctttatgatttatgctccttatcttgtatcaaagaaatctttgcctatactaggattgcaaagatttttctcccatgtcttctataagttttatgcttttagctcttacatctgtaaatcacttcaggctggtatttgtgtatagtgtgaagtaaggggcagtttttccttttgttttctatgtggatattctattgttttagcacgatttgtttaaaggacttttctttccctgatgaattgctgaggcaccttggttggaaatcagatgaatataaatgtatgggtttatttcaggacatgctgttctgttccattgatttatatccctgtcctttagtcaataccgcattatcactatactgaatagtgaaccttaataagccttaaaatcaagtagtctaaattttcctacttgaattccttttaaaattttctttggcagccgggtgcagtggctcccgcctttaatcccagcactttgggaggccaaggcgggcagatcacgattgtcaggagataaagaccatcctggctaacacggtgaaaccccgtctctaataaaaatacaaaaaattagctggacgtggtggcgggcgcctgtagtcccagctacttgggaggctgaggcaggagaatggtgtgaacctgggaggaggagcttgcagtgagcctagatcatgccactgcactccagcttgggcgacagagcaagagactgtctcaaaaaaaaaaaaaaaactttggccattcttgatttacatttatatatacattttataattgacttgtcaacatctacaaaaaatgacttctagcatttgagattatattaaattcataaatcaatttgagaagaattgacattttaacaatattgagttgttcagttcatgaacctgttatattttctgatcatttaggttttattttagcagtgttttgtagtgtatattatataggtcatacacatgttttgttagattttccaagtatatcatgtatttggatgatcttgtaaatggaattttattttatttcatttttagttgttttttgcttgtttagaaaaactggatttttgtatattaatcttataccctgctattttcctaaattcatttactaataatagtcttcttgtagatttcttaggacttttctatgtatacagtcatgtcacctataaataaggacagttttattttcttccctccaaccttttggcttttatttcttttttgtgatttactgcatgggctagactaatgttgaatagaggtgatgacagtggacctccttgccttgtttttctgttcttaggtgaaaagcattgtttttcaccattgtgtatgatgttccatcaattactgagggaaatatgttaaaattatgacttttcttacatttctctttagttttgccagcttttaattcaaaattttgaagttctcttattgtttgcatagcatttataaattgttacatcttccccatttattggcacttttatcattataaattgttcctttttgtctgtggcaatatttgttgtgttgcagtatgtttcatgtgataagaatatagccattttaacataattatgctcacttcttttctctctattccttatatatgtgtttttgcattgctataattggtttttgtatttctttttttaaaatcaaatctagtaacttcatcttgttggtcaaaattgcctgtcatttacatttggtgcaattattgatttgcttatgtttaggtctgccatctgttttctccttttgtaatttttttaaaaattcaccatttcttttcccttttgtcttcataagatttcattttcttttttggctttctagctgtaattctttgcatttttgaaaagtgattgctctaggaataaaaaatgcatctttgacttacccatatctatggatatttttatttacctctgacaggtttgtgctattgtttcatatatgtaactctagatattataggcctatcagtactcttgatgtgtattgttatacttactgccttatttatatatttattgaaattgtaaacgtgcagattatagatgtatatatttatggggtacaaagtgataccatgattcatggatacaatgtgcaatgactaaatcaagctaattaacatactatcacctcaagtacttaccattttttgtggtaagaacatttgaaaattttttctctttgcaattttgaaaggtataatacattatcatttactgtattcaccatgctatgcagtatatctcaaaataaaaaccacaacaaaaacttacccctttgaccatcatcatcatctccttgttctttcttccctttccccctccctttagcctctggtactaccattcagttctctgctgcttagagttccattgttttagattctacatgtaagtgagtacatgtggtattcacatgcctgtgcctggcttaatttctccaattccaatccctatagttcagtcttatttattattactattttttaatccttaactactaaatctgccacctgtggtcatttgcagttagtttctgttgacttgacatttttgctaaatatggatcatgttttctctttctttgctggtaatgtttggttgaaaactagacatgacatggtaggtaatatataacaatttctgttttgttcttttgcaaagtgtttttactttctttccttttttaggaggggagcagtaaggaggtctaagtgtaggtggttaaatccagggtgtacagtgtaggttttccagtggtttccagtaatctttttgttgtaattgctgctacctgtaggatggttatatagccacttcacccctccaacattgagcttctaatttgttttttttattattagtagtatactttagttttagggtacatgtacacaacgtgcaggtttgttacatacgtgtacatatgccatgttggtgtgctgcacccattaactcgtcatttacatggagtatatctcctaatgctatccctccccactccccccaccccacaacaggccctggggtgtgatgttccctttcctgtgtccaagtgctctcattgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtttatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgattttttaattatcgccattctaactggtgtgagatggtatctcattgtggttttgatttgcatttctctgatggccagtaatgatgaacattttttcatgtgtcttttggccgcataaatgtcttcttttgagaagtgtctgttcatatcctttgcccactttttgatggggttgtttgtttttttcttgtaaatttgttggagttcattgtagattctggatattagccctttgtcagatgagtagattgcaaaaattttctcccattctgtaggttgcctgttcgctctgatggtagtttcttctgctgtgcagaagctctttagttgaattagatcccatttgtcaattttggcttttgttgccattgcttttggtgttttagacatgaagtccttgcccatgcctgtgtcctgaatggtattgcctaggttttcttctagggtttttatagttttaggtctaacacttaagtctttaatccatcttgaattaatttttgtgtaaggtataaggaagggatccagtttcagctttctacatatggctagccagttttcccagcaccatttattaaatagggaatcctttccacatttcttgtttttgtcaggtttgtcaaagatcagatagttgtagatgtgtgacattatttctgagtgctcagttctgttccattggtctatatctctgttttgtgtttttaatttcttgcagttggctggctatttttctaatttcctattttttatagtttgcaattttccattaatattttcatagttgtctgctatttctttaaatgtagtactcatagttgtttgtaatgtgtgtctgataattatagcaatatcaagtgacttgtatggatatgttccttgtttttttttttttctcattcagtttccttatatccttatttccctgattattattgacctttgctgcttgttacaagtaaaacggtattcatgattatcattcatgccttcttccagagaagatgtgtgctgtgcttattccttttaggtatctatgagtcttatcagtctggaaacatttgaaattaaattattggcttagtttgcttgaccagcctaataatgcaaatttatacagcaaatccatgtgatgttcaggtcgttattacaattccatatggtttggcctggaaatttcttttcctctcatttgacattcagtgcttttacaatgattttttattctttcctgagcatttttagttgttaattgaaaggttggtctaaatagtaagttctaccattttgtcagaaatggatgtcctacaagttctttagactttttccaatttcattagtcattagtctttgtataaatatttttgtaaggaaatgtatgagatttgtgagcagcataaaaacacaaaataataattaccaaataataatgaatgaaagaaatacgttgaatgtaattgtataaaatcatttcattctcctggtcattaaaatggatttatacaaaattgttggttgatagagtcattctgaaagtcttcataatagcacacaaaaccgttgattgatagagtcattctgaaagtctttatataccagtagactttcagcttgatgttgtagaatagatagaatatagctcagaaaggaaggagtcagattatctaggtcagggaaaacagcaagataccgagggggaggtgaataatgttttaaacaagcagttttcggaaaggaaactaacctgactagttcttgtctaaagtaatgggaaatattataggatataagtaaggttgttctaggttctgaatagctcagaaaactcaacaataaaatttagtaaaatagtgggaagtcttatatagagagggagaaagcaaaacattttttggagacatgttctgcctaagtatttggaagccattaagttgttaataattcctattatatacataaaaatctttagtctccattatgtaatgctaccaggaacctttctgcctgtttcctgcctaaagacttgacctctcaatatgtaataggccacatcagcgcactttgtttatgctaatcattttgctcttttttgattgtacagtttgagtgggtcagcagtcttgtttcctaatctgattttattaactctgtttttatagacataactctcgtagtttaacaaatttttgttagagcttgttttccctattgctataattttaagtcttttctaatgtctgtctttctctctctatatatatatagtggcccagatgcccttttaaaccagaagcacctctaaggttttaaaaaatcagtatcattatatggttcatctcccaaagtctcatagacatttgttaatttgaaagacatttactgaaggttttggttttctatttttcaggtgctggcataatactgcaaaacgtgaatgctactttttttgtgtgaccgtttatcaagatttaactttttaaaaattcacatacagagttagaaggatataatgtttgacttcaaaattggttttagctagctatttttggtagtagtgcatcttaaattttatattgattattggttataaaatatgatttgatttttgaaaatgataatttaaaaccaatttttctttcttttttttttgagacggagtcttgctctgttgccaggctagagtgcagtggcgtgatctcggctcactgcaagctccgcctcctgggttcacgccattctcctgcctcagcctcctgagtagctgggactacaggcgcccgctaccacgcccggctaattttttgtatttttagtagagacggggtttcactgtgttagccaggatggtctcgatctcctgaccttgtgatccacctgcctcggccttccaaagtgctgggattacaggcatgagccaccgtgcccagcccgttaaaaccaatttttcacatgaaatcttgataccgtattgggctacattccaagcacatatgcaagtatgattttcaccttatggttgaagcattgggctagaaccagcatgagtctaaattcctgctctgctgtgaagttggggcataaccctgggcaagttcatttcttgctattgaagcaggtgatcagtaagatacttttattgtcaggtaactgagcaaaatttggctcaaaaagagaaagtaaaataaaattaataaagatgtctctttagaggagtagagaaatataaaaatccaagataagctgaaagatcttaggtcaatgcatactccattaatttaagatggtctggtgaggatcgtgaagccagaattagctctttctcttcatatcagggaaatccataatgcagctgttgtaaaacttgttcaggtcctaggtcatcttacggtttttatcagtaggaaatatggctgaattatatatatggaatataaaaacacatccaggaacatataaaaatcttgacctttaaagctgcaccatagctgtttctaagtttttctactaatgtttgtttggtgtttaaaatcttaactttgaggaagttttttccgttagacctttttttctttttcctgtgaactgaaaaagttgctgttagtttgttttagcagtggagcatctgagagggagtctagtttggaaaacctttgaggtgatatattttaatctatacttcctcaatttgtataattcagtagaaaagactgttcatttaagggaatgtgagctgtttctttccaattatttttttactgtggtataatacatgtagcataaactttaccatcttaatcgtttttaagaatacaattcagtgtatacttacaagtgttttaatacattaatgatgtgcaaccatcatcaccattcatttccacaactcttttcatcttgtaaggctgaaatcctaaacccaaagaatgttaagttttgaaccactactttacaatccataatcaaaaagtgatgttgattaatattttttttccattattttagtataagccacccgcacttaaaaagtcaaattctcctggaactgcatcatcaggatcttcacgattaccgcagccaagtggcgctggcaaaactgttgtaggtaatgatagccgaaaagcaacttgatttgtttttgaaaccatgttggcagagcaggaaataaagatagtggtctattctggaatattaagatagatttataattaagaagagatgtagaagttaagtaattattttttaaaataagataactttgagtagtttctacttttaaccttttttttttttttttgacggagtcttgctctgttgcccaggtttgagtgcagtggtggaatctcagctcactgcaaccttcgcctcccaggttcaaatgattctcctgccttagcctcccgagtagctgggactataggcgggtgccaccatgcccacctaattttttgtatttttaatagagatggggtttcaccaagttagccaggataatctctatctcctgaactcgtgatcccccaacctgagcctcctaaagtgctgagattactggcgtgagccaccgtggtgccgagccacttttttgttgtttttttcagcttaaatgttggccccagatgttgttattgatgtcatctgttcagaatagtcagcccagtacttccttgattctttgatccagcattttcctctcattttatgctagctcttcatagctttctgaactgggcaattgttcgtagtagtcaaacacttaatagttagaagaagatattgaccactgacatgtacctttatttatatatcaattataagagggacatttagaaactagaaatgaaggatgctatatgtcgtcctctggaaatgccatttaaaaaatgtcttcaatgaaaacttgatttatagttgcaaagattattactaaagcattgtttcctttgttagatgctctgttttatgtaaccttttttagagtattgttaaaaataatgcttttttattataaggtgttccttcaggtaaagtgtcttcaagtagcagctctttgggaaacaaacttcagaccttatctccctctcataaagggatagcagcccctcatgcagggtaagtctacactggatataattattagtggtatataattaaacgatactaaggttttgttatgttttgataattgctttttcattcatcttcatttcctaagttcatttgtcttttaacattttgctggtcaggagcacactcactgctgttgagtatctaaatttgtataaccattttagaaaataatctggtattaaaagccttagaaatcatagcttaaattgaataattttacttctgggaatttagtctaaggaaataatttgaaatgttgacgatttttatactaactataatttactaagcactatgtatcaggcactgtgctagacattttgcatatatttttgttaaaaccacttcataatcaagagaaaagaagatcagagaagctcagtttgctcaaagccacatagctgttaaagttagacgcaatatataaattgggatatctttgactgtaaacactggactcttttcacgtttttattataatgttagaaataaataaaatcaccaaaatgtctagctttgtttgaatagtaaattatgaaaatctataaagggatattttgcaactatagtatgtatataaattttaataaggtgattctgttaggaaaatgttagctactgaactccatgtgtagtatgatagaagcagtggggtgattctcttaatttaatccttttttatatttttctactgttatatttacatggcttttaatgaagtatataattaaactttcaatagttatgggaaaaattgtaacagtggagatattaatatagagccatatatttttagaaatttacttattttttattttgataaatcagaaaattaagggattaccacaggaccattagaatgaaggtgtatgtctatatctttacatatactggttcagttgattaatgaaatacagcacacattattttctttttttaattttaacttttaagttcagggatacaagtgcaggtttgttacataggtaaacttgtgtcatagggagtttgttgtatgcattatttcatcatccaggtattaagcctagtacccatcagttatttttcctgattctctctctcctcttatcctccaccctccaaaagactccagtacgtgttgttcccctctatgtgtccatgtagtctcataatttagcttccacttataagtgagaacatgcagtatttggttttctgttcctgtgttagtttcctaaggataatggcctccagctccattcatgtccctcctaaggacatgatctaattcctttttatggctgcatagtattccatggtgtttatgtactatattttctttatccagtatatcattgatggacatttaggttgattccatgtcttcagtattatgaatagtgctgcagtgaacatatgtgtgtgtctttataatagaatgatatatattcttctgggtatatactcagtaatgggattgctgggggaaatggtagttctgtctttaggtctttgaggaattgccacactgtctttcacagtggctgaagtaatttacattcccaccagcaatgtataagcattccttttttctccacaacctcaccagtgtctgttattttttgtctttttaacagcagccattctgactagtgtgagataatacctcattgtggttttgatttgcgtttctctaatgatcagtgatgttgagctttttttcatatgacagttgaccgcatgtatgtcttcttttgaaaagtgtctgttcatgtctgttgtccactttttaatgggattgtttgttttttttcttgtaagtttctttttttcttgtaagtttgtttttttcttgtaagtttgtttgttaaattatagatgctgggtattagacttttgttggatgcataatttgcaaatatttgctcccattctgtaggttgtctgtttactctgttgatagtttcttttgctatgcagaaactctttagtttaattacagcccatttgtcaatttgtgtttttgttgcaattgcttttggcatcttcattataaaatctttgctgctgcctgtgccctgaatggtattggctaggttgtcttccagggtttttatagtttttggttttacattagtctttaatccatcttgtgttaatttttgtatatggtggaaggaagggatccagtttcagtcttctgcatattgctagccaattatcccagcaccttttattaaatagggaatcctttttccattgcttatttttgtcaggtttgtcaaatatcagatagtagtaggtgtgtggtcttacttctgggcttgctattctgttccactggtccatgttccagtaccatgctgttttgattactgtagccctgtagtatagctggaagtcaggcagcatgatgcctccagcattgttctttttgcttagaattaccttggctagtttgactcattttttattctatattaatgttgaaatagttttctctggttctgtgaagaatgtcactgatagtttaatgggaatagcattgaatctataaattgctttaggcagtatcaccattttaacaatattgattctccctatccatgagcatggaatattttttcatttatttgtgtcatctttaatttctttgagcattggcttgtagtcctccttgtatagatctttcacctccccagttacctgtattcttaggtattttattctttttgtggcaattgtgaatgggagtttgttcctgatttggctctctgcttagctgttattagtgtataggaatgctagtgatttttgcacattgattttagaatcctgagactttgctaaagttgcttatcaggttaagaagcttttgggctgatataatggggttttctagatacatgatcatgtcatctgccagcagggatagtttgacttcctctcttcctatttggatgcccctttatttctttctcttgcctgattgcactggccagaacttccaaaactatgttgaataggagtggtgagaaagggcatctttgtcttgtgccagttttcaaggggaatgcttccagctttttcccattcagtatgatgttggctgtggattcgtcataagtggctaatattttgaggtatgttcctgcaatacctagtttattgagagtttttaacgtgaagggatgttgaattttattgaaaaccttttcgtcatctattaagataatcatgtgctttttgtctttaattttgttgtgatgaatagcatttattgatttgcatatgcggagtcaaccttgcatcccagggatgaagcctacttgatcctggtggataagcttgttgatgtgctgctggatttgatttgctagtattttgttgatgtttatcaaggttattggcctgaagtttccttttttgttgtgtctctgccaggttttggtatcagggtgatgctggccttatagaatgaactagagttgagtcccttcttctcaattttttggaataatatcagtaggaattgtaccagttctttgtgcatctagtagaattcagctgtgaatccatctggtcctgggcttttttcaattggtaagctatttattactgcctcagtttcagaactcgttatttgtctgttcagggattcaatttcttcctggttcagtcttgggagggtgtaggtgtccaggaatttatccatttcttctagattttctagtttatgtgtattgaggtattcataatattctgtgatgacttgtatttctatggggtcaagtggtaatacccctcttgtcatttctgattgtgtttatttgaatattctctattttcttctttttagtgtagctagcagcctatatattttatcaattttttaaaaagcagctcctagatttgttgatcttttgaatggtttttcatgtatcttcttcagtttagctctgattttgactatttcttgtcttctgctagctttgggatttgtttgttcttgtttttctagttcttttagttgtgatctttggttgttaacttgagatctttctaacttttgatgtgggcatttagtcctataaatttcccttttacactgccttagctgtgttctagagagtctggtatgttgtttctttgtactctaagtttcaaagcacttcccgatttctgcgttaatttcattatttatccaaaaatcattcaggagaaggttattcaatttatatgtagttgtagggttttgagttaatttcttaatcttgatttctaatttaattgttctgtggtttgagagaatatttgttatgatttcagttcttttgcttttactgaggatgttttacatccaattatgtgatcaattttattttattttattttatttttgagatggagtttcactctgtcgcccaggctatagtgctgtggcatgatcttggctcgctgcaacctctgcctcctgggttcaagcgattctcctgcctcagcctctcgagcagctgggattacagggatgtgccaccacacctggctaatttttgtatttttagtagagatagggtttcctcatgttggccaggccagtctcaaacccctaacctcaggtcatctgcctgtctcagcctcccaaagtgttaggattactggcatgagccaccgcgcctggcccatgtgatcaattttagagtatgtgccagatggtgatgagaacactattctgttgttttagggtggagaattctgtaaatatctatcaggtccatttgatccagtgctgagttcaggtcctaaatatttatttgttaattatctgtcttgataatctgtctaatattgtcagtgaggtgttaaagtctcccactattatcgtgtgagagtctaagtctcattgaaggtctctaagaacttggtttatgaatctgagtgctcctgtgttgggtacatttgtatttaggatagttaacttttcttgttaaattgaaccctttaccattatgtaatacccttcttttttttttttttttaaatctttgttggtttaaagtctgttttatcagaaattaggagtacaacccctgcttttttctgttttccatttgcttggtaaatttttctccatccctttattttgatcccatgtgtgtcattgcatgagatgggtctcttgaagacagcataccaatggatcgtggttctttatcaaaatacttgccactctgtgtcttttaattgggtcatttagcccatttacatttaagactagtattgatgtgtgtggatttgattgtcataatgatgctagctggttatttggcagacttgtttatgtaactaacagttttacagtattactggtctgtgtacctcattgagtttttgtagtggctcgtaattgtcttttctttccatatttagtgcttccttcaggagctcttgtaaggcaggtctggtggtaacaaattcctacagcatttgctggtctgaaaaaggttttatttctccttcacttatgaagcttagtttggcctgatatgaaattttgagttggaatttcttttctttaagaatgttagccaggtgtggtggctcacgcctgtaatcccagcactttgggagaccgaggcgagcggatcacctgaggtcaggagttcaagaccagcctgaccaatgtggtgaaagcctgtctctatttaaaaaaaaaatacaaaaattagccgggtgtggttgtgtgcacctgtagtcccagctacttgggaggctgaggcaggagaattgctcgaacccaggaggcagaggttgcagtgagccgagattgcgccattgtactccagcctgggtgacagagtgagactccatctcaaaaaaaaaaaaaaaaaaagaatgttaaatattggtccccaatatcttctggcttgtagggtttccactgagaggtctgctgttagtctgatgggctttcctttgtaggtgacctggcctttctctctagctgcctttaacatttcttctttcatttcagtcttggagaatctgatgattatgtgtcttgtggatgatcatctcatgagtatcttactggggttctctacatttcctgaatttgaatgttggcccatctagctaggttaggaaagttctcatggatgacatcctgaaatatgtttttcaaattggtgccattctcctcatctctttcagatataccggtcagtcatagatttggtctttttatataatgtcacacttcttggagcttttgttcattccttttcatcctttttttctctattcttgtcagcgtgtcttatttcagaaagccagtcttcaagctctgagatttgttcttcgcttggtctcttctgctattaatacttgtgattccattatgaaattcttgtagtgtgtttttcagctttatcaggttggttatgttcttctctatactggctatttcatctgtttgctcctgcagtgttttatcatgatttttagcttcctttcattggattacaatgtattgctttagctcagtgaacttcgttcctgtccgtatcctgaattctgcttctttcatttcagctgtctcagcctcagcctgattctgaggagattctcagcctgattcctgttggagaggtgatgcggtcacttggaggaaaagagggcactctggctttttaagttttcagcatacttgtgctgattctttctcatctttgtgagcttacctaacttcagtctttgaggctgcttacctttggatgggtttgtttttttgaacaactctggctacttttccatagggctgcttgtgtatgctgggtgtccactccagtcactagtcaccttggatttttcagtagctggaggtgtcaccagtgaaggctacaaatcagcaaaggtagtggcctgcccctcctcctgggagcttcattttagggatgcctcaaacctctgtcagccaaagaacacctgtgggtgtggctgaagactccagttgggaggctccacctggtgatgaggaatgggactgggaacctgcttaataaagcagtctggccacatttttatgggaccactgtggtgtgctgttgtaccacttccacctctgggtcggcatgggctctccaaaccccagagactgaaactgctaagttgcccaaacagcaaagatgatggcctgcacaccctgtgggagttctatcccagggactttgcaaatctctgtaggccagagaacacctgcagggctggctggaggtcccagttgggaggttctttccagtgaggaggggcaatattggggacttacttaaagaagcagtgtggccacactttcctagagcagctgtgttgtgctgggttaccactttcgtcccagttggctttggctctctgtgggccagagaataccagcagggatggttggaggtcccagttgtgaggtcctgctctgtgatgaggaatggattgggaacctgcttaaccagcagtctgaccacattttggtaaagaagtcatgctatgctggggaatcctctctgcctctggttggtttgtactctccaaagcctgcagaacagctgagtcacccaaacagcaaagatggcagcctgtcccttcccctgggagttccatcccaggtaggctcaaaactgctactggtggctggctggaattccaagccagtgggtcttatcctgtgaggtgttatgaaagtgagacctgcagactgtctctacttggtcctcttgattcagccttttttcctaagggtatgtacgggggtctaacatcctgctttgctggagttgcagttacttttgctgggaagtttggagttcctgggtctttgcctgtgccggagcagctgctctgccaagactccccatatctgtatgtcagactgaaggctctagtggagtggcttcacaagggcgtctcttgacccaagggttgcaaagatccgttggagaagcgtggtttcccagggtcacacgttcactcactgcttccctgggccagagaggttcaccttgctctgtgtcgctccaaggtgggctgtcatcctgcctctcttttctttgttctctgtgggtcaagttgtttccttgattagtcccaatgcaagtacatggatgtttcagatgaaggtgctgtatttactcaccccttttcctgttattttcaagtgtaagttatatgtggctcacattcattttggtttttatgtgggaaatatatacaaagatatctgtcaaatgatagtaactacattttgcttctcaattcagactacatagaaaatggaagacctaaaggaatataatgtaattatcattatagaaaaggaaaaaaaaatcaaccaacaatatcttttgagttaagtgatttttcttattgttgtgcttccaaaaacaagagacaggctatccataagaaagagacagtttatcagtagatcaggtagttgaaaagtaaaaaaattttatcttttagtggtaagaaactgatctgatttattttcttctccaatgagttgactcattggatgattaagtgaagtatagacatagcaatatgtgctttaattttacaaagtcattttaccatatcacagagaattggcctccatgttaggtaacaatatttgttcatagtgttgtttatagtttcacttacagttgatcatagattaaaagctgatatttttcagtatttctatagtactggcaattttatcagttggcaatattaaattgtactgacacagtattcctagataggacgtgtaaagctggctggtgtaatgaagagaggcgctgaccttggagttagaagactaggtttctgcatcataatctgccactaaatagctttgggcatgtatctctttgtcatgctgtgacatattgtctgactgtgacaacatctgtgactctggttagaccttgacaactgatccaagaaaatctgaccaacatacctggttactaatggaaaatatgcttttgctaacaagcagagattttgagtacaataattttgtcagttgtgcattgcttatgatgaatgccatgaagaatacatattttttggctatcccacatcatatataactgtcaatcatacctgttcaaattctgattgtccattctgtataagatccttgcagattaaaggaagctttccaactactggaaagagagctgtggagctcatttctaccaatatattactatattaactggaacattgtgttactgtattaaattagaaccattcatagctgtctatttagtgacagagttccttcctttttttttctttttttttttttaagaattagtgaagtaatgatttgtttctcttgctagattgtaagctccatgatggcaaagactatgtctgccttgcttccatttgtaactaaaatctagcagaatgcctaggctaacaaaaaatttttggttaagtgaaaaaagataataaattaattccctcatctgttaatctattggcatgtcacagaattatcatctggtaccagtgaaagaattacttaaagtttgtatgacaactgttatttcgatttatacagatgattcaggattgagtaaaggttgaattaagacatttggtcaggtgtaatgctcaataaattgagcattcgctgagattagtaaatgctgttatttcagtggattgcaattatttaaagtctggtgtatgtaatctttattgtagtccactttaatcaggcataccagtgatctgtaatagaatcatgccacaaagagatttatttttacactcagaaaaattctcatatgtttggttgtttgcttctagacagtttgtggattaggccaggtgcagtgcctcacacctgtaatcccaacactttgggagagtgaggtgggagagtcgcttgaacccaggagtttgagacttgcctgggcaacatagtaagaactcgtctccattaaaaaaacaaaaacaaaaacaacctttttaaacctttttttaaatgtaaaaaaaagcaatcaaatcaatttctaggtcaattttaacagatttgtttaaaaaacaacaaaacacacccaagtagaaagtttttcccttcttctaaaagatgattatcttttttttttcttttttttttttttgagatggagttttgctcttgttgcccaggctggagtgcaatggtgcgatcttggctcaccgtaacctccgcctcctggattcaagtgattctgctgcctcagcctccccattagctgggacaggtgtgtgctaccatgtctggctaattttgaatttttatgggttttcaccatgttaggctggtctcaaacttccgacctcaagtgatccatccacctcggtttcccaaattgctgggattacaggcatgagccaccacgcccggccaaaagatgattatctttaataccaggaaattttagaaatacagtgaaacacagatcttttaaataaatatttccccatttgaattgttccctagagtttacacagttgtaccttattaccagtttaaatggatatctcagttaataattttcaatagtgaaactatcaaatatcagagatttacttccttttagttactatgaaaagcacatttactttggagagcaactgtaatacacctaaaattagagcaaccaaaggcatgtatggagcattttttaatttaaaaaattgcattttgtttctcataccttatttaaaacattaagaagtaaatgtctttagtttttgagtacatttttatatgaataggaaacatgctgttttcataatccagtcttttgatgtgtgtgaaatgaatttgtgtggagcgttatgtgaatttttatgaacttatcttttattgttgatctagaaatgcttgtgataacctagaattccagacctcggtttcttatgtggataacaatgattggagattttggatagggagctaactttgctgtggaattgagatactaattatttgtgtaggattgataaatttaggatcaaaagtagaggtatgacacatttcaaaactgccttagagcaggggggtgttcaatcttttggcttccctgggccacactgaaagaagaattgtcttggaccacatataaaatacacgaacgctaatgatagctgatgaactaaaaaaaaaaaaaaaaatttcataatgttttaagaaagtttacgaatttgtatagggccccattcaaagccatcttgggtggcatgtggcctgtgagctgctggttggacaagattgccttatagcatcataacaacagaggtgtgcaaagatacaaaataccatccggtaaattcttttcccaatattatttcagaaatcatctttttgttatatctcaatctacagtacttgctacactcctacaaggtacctagtaagccacactaaaattacttatttcgtaagtgaattcactctcctggtatcaacagtaaatgacttttcctatgttaaagtttatttcaaatcagggataggttgatatcgtcaccatactcattcagctatgagtattttgaaggcctgtgaaagtattatatgtataaaatcttgattgttattgagatttatagattttgtttttgatagcctaatggcaacttagaatgtaagttattaagtgattatagcctaaaaatagcattcattaacttttagcctaagtaacatttgagttttgaatgtacatatatatatatgcacacatataaatcaagttgaatgttataatacaagtatggttaaaatcattactggaacctgtccttcaattaggttttcaaaatctgaaaatattggcaatctttttatatatgtaatgtttccattggataattacctttaggtttttattatattttacacatctttcttgaactgaactttgttgtatcacatgtaggatttgaccatttcttatcatataagaggaatatgtttttaaaatatagtcaaaaattttctaaattttaatttcaggaagttttttctgagaaagaaaaattttaatccttatttccagaatcatgtaagataaccactgtttggaagaaaaatgttttgataattaaggattagaataaaatctgaatgtttaaaattccaatagatgggtttctttgtactttaacaaattaaaaacaaattttaatttaaaatattttagaaattttacttaatacatttatttaatgaaggctgcttttaagaactttaaatcctcacgtaaacaccaccacctgcaaagtattaatatcaactttttcaacaaaatgcctgctatgtataagctactgaaagaagacaaaaattaataaaatgtgtccctcctcttagatatctataatctaggaaaatgaacacattcttttcagacactaaactccataagaacaggtatcagatctatcttatttaccaccacatcctgagaatggagcacagtgcctgacacataatagatgctcataatagatgctcagggtttatagtcagtgaataagtaaagaaatgagtgagcaaatatctcttaaaaagaacagacttttaaagttaacaagcagtgatgtgttattcagtagcaaataagattgtttcctaatgtcataattcaattttccctgcttcctactatgactagatgttggttggtgatagtttatatgattcagttatttggttggttgatttaaaacagtgaaatatcctacaaacctgcagtttgtcctgctatcctctagatggagagcctttataattttggtcaaaatgtgtgtgtgtatatataggccccttaccattattatatgtgatttttagaattgtcatccatgttttttttttccatgccgagtcctgttttactttggatacatttcagaaataaagtcacttttttgttagaagtcagtggagttagaaagtcaaatggagtacatgttatttagtcaattccttatttttggaattttaaaaagcacggaaataaataatatgaagagtagagaaagtttccatgaattctgggaggaagaaaaatcatttgtgaataacagcattcagttcacttatagcttcatgattttttttttgaaatagttgttcttcctaagtttcttcattgattccattgccctgctgtgtataatttgacatttgtttggatgtgtagggtagcctgtgtagtcagaattttcagacctaataatggacattgtatgaactctctgaggattcttttggacattagttcttaccttgacagtcagataaaattaaggacttggggagtagatatctgatgaaccagaataatgtcttttaaaaaaactttatataaagaagcagtagcaatctccttatgggtacacctttatatattttaatagtaatatggacaagttaggccctccacttcgaacgggaagacttgtgcaaaggttgtatgacagtgatacaaaatcagacagtgccatcaaaagacatgagttattacctatttacaagtaagtatttgtaactcagtttggttaatatttttcagatatttccttaaaagctttatataatggaataacataacttttactgtcctatacttaaaaaaatctgttgaataatttctaagccaaaatgtgtcaaataatctaggatttaaaacattttgatttttagtaagcatttctgttgtactaaataaaactttttaggttatacattttattccattaaatattaattttttgaggtttcaaattgcagtcacatttaataattatttttatgaagttttttttagtagtaattagggttttttgtaatagtagttttaaaaagcagagtttgagaaaaataatgtcttgtacagtatataatattgttagattatctcttagataagccgatggtgaactattataaaaagcccagaaaaagaaaagattttaggaaactttcaatccaagggtccttagtctttttgttagatggttgtaaattctgcctacaaccgggaaaaagtatgacactgccaaagagtcaagctcgaggaagagtatgacacagccagttctgacctggctggctgaaaagagtgtgtggcaatggcagttactttgaaactctacagcatgagtcttcaaggtttactaatttgggtctcaattctagcccacattttaaatatgaaattagggcctaaaaattaatatacctattaatggtggaaaatattaagcagagtaacttagttaacttttaaaccaacacctactacaacagtctgctcagtatgtatgtatgaaaagtaataataaatttaactagataaacaaaggtaggagaagtctttaagatactagcagcagccatttgctatttttaagtagtgataaatcctagcaggaagagtttgtgctgtgagccgtttttcattttgctgattctactgtcagaactctctgatgcagatctcacagtaacagtgactagcagtaagatggattaagtacaattccaaaattaaaccttctttaattattcatatgagctgttaacaggtagattctagatacagagtaagagtaatgctttgcagattctgaacagaaagaaaaatttgtggactgtgtaagactggggcaagatgttttaagtgatcaaggccattctagatgttactaaaaataaatgacaggtatttaatattggtagctattaatgatgataatctcttatattttcctctaaatataaacattttgaacaacctcaagttaccgatatggtgacattatgtgtatatattcatgggtgtgtttgtattgtttgtatatctcatgcacttaagacgattctatagccaaaaaaaaaaaaagtgttcttcctatttaaagtccattctttgacaatgatttcctaaagattgaatttctagaaaaagactctagtagttctacaacatccccaaagaggctatacacaagagtagagtaaacctcatgaatggacttggagtgagcatttgaagaggtgcagggcattccattcatgcaccaaagtgattctttgcttgttgaagtttagaagtaatttaaagaagtaactatgcaaagcaaccactttgaatgacagcattgtgtattgaatatgagttctgtaatacagcccacttaagttcaagtactactctggccacgtagtagcctcacaatttatataatctctttgaacatgcttccactttaaaatgggaataatatcttctgagatttgggggacattaaataaggcatgtgtagtatctggcttcataattgtcatgtagtggctgtttgaaaaatagtggatgttgttattacctgcatgtactttggaagcagctatttacaattttagggtactctctcctactttgccatataagtagagtaagaaaaatttcaactaaagtttaagaacctctaatctggaggtattttttaaagtattctgctgttcatataacactgttcacctgtgaaatttaaagatttgattaaagctctatagagagggagggaactatgcttcaatgaacatctaaatcctagctttggaacacactagcagggtcaccttgggtaagttacttaggggctctttacctcatttgtcttatctgtaaatggagttatgaacgctacctatttcataggattattaggataaataaatttctatgggcaaaataattagaattgtacttgacatggagtaagcactattatataaatgttaacttatagtggcaacaacagtagtaatagtattagcatcagctatctaaatgtttatatgaattgtactttttttctcataacctttctataagtgatcattttataaatgatgagactcagacttgctgtcacaaagctgtcagtagcattagcatttgaatctaaattcatttgaattcccaagcctctgcttttagtgttatatcatcatcatttagttttctaacccttctttgattcttaaagtttcaaaatggagactcatggatgatccaaccagaagtccctctgatttcggatagcccaggctgtgcagttggtaaaattaaatctttaaagggaatattatattaactcatttattttagttgctgctttttagaactttcataagttgaatattattctttaatgtgactagcaaaaaaattctttttttaactacatcgtatatgcctagaataatgaaacttgtttgtttatttaaccattatccgtaagcatttatcagaatatatgttttgagggaaatataaatttaaactgtttttaaaaatgtatctttcagaatgattaccttataaatttcatgtaaagcatatatacatattttagttgattttatttactatcagaatagtattagtaaatgcaaaattatttggtttatctttaatattaactactatttgctttcagatttaaaataattattgggactttaatcttttgaacttctctgaagcttctaagtattctttctagtcatgtgaataggtaatttgagaaatacatgctcactgttcaatacttttccattatttttcctcttttttatagagctaatgtcaaaccccgaaattccacaccacctagtttggcaagaaatcctgccccaggtgtgcttacaaacaaaagaaaaacatatactgagagctacatagccaggtatgtttagctctgctctcccaataactaaaataaaattgagtatatgatagttttccaaggaccatacacaaaagtaagtaacaagctatttatagaaaacctgatttttttcttttaatctggcttttaagttgtacacctctaatggatttgggcaaagtaaactgaaaaccttctgtaaaggattaacccttctacatgccactaagaacgtatgtgatttatgggaggaggtcaaaatatccacattaataagagtttggaagaagttgttccaaacttcatggatgactttgagggacttaagacttcagtggaggaggtaactgcagatgtactagcaaaatagcaaaagaactagaatcagaagggaagcctgcagatgtcattgaactgctgcagtctcacgataaaactggaatggatgaggagttgtggtggctcacgcctgtaatcccagcactttgagaggctgaggcaggtggatcacctgaggtcaggagtttgagactagcctggccaacatggtgaaaccctgtctctactaaaagtagaaaaattagccggttgtggtgttgcacacctgtaatcccagctactcaggaggccgaggcaggagaattgcttgaacctgggaggcagaggttggagtgagctgagatggggccactgcactccagcctcagtgacagagcgagactccatctcaaaaaaaaaaaaaaaaggctgttatagtgtatagttcatctagcatctattttacctttattactgtttttttttgtttttgtttttttggtttgttttttaagacggagtctcgctctgtcgctcaggctggagtgcagtggcgcaatctcggctcactgcaagctgtgcctcccaggttcacgccattctcctgcctcagcctcccgagtagctgggactacaggcgcccgccaccacgcctggctaatttttttgtatttttattagagacggggtttcaccatgttagccacgatggtcttgatctcctgacctcatgatccacccaccttggcctcccaaagtgctgggattacaggtgtgagccaccgcacccggcctagtatgttttgttaatagataatagagacctccctgtgagtgcatgcataagagtttgttatttattgcatcacaataatttaatatcattaaataataaaactaaaataaatactagaagcatcacctcacaatccttgtgaccaaggagagagacttgaaacctaaggatctctatctttcctcatggttgggttctctttagagatgggtttgcagaaaggacatcataaatgttcattctgctcccagtgtagtaaattcctagcacaaagaacagatggaaagcgatgtggtttggatttgtgtcctgcccaaatctcatgtcaaattgtaaccctcaacgttagaggaggggcctggtgataggcgattggatcatgggggtggacttccccattgctgttcttgtgatagtgagttctcaatgtatctgattgtttaaaactgtatagtacctgccccttctcttttttcctcctgctcccaccatgtaagacatgcttgcttcccctttgccttctgctatgaataagtttcctgaggcctccccaaccaagctttctgtacagcctgcagaactgtgagtcagttaaacctcttttctttataaattacccagtctcaggtagttctttatagcaatgtgagaacagactaacacagaaagcatggctgcatttggtcatggtaaattctcgtaacacagataaatataatgttaaaaaaaaatgttagaattttagtatttactaacaaggattttttaaaatttgaactagaggaatattaaaaacgagattaagcaggctaattgttatatttatgtcctgtttctccagggttatgggttgaaaactactgatacaaactttatcttttcattgtttctttacttttttaggccagatggggactgtgcatcttcccttaatggtggaaatattaaaggcattgaaggacattcacctggaaacttaccaaaattctgccatgagtgtgggactaaataccctgtagaatgggccaaattttgctgtgaatgtggcattcgaagaatgattctatgaatagaatctcaaaaaaaaaaaaaagccaagttcagagtttatgattattgctgcttggacagctagagcacatcctctagttagtttgtgctaaaaatactcgaaataccatttccagttaattttgaagtgtaatcttttggctatataatgtgtgtatgtttatatgtgtacatatactgtatataataaatatctgataccccagactgtgtcattcaaggaaatattcacttatctgtcagaaaataatttcaaatggaacaattaatttaggtgttacttttctgttgttgttaaagcacgttaagtacatttccacaaactctcatactctagtgcttagcccttcaagctttaggataagtataactttgagcaaaaaatttggataaacatttgtattattggtgcctatcttcagatagtatcatagtaggatagatgctgggaattttgtaattaaagagaacagttttagttaccattaggtatgttaaggtcactcctgtagagcatgtcaacaaattatttcataaatccgaaaaactaagagaaaaaaaaacccctctattagttacgtaatttaaacatcttacttgttttgtaaaagtgtaattatgcaatttccttttcaaatacacaagactaaaaatacaaatctatcttgttctatttataactgattttttttagttctgtatgtattcgttgaacatatttttttacttccaattgtttttccagatttcacttttcctctttttccataacccgtgaagatagttttaatttgctagttcattttttgctgtatttgaaaatgtaattatttaatatagaaggcacagaattccctgcaaaatcttacatgtttaaaaacatataattttttgtatctgaatttagaataaatcattttaatgcatcttaaatcacgtcacctaatcataatagttgtggtaactaatcattagtgcagagcatgcagataaaaaatatttgaatttttttttcttggaagtacatgtagttatgagtaggttaagagaatatctaattttcctactctttttttcatctttagcatttaatgttgaaacaccattcacgtcacattaaggacccactgaaaatgtattgttttaatgcataattgacttacctaattaaacatacacacaaatttaattatttttttctctttaacctgatcacgacacagctcttaatcattgtcactttcagtatatcatagtagttagtagtagattgccttgatggcagtaattctgtagtaatttctattcaatcaaacctaagagagctttgatcttactgtaaaggtacaaacaaatctcttatataattcctagcttttttttttgtttatgattctgatcaactataagacacaatgtaaagaattgtggcttataatttatctgaaatttattagcttagtttagtttgggcaggagttacaaacttaataggaattgtcattttacttacagtttatttcctgattagttgttaatttttttcccctcagttatctttattcagtcttattggtcaaaacaaagaaacaaatagtccatcaactaaaataagctgtaatgaatttagaagatgaatgcatatattagatttccatttaaatcacttctgttataaatcatataaagaactttaaacttgttttatctaatactgagcactgtttttttgtcaagtatttttttaagaccacataattctttttgtctgctcaaggaaaggatagataaataattggcacacatttgtttctcactgaattttacagtagtaaattaatgttataatgtaccacatggagatgagttggtaagaaatcatctagttccagagcccagagattataaacagtaggtgaaatagatttatgacttacgaaatatgttgtgacaatatatttaaatgcatttttatattacttgcatattctcacattgatttgtgcaatagttcagttttaaaaaaaatcttcctatgcatcatgtattttatttttatttattttcacaagtatttgacagtatggtagaataaaagatgattgtaagattaaaaatgtaaaaattgcttatgtattattctgaattgtgttaggttgaaaaagatgattgtggtgactattatttcttgtccactatttgttttttgttttttcaccaataatgtcttcatatttgaacctattcaataaagacatgaagcataaaaa

SEQ ID NO: 442 - DNA, 114600 bp, Homo sapiens
ttgttctttcctggccttgtggagtttcacgttttttattcagttaaagattcaaggtactcctaagcagatttctgaagctctttttccatgtaattccctcctctccagaattctgccctacaaattccaaccgacttggcctaccccaatttcgtcaactccaatctctgtcttttcaacccaggagatcctaggtttccatatgatttcctttcatcgcaccacagactggaaatcgcctctgggcaaaagggcaggatgatatacggctccttttatttcttttctctcaggtaaaacagtccacagctgtccgttgtccaatgtctgaataggtgtctcctatattttgttccgttttctaattgtttatagtgggacactaagtcccgacccattttcttttcttgcccagagtggaagttttaggaaactccttatggaaaatgtgaattgttttattattttttatggtcgaaaacatctttctctatgatatcttcccactcaccctacttttttccttctcaggaaacactgacgggaacacacgtgccggtgctaccctccagtgactggactagatccttgcgcaacttcaacccgcgctagctccgcctacggccggccacgccccgtcttctcaccggcgcgcctccctcttgttcgtcctccctccccctgtggactgcggcgctggcgttccgcgcacgccggctcactgcgcctgcccggcgtgtggacgccacacgctcccggaagtgggaggtggccgctggagtttgtgtggccgccgccgcgggaacgcgagcccggtaatttttcaacggagaaaggcgaggctttcgggctctgcagagtgagagttagcaagtgtccggctccagcaactctcctctggcgtgacagccggcatggaggatccacagagtaaagagcctgccggcgaggccgtggctctcgcgctgctggagtcgccgcggccggagggcggggaggagccgccgcgtcccagtcccgaggtgaggagtcgacccgcgcctggctgttggcgccagctgccccgtccccaaagcgccctcggcacccctttcttctcaggtgtcccgcagaaggtgcagctgtgcgcccttggaccccagcctcttcctcggtgcccagctccctggctttatcctcgggtgggtgtcttggagccccctcagggccgaatcactctctgggagggaggaaatcgtcaagaccagttctgtctacagtgggttaacaggttctaagagggagttttgctttaaacttaattctgtgttcacggttgctgttgtcactccatgtagccgttatgggtagtttgcaaggctttatgtttttaaaatctcaccatatacgctaggtatgtcacttcatgcctgtttttaaaaaaagaaaaaatttaaaaagcactcaccagcatccctgtctctgtacctgttaagtggagcttcgtcttagctgcttttgctcattaactggtgtctcatataaccatagtataagattgaatgaatcattttgacatctcatcggttgaacttagttacagtggcaaagttgtagaacagtcttaaaacttatttaacgaatgttaattgttgactagcgctgcggattgtaagtgattgaatactaaaattgatcttttcctaataataaacatgttgaacacttcgtaaagcttcataaagtgcgtatttgcaagaggcctcctaactcttgctccttccgtccacagtcagtttccatctggcagctagaatgagcttttcaataacatgaatttggcttattcccctcctgagtcacttccatttgctgctctgcggggtcgggtgcctgcctcccttggtaattgcatctcacacagttttttcccttttgttcccagtgcccctcgctgccttgtgttctttgacattggaaagaaggtctcgttaaggatctctgtatgttccttttgccctgtgtgcacttcctttggatccttgcaattatctttctccttctaaggttgttatttcaaagagtacttgcacatcccttctcttgtaaagaaccactcttccacctgcctccctcttcagcctgagatacgttgtcaatctcatcctgtaagtgggttttaaaataaatttcgaagtttatttttagtaaaagaagtgtgtttgaatatgcttctttatatttgaaagtcttgacacttttacagctacttaaggcctaggtctctgttccaaattggctttagtgacggtagtaattgttaaaaacttactgttgcatgctctttatagtgatacttttttttttttttttttttttttttacaaaaagccggtcgtagttgccctctcccgtagtcccagctactggggaggctcagtggggaggatcacctgagcccatgggtggaggctgcagtgagctgtgatcgtgccactgcactccaacctgggtgacagagtgagaccctgtctcaaaaaataatagtaatgatacttttttttttttttttttggagacggagtttcgttcttgttgcccagtctggagtgcaatggcatggtctcagcttactgcaacctcccgcctcccggattcaagtgattctcgtgcctcagcctccctagtagctgggattacaggaacccaccaccacgcttggctagtttttgtatttttagtagagatggggtttcaccatgttggccatgctggtctggaactcctgacctcaggtgatccgcccacctcggcctcccaaagtgctgggattacaggcaatgagccactgcgcctggccatgatacagtgtttttcaatctgggccaaagttttttgttgaattcaggtggtaaatttccattatctctaatgctagttgtctttgtaaactagtagaagctattgcatatttatatttttaataagtaggttcagatttcatcagaactctccttttggaagaacgtcaatcaagaaaaattctaagttttttttcagtgtgcagatgcagaggttttccttttctttttttaaaaggtagtacctagatttttggcagcagaataatagcatttccagaacatgttttcaaaatgttctctatacagaaaaagttttatttgacaagcagttactttgtagcttactgttaaaatgtgttttcttttttcttgcaacaacagattgtgttcctttaaaaaaatgctaaaaatcaagctccggtacccttcccaataagaagaggacagcaattatagaatacctgtctttttgtaaaagaaaatttgtaactcatctttaagttcaacaacagtttttttatgttttttttttttttttttgagagggagtctctctctgttgcccaggctggagtgcagcggctcagtctcggctcgctgcaagctccgcctcacgggttcacgccattctcctgcctcagcctcctgagtagctgggactacaggcgcccgcccggctaattttttgtatttttagtagagacggggtttcaccgtggtctctatctcctgacctcgttatccgcccgcctcggcctcccaaagtgctgggattacaggcgtgagccaacgcgcccggcctcaacgacagttttaaagtagtttgccacaagatagtaaacctctgtttggtatagaagattttcatggccacatcccataatgtaaaagcttctcttatttgagataatataaaccatacatccacttaattgaatacgtgaatattgcaaaatgttacagttctgtgatggtgaatgtttctctccatattgtggaatctatcacttttctcattatatggtccgtattatatgtgacatgtgataggtggatgtagttactggtacggatgctgatgcaaatgtaagtatgtatttcgtaaactaattttgtctttctgcagattaacaatacaagtagggtttttagtattttctttctgctccttggcagattgatttgagcatccttctttgtgaaccattagtgtagatttgaaatttgggaggagacactgctttctgaggattggacctcggctgtctctagaacttcactgaaggaagagaactagagctggacctaggaaaggaagcaaatttttctttatggaagtcataatttatagcatctatagaagaggcctaagtgttacttgtgaataatttttctagctacagtttaggatgagaattaaccagtgaatcagaaagaggatttatccaaagagaaaatctgcttaaattaactgagacatctgttttggtagacaaactgttacttaatgttgacctaaattttaacctgaaatttactaaatgatgactaaagatgaagtttcaaattcaatgtaaatttaaagtcaaaagataattttttgtaaaattctggtcaagcagagcaatatctattgtaaatctaatatattgttgaaagtgaatcattggtcaactagcaatactttttttttccttaacattgttaacaaggaacctcagtgtggctgttctttaatttatggacagttcacacattggaactgctgacctcttcctcaaaggaaatgggtgagtcactcttgagtactctggcaccttacctagcattacatttccagtaaatgtgtgttgcattaaattgagagcttagagtaagaaatggttcctgaaccatcaggatcagttctgagttagggactgtggcctctctgtgattatccttccttgatctataattacagtttacgtgaggacaatgtggtacattataactaaggtaacaagctttaatagggataattagtactaaatatttttcaaaattatggaacatagctaatatttgtgatattgcatgtggaaaataacttacaaatgaatctttggaacttaacatattagtaatttgagactgcctgtggagaaaatagaattgagtcatgttttttcttaacagatttttatttatgaaaaaattcataattctatagttcttctggttagtggacctaagtacaacttttggaaaatgtaagttttgaaattaaatacatttccttctttgagtactaggaagctgtaaattagatttgcggtccattttgtttttatgttgggcaatttttgttaactttgtgaaatgaagtcaggttaaaaaattatcagaagttattacacatgtataatgtaaaagttcatttaaaaatgggttcatttgtaaatattagcatattgtttgtgaagggcttgttgtatagcctgtgatattaatagttaccatttattaatagctactgtgggtgtaggggtctgatacacataatctcatttaatctttgtaataattctgcccaaacactatttaccattaccaaattaccattttatagataaggaaattgaggatcagaggctaatacgtagctatccaaagtcatgctgctatttctagtaaatagtcagctggggttctctattgaggtggtgttgactcccaccaccagtcttctttttacttagctttgtttcctttgaggaacctcatgactcataatagagtggggtaaattgtattggagacgcatcttccttcttatcctttcctccgtttaggagctgcagtgaacacttttcattgaacatgtagcatgaagaggcttcagaagtttgaaagtttgaatctttaaatctgtgatgtttgtactaattataaactacatcctttttttttttttttttttttttttttttggtaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactaggtaattaaaaataacttataaaattataaaagtagtacatgctcattttagaaaatcttgaaaacattgaaatattaaaaatcatctgtaatcctaccgtaatgacatgatcctattaacagttcacaaaaactaattaacattttttatgtgcaactctgattatttttgtctgtcttctagatgataggactgctgaatcaaagtcaaatattttaatgacctaccggcaatgtataggagtctctgtcttattatgacaagagtgttttaaatttttttagttgctcatttaaatgatggatagttatattagtgagatagagtattttttattttctttttgccatttgtatcttttataaaaagagtttgtttgaaatcaggtacaataaattaaaaacattcacttaacaggaatattttttgttttaatttctaaaaaataatctacaatgatcgtttgcattatgtttcactgtatattgagtgagaaaacaatgcaacttagtcaactgtatgtgtattttaatgagatatacacatacctaagtttttagtaattttttgcgaaacaaatcactttacgttcattgggccatggggcagaaatggcttttggagtccagaaaaatacatcgatttttgataaacggtagaactgccaggcatcaagaaaaaaaattgcctgtatgaaataggtaaaaactcttcctttttcaagacatctctgaatcataattctcttaatagtagtattcttcctctttagagtttcaccactcttcaaaagagcacaaatttattaatttctagattgtctacatcataatgtatgaagaaatttttgactcctatttccccgattctttctgttatgaaggtacaacttgtagcctacagaagattttccgagcaaaatttttgtccttcccaggtgtgaagatcagttgcttactcctggcttgcgtgggagctagcgatctagatgtatgtttatacgtttattcaacaagcctgtattgaattctaagtactgcactaggcattgaagttataaaggtaaatacagatatgttccccactttggcaatctcagtcttttgggaaaacatacaaagaaatcatcacaatacagagtggccaatgctatattggaggtctggccaggtacagcatgagaatacagaggagaatatttctcaggaattcagaaagatgacatttgaattgtgccaaacagaaaagggagggggagggtatttcaggcaaaaaaataacagaaacttttctaattccagtttgtatggtttctgcaacatgatcttgccttttcttcacctgttgtgcaaccaaagttataggacataaaagtgtattgagaacatgccttttattttttatttttttgagacagagtcttgctctgtcgccaggctggagtgcagtggtgtgatctcggctcactgcaacctccgactcctggattcaagcgattctcgtgcctcagcctcctgagtagctcggattacaggcatgcaccaccatgcctggctaatttttgtatttttagtgaagatagggtttctccatgttgcccaggctggtctcgagctccagctcaagtgattcacccccctcccaaagtgctgagattatagacgtgagccatctggctggttgaggccatggcttatagtatattttgtctgcagtacacagtatacctcaggaacatgtgacaatgatagtgaaatgataggttgtagccaagttgtgaaggaactctatgctgaagtctgcattttacctcgtaagcagaagggagccactgaagatatttaagcagaaaattggtgttagtgctcagttctcaagtaaagtaaagaatgaatcgaagtgttgtggtaatggaggcatttgccatgctcaacgaagctaatgagagccatagcagaaagaattagagagaatcatattctgaatatgtttctgagttagaattgacaaacatggtgaatatttggaagagcaaaggagatgttaaagatagcaggtttctatccagagcaactagttgtatgtttgtcctgccattagctttgcagacaactctggtaaatgtagtctctccccctatcacacctcccaccccacaacaataacaaccaataaaaagataaaaaaagaaagtaatccaaagctgtcacatgacacagaggtcactcacagtgccttaatatgaaagaggttaaggattttctccgtaggtcttgataattttgaaaatctcaagcaaagaaacaatattaagacatttcatcttaaaaaagctaactggttgattattactattttcatgggtaggatttttttcagtgcttaattgtattttagaaaggaaaataaaagactaaaaaggttttttttaaatagtcattaatcagttaacatgatactttacttggcactacacattaattataatttagatctttttatttttacttccatttcatatttgcaggccaatataggattcatttatataacgctgaaggaagcctgaatgctggttgcaacttaattttttggaaaaatacatattgtttaaagaatgaagtcacctgatcactgttatctgttaggatgacctttctctcctccccactactccatttgtggaatgtatattttaaagctacctataatattgaaatcccctaaatcatattctacccatgataaattaagaaacttatttctagttaagaacctactagtgtgataatgctcctttggacagtttacttagagtgtattctaattgagttttccttgttaagtagccaacagacattcacctttatatgctaggctcataatgctttcatattcatatgaatcttttgagttgactaacctacaaaagccaaaagaaaggaaagagataatacgatattttcaacttaacccaaatttttatattcttaagtttatattttggccagtggaataattttatattaatttcaatgtttgtatcatatatgttatcttagtatataaggcagtatgacgactgtgttggtagtatatgctgacagtgtttatggtttgaagtaccagtatatgttggagaaaatactgttatatactactaaaataaaaaaagacttgtgaaggaaaatgttaatgttgtaataaacatattattttaattagttctttgctaacttagctttgagtcttgcttttcttacatttattttagctagcatttgctaaatttcgctgtgattgtcagtgttcagcccagtgccagcaggtgagagttttgattcttgactgtagaatttacctaagtgtaactagtcttcttcttctacttagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagtaagtgaatttttgtattttaattgtatttctagcagcaactattctggtgtttactggttatgtggaggacctcatttgctttttagccagaattagacttctaaagtaagttttttctttgccatgaactttatatcagcttgattaatagaaaagctgtaacaaagcaattttagagactactgctttctttttgcagtagcggaagttaaaatgttgttttccatttgcttagaacatctgggtgtggacatcagaatctcctggtaagtaaaaaaataaagaaaacactaatgatactgatgcctggccctagtcccagagattctaatttagttctctgatagggcctctgacatcagcatttttttgaagcttttcagttggttttaatatgcggtcaggcttgataaccaccactgtggcctagtgtgaactctgatctctaagaatgataatttacaaaaatgacttttgaacctctctctctggtggaaagtttaagggtgaaatgactcatataaccctggtttctaagccaaataatatgtgtgctttagatacttgtcagtgctttattagttaagaaagtctagtaggaattccctaaaataatactgtttaccttataaaatctgagcaagaatatcctaacatctcaactttccaaaagtcacttctgtgatatcctcagttgctaccaacccacttgggagtaagtataaaaaggttttgtgaattaaaatgcataggttattagtgctattcaaaatctcttttagttatagtcttagcctatttctataattttcttatccaaagcagattgaaggtcagtaaattagaaggaaaaatggcagctatgaaggcaaataatcttgcataagtcactagattttacttctctcttactcaaggacgttactgtagcagttctccctcatttggacattatgatttattgcttttgtctatattgctcccactacacaaaaacatgttatatttttcacactgtgtaaaaacttcatcccacttcactgccagctactgcatttctttgttcctctttttgggaaaattcttcacttaagttataggtacttatatgtttatctctttccttttcttccattctctcaaatttataccataaccttcaataaagtttaagctgtgtattcaatcccatcattccactaaaatcactcatcaacatcatctttgacctttaccctaactcctggcaaaattgaccattctcacttttttttttcttttttaagatagagtcttgtacccagacttgagtgcagtggtgcaaacccagctgactgcaacctccacctcctgggttcgagcagctctcctgcctcagcctcctgagtagctgggaatacaggtgtgtgtcaccacgcccggctaattttttgtattttagtagagacagggtttcatcatgttgcgcaggctggtttcaaactcctgagctcaggcaatccacctgcctcaggttccccaagtgctaggattacaggcgtgagccaccatgcccggccattctcacttaaaaaaaaaaaaaaaaaaaattaacactgcactgctggcttgaatactctttccttggagcattttcttcaggtataacttgttctgcttgatttttctccagccctactggattccccacttgcagttttctttgctggttcctcctttccttcccagcttccccgtatcagatgacccaggtctcaatcctagcccccgttctctgcttacatcctcttctctgcttacatcctttcgcttgatgatcttatctagttccatagctttcagaagctgtctctttgctggtgactttcaaatacatatttccaacccgttccaaatccagattgcttatttgaaatctctgcttaagtgtctcaaccttttgaacttaccccagcccattctatctttagcctcctgtagcctgggggatggcagctttttctaattagaatccttctaattgctcagttcaaaaactttggagtcatctttgactcttgtttctctcacatccaggtcatcaatgattcctgtttggctctgccttcaaaatatatccagaacccagtcacttaactgaactgctgtgacttcattctgatcctctatcatttatgtgacttactgcattcgccacctaactggtctttgtgtttctgtctgtgtccgcctacaaccagttctcaaaaaactggccagagtaatccttttaaaatacaagtcatttcacccctctgctcaaaaccctgcaatggctcctcatttaactcagagtacaaccaatattccttacatgacctggcctattgtttcctctgattgtttcctgtcttactactcttttccttaactcattccactccaggcatactgacctgcttgctcattctcaaaaatgccaggcatgctttatcccattacttgccaggactttagctccagttttcttagccagaagtcttgctggctgatgtttttctccttctctccctccctcccgtttttccttccagtccttccttaaatcttacctctaaataaagcctacttgattatcctatttaagagtgtggcctgtgcccatgtttctgaccccccttactgctctactttcctttgcttgctcaagggagtctcctactttatcttcctgagtagctgggattacaggcacccaggttcctttagttttaataacccttactaccttttaacttacctaatttatttaagtgatgattaaagatttggccaatgaatgtatagttctctctagcattcttctgttaaaagtatttagtagcgaataacattttagtaatatctgttatttagtactaccgaattataattataagggaagttgcaatatatttttgaaagaatgtcatttagaatgataaaatagtgatacttaaaaggatatagacttaatttatctgtgatatgcagttaagtggaatgttgcagtgtatccggtaagagtgtctaacttttgaagttcaattattcttttgttttgttttgttttgttttttttgagatggagtcttgctttgtcacccaggctggagagcagtggctcaatctcggctcactgcaacctctgcctcctgggttcaagcgattatcccacctcagctccttgagtagttggaactatacgtgcatgccacctcgcccagctaatttttgtatttttagtagagacaggtttcaccacttcggccaggctggtcttgaactcctgacctcaagtaatccaccccccttggcctcccagagtgctgggattacaggcattagtcaccacatctggcctcaggtgttcttttttgttctttactgttgctcatttacaattctttacaaccatttatagctcatccacttaatagattagtaggtagaaagaatttattcttaggaaatacaaacttttcttaatttttaaatcttctgccatgaagaatattttttgtcattttctctatatctactacctaggattaacagttgctgcctttaaatctttagggtttaaaattgtccttaatctcaaaattgactcagtgtgttctggttagggaggcattactggctagaggaaaaagcacttagagatcggagcctgataacaatactggcctcacttagtttacagagttgtgagcataaaataagaccatcgtgtcaggagatcgagaccatcctggctaacatggtgaaacccagtctctactaaaaatacaaaagatcagccaggcgtggtggcaggcgtctgtagtcccagctagttgggaggctgaggcaggagaatggcgtgaacctgggaggcggagcttgcagtgagccgagattgtggcagtgcactccagcctgggagacagagcgagactctgtctccaaaaaaaaaaaaaaaaaaagagaccatcgtgaaagcttcttgaaaagattcaacattactgtagatacacagtgttagcaactcttaaactacctatatatcatacagttaaattttgactatttagaatttagttcaattggatttttatatgaaaataaagactattcaggagtaaatgagagaaaaatagtttaaagctaatttattataactgcaggctggcatttcttcaaaagaatttattatttttaaaacttagtatcttgaagtagaggatgcattaatgcgctttatagttttaaaatattatgaacaaaattattaatattttgttcctcaggaaaataattaaattttgggttgaaatctttcacacactcactttatcgtaaaatattttaaattatgaatcaattcattttttaatttaaaaattaagagtgctttcgatgtggggaattattcttaaaaactggaagggtttatgccgtgagatcctatgaaattgcaacctgctgtgatgaattcgtcgtgtatcatgtatcgtgtatcttaactcatataaattactttaacttgctatccttcccttgcaggaagacacgtttcagcagtatgtaagaccagagattaacacacagctgtctgatttctgcatcagtctaactggaattactcaggttataattctaagttcttctttctagagtttgaaagagttcttgaaattagggatttattttatacataatttaaaaaaattattactgttgtgaacaatttaataccttgcttggtaaagatctttcatgttgtaataattaaaaaaaaaaaaacagcaaattttatatctggtaacattttcctcagcctttcctcttaaggagttgtagtggtgaatcgaaagatttcgtctgtaaaatgcatcagcaaattgtttccatactgaacttggagatgtttgatttatttatttttttgagacagtctcactctgtcacccaggcttgagtacagtggcgtgacctcggctcactgcagcctctgcctcctgggctcaagcgattctcctgcctcaacctcctgagtaactgggactacaggcgcgttgccaccacacccggctaatttttttatttttagtagagacctggtttcgccatattggccaggctggtctcgaacacctaacctcaagtgtcccgcctcggcctgccaaagtgctgggattacagacgtgagccaccatgcccagccagagataagttttagaatgtatctgtttacaacctgactttatattttgcatttattttttatttttatttttttgagatggagtctcactctgttgcccaggctggagtgcagtggcacgatcttggctcactgcaacctctgcctcccaggttcaagcgattctcctgcctcagcctcccaagtagctgagactataggcacacaccacgatgattggctaattttttttttatttttagtagagacgggtttcactgtgttggccaaggtggtcttgaagaactcctgacgtcaagccctcctcggtcccaaaaagtgttgggattacgggcatgagccaccacacctagcctgtttcatgaatttttaggtctctgattttttattgtattctaatgtggtaggcacttttttcatttagttagttcattcattcactccacgtgtatttgagtgcctactataatatatgccagcatttgtatatatctttatgtgtatatagacgtatgtctgtgcagtggtcacagtaggcctaataagtcagtgttttattgcggtgttgtggacatctatgaaaagggcttccatatatgacagagggaatagaagactgtcctggggaaaaacatcctcaagttgatgaacttgggctgagtcatgaaagataggtaggcagaaaagaatggctgggcatttcaggtgggaactggcagacctacaggtagttcaggatggttcagatgtgtatggactgttaagaaaatggtccagataggcagaggcaatccagatcctgaagggtcttgtgcatctatttgtcctgaaagccttggagagtggttggaggatttaagtatgagagtgatagggcggacccgatttacgttttaggaagatcagtctggcagcagtatgtagtatgcgtggaaaattgtgagacctgagatgggaagacacttagggagctgtggctttcagcttagaagagatttctcttttccctcctctagaaatccagtaagccgctaggttcaggcctataaaaagagaaccactggggatgatcttaaatcttaattttgggaggattatacttttcagttgaaagtagtcccagtacttggttatgaaatttttagaatttcttaaaaatgaaactttaggtggagctaagccaaggaaaccatgaatttaaagtatcagcctttctcatactgtttcttcccctccaacttaggtctgggtattttgtaggtctacgtgaagctgcagccctgatttttgtatattttacttttatatcctcaggatcaggtagacagagctgataccttccctcaggtactaaaaaaagtaattgactggatgaaattgaaggaattaggaacaaagtataaatactcacttttaacagatgggtaagtatttaggaagattatttttttatatctactttttaaagattaaagatacccttatttatctgatttttagaataaccacaaactattattagagaccctagagtctcaccccacagggaatagtatttttcctttcacctaaggatgaaagagaggaagaaaacagtggtcacagtccaatacaggactagaacactacagaaagttaaaaatatgtaaagctaaaaagactttgctaaaactctgttttttcatgacacttccttactcaaaaaagttcagactcttgagcttggccttgaagcctctttcctctcatcccacgctacctgtttaatctaattcacctgccattaatcctctttagtcagactggcccaggaattcacatggtttaccctttctctgtgtagttacttatgcctccctctgtactgagagtgtcttctcgacaactttatcatttttcaaagcccatcttgtgttttaccctgacaacgccattgatcttttttttccttgaaaccttataatttctatggtatataccattcatgttgacatctgaccatatattctgatatataatctttgtgtacatacataagacttacttttgcaaggaaatctaaaattctttcagagaaggacttttgctgcctaataatcttccataatgcttaccttagtgctgagcttaaagtgtatgcccaaaaagcatttgttaaatgaaaagctaaatgggaagatcagaaagattaaaacatagatgacagacgttgtgccagggcaactccgataccttaaggccattaaggttgaaaagaacgtcctaaacaacttctgtttcaaactgtgcaggttatcctctatacctgagatgtcaccaacatagagggtttggagatcctcacatgtgataggagaaaagcattgaatttaatcacatcataactgttaagtttggaaaaatgtttatggacctctttagaaatccattactgattttaaacatgaatgagcagtgctctgctaaagtatacaggtgtttctgctgtagtatagtatacgcagttctggtaaagtctcattttgtgggacagatcactcaaaacctatgcaattttgtaacaagagcactaacaaaaaccaatcattagagtctccattaataatttggcagcccaggcaagcagctcagggaaggtgaggttgcgtcaaagtatatgaaaattgtacagaagcactagtgtcctggggacatacacttatttttaattttcttataatatagttgacagtattataagaaaatacaaaggattatatcctgttcccagtatagcagctgagttgagggcttttcttatttcctgctgaagtttataatttccactgctattattctgactctccttgcctaagaaaaaccacgtaggaaccaacacaatttccatattacacaatcagtattgtccttaactacaataaattggttagtgttatagaaaaatgttgtagcagaacagattgtattttaaccatttgataccagctgcttttgtttctttcatttttttgtttttggttttatttcaaagcatgctgtcaacttaccatgctaagtctggcagtaaaagtaagcttagcataatactcagcaagatagaagcctgcccagaaccatgaaaacaatcaagatgagcctaataggaattagtttgtgaacaaaagttaatatatccgacttctttgtttggtttttaaagcttaattttgaattagtattttgtaggaagcaaggttaattttctcagcttgatgttacatttgaatatgagaaagttgacatatataaataaatgatttaaaatactcatttgtaagaatagcatagcgtttatttcatcaattttttgtccttttttaatttatagttcttgggatatgagtaagttcttgaacattcagtgtcaactcagcaggctcaaataccctccttttgcgaaaaagtggatcaatattcggaagtcatatggaaatttttacaaggtaaaatttctatatttaataattacgtggttcttaatgataaatttgttaaaatttgcatgtacgttagattgtaattttccaggtgtttttcatggaaaaaagccatataattagttcttactcttcagattccaaattccttatgttcaaattagataagcctttttctcattcaacctgttaactttatttaagtaggttaactatatatacctgacaagtttgaaactgtaggggcagtcagtatgtggattgttcatggagcaaatgctccccactagattttaattttacttcacatttatcaaagttaatatgcgtgtgccgtgtaaatgtttaaaatattattgcaagacttacaatgaatggcagtcttctgccatagccttcaccagaactggttcctgttctgaggcaaacactttcaacttatgtaaagctctgtttttgtttttgtttttgttttttttcaaatatttacctttgtatttctaagtttcatgcttatactacttcttgacttttcagtttgcgatctattgaattcctgccctgaaagatcaagattgagttcaattaagttaccactcctgcttgtccttcccttcctgcatcttcctactatagctctattacctttcagtcagagcactcagtgttcatactcccgtgactatggagagtgtccacaactttcccctggatgtaataatttacttccgcggttgtttacttatccccttactctccattcaaactgtaagtcacttcttatgactgagaacactcaggtagtctgtcaggttttcttttttcatctgtttttcccttgcagactatcttcctggagcctttaatcctgttctaatctgaactgttagttcttcaggcttcttttaaaatcatcttaggggatttcctttaattctcatgcattagatactatgtcatttttctccctttacagtttcattttggagaagcatgttctaaagtagtttcatgagaaaaggtgcttttccttacagactcttctgttttaacagtcttttaaaactgagaagtatgcatgcagaaaagtagagttttgccgattgctataaagcaaatacccttgtaacttccacccacttaactcccttccttcctcctggagttaaccctaattcttcctttcatggtaatcattttcttattattccttatagctttagtatttaaatgtatatccttatattatatagttttgtctggctttgagcacgatataattagtattatactggctatattatttgttttttttgtttttttttttttttcaatattatgcttgagatccatccacgtcttgtatgtcactgcagttcattcactttattgctattaattccattgtgtgactataccagatttgtttatctgttctactttggctggccatttggattgtttttatttggggcttccatgaagagtacttttataagcattgttgtgcatgtcccctggtgtctgtgcactcgtttttctaagaaaaacctaagagtgcagttgctgggtcatgggatatgtacatcattgacattactagataatacaaaaatagttttccaatggaattgtaccagtttgcactcttatcagtgctatgtgagtttatagttactgtaagtttttgctagcatctgatattgtcatacattttaaatgttttgtaaatctgacgggtgtgtgataccatctcattgaggtatcagctatctggattgcttttttgcgaaccccttatttaaatttctgactgttttaaaaaaaattgggtagtctgttttttcattacctgtgtattttactggtctatagatttttactttgggtgctagtcctttgattatatttgataatctttttgtgtgaatttattttgttttttggtttatttgtctttgagatgaagtctcattctgttgcccaggttggagtgcggtagtgcgatcttggctcactgcaaccctgtctcttgggttcaagcagttctcctgtctcagcatcccgagtagctgggactacgggcgcccacaaccacaactggctaatttttgtattttcagtagagacggggtttcgccatgttggtgaggctggtctcgaactcctggactcaaatgatctgcccgcctcggcctcccaaagtgctgggattataggcgtgagccactgcacctggccttttgtggatctttttttgtgtttttgaactcattttgtgaatttttttaaaaattgtgttatggaaaatttcaaacataacagaaataggtatgagtcctcatgacccaggttcaacaattagaaactcatggccagtcatgtttcatgtgtatccccacccactttcctcttccttattattttgaggcagaagtcagacattatgttatctgatctgtaaaaatttcattacgtagctccaaaagctaagggtcattttcttagaaacacagctaccataccattgtgacatcttaaaaaattagcagtaattccttcatcaaatagtcataaatattttcttttaccttttgtgtgttgagtcagatcaggataaggttcacagatttgtagttggttaatatgtctcttaagttttttagtctttgatatgtttggtatgttaatacatctctttagttttttttaatctcttctttttcttccctagcagtttattttactttattcttttaagaaactgagtcatttgtcctgttgtgtttccccttatctggattttgtaatcatatcctggaatgtggtttcagaggtgtctctgtcttttgtatttcatgtcagtttatactccagttgagaagctcgatcccctttaggttctttttttgctacaactcccagatggaataatttttattattaaaaattaataaaccttaaaataattttcagtcagttatgcataaatctacagctcacagtatattagtgtaatcggaaagttgtagatattataaggcaataaaatgctccctccttttttgagtaaacagtggtttctctttgtgcacctgtttattttggccagtttgttagcctgctctttttgtgtgtggttttcccctcttcgtaatagataactataatgcaattagttgtataagtagaagaaacttatgttttccttctttttttgtaccttatctaagacctaaataaaactctctgtcacaagtttctgctgtatataatgctaataaggtatattatatggtatgtctaaaaacattttttttttaagtaaaaatgactttttttttttttttttttttttgaggcggagtctcactctgtctcccaagctggagtgcagtggcatgatctcagctcactgcagcctctgcctcccgggttcaagcagttctcctgcctcagcctcccgagtagctgggattacaggcatgtgccaccacgtctggctgatttttttgtattttttagtagagacggggtttcaccatattagccaggctggtcttgaagtcccaaccttgtgatccgcacaccttggccgtccaaagtgctggaattataggcatgagccattgcgcctggccaaaaatgaccttctatccagtctttcttgggggcaaagggtggaaatgggtaattaaacttggagcttaatttaaaaggcaaataactgtaatacatttctgtgaaataattcgcttaggatgggacttggtttttctaaaagtaggctgaaacaatataaataaaaatacagtttaagacagatttttgtataagattttgggggaaatcccaaactttctttgtgcgtggcatatcaagcgcaaatgtggagttagcatttacaaaattatacagctgtttctttttgcttttctcttcttttttctcttttcttttcttttcttttcttttctttcaagacggaatctcactctgtcatccagcctggagtgcagtggtggggtctcagttcactgcaacctgcgcctcctgggttcaatcaattctcctgcctcagcgtctcaagtagctgagattacaggtgcctcccaccatgcctggactaattttattgtatttttagtagagactggctttcactatgttggccaggctggttttgaactcctgacctcaaatgatctgccccccctcggcctcctaaagtgctaggattacaggcatgagccaccaggcccagcctctttatgtttttataggcctatgtatatgcattacaatgctgttgttgaagtaaaaggaaaggatgaaatacacctcttgactgtaaaatgtgttttctttttttttgtcctccctttacaaatactcaattttagattgaatttaagataagctcacatggattctttttctcaggaaattagacaatttctgcctttgctcttcatgcatgttaaaaaaaaaagcttgcttacacatgtagaaagttgaaagtgcagtgaagtgttactgctttcaaatgaatgacaggatactttgcagaaatccacaacttttctgggggtagagcgttaagtctgtctctggtgtacagtcagattgtacctataaagctcttttcttgaagtcagattctcaggctgagcagagattcagagaaaggatcccttacctaatcatatgctggtgttgaaagggaggaaaaatatttaattatctcctacagtttttccatgtggcactcagacttgagactttccaatagctttcctcacttgatatcaagcccaagcaaaaggtggacattttaaggttttctgttgtaacatgattatttccaaagacatactccgttacctttgaaatgcaagaatcttgtcacttgaagtcaaacattttctccagcttcttatagggacttgttcagctgattcatgtgatgaaaaatgtctgtaaggaggctgcgttttgcagcgcttcttccaactgctcagcaaaatctggcctttttgttttcctcttgttcacctttcaactcagccacttgattgagaacttttccttgctaagccagaggaagcaagaggttggtttgttctttgtctagatttcacatcatttttaaaaacacgatgaagtgactgggcctttgtttaataaagttaataactcttttttgggcactctctaggacttttcattttaatcttttttttttgtgtgtgtgtgtgtgtgtgtgtggttaaaatgtacataatacaggttgagtatccctaattggaaatgattgggaccagaagaaatgtttgagatttggggtttttttcagattttggaatatttgcatatacataatgagataccttagagataggacccaactctaaatatgaaattcatttttgtttcatatatacctcatacacagagcctgaagttaagtttcatacagttttgtggatgaaacagtgtatgtacattgagccattagaaagcagaactgtcactgtctcagccactgatatggacagtctggttgtttggcatcatctttcctgatgctaccaataagcaatagctttcttagttacacataaattaagcatgtgtcatgtacctgtgttttgactgcgaaccatcacatgaggtgtgtaatcttccacttgtgacgttatgttggccctcaaaaagtttcggattttagagcatttcagattttgggtttttgggattaggaatgcccaccctgtataacacttgttgttcacttaaaaatgctctcaatcatttttaagtgcacaacagttcagtggcattaagtacattcacattattgcacaaccatcaccacatcattctccagaactctcatattccaaaagtgaaactctgtgcctgttgaacttccccttcctgccaaaccctggcaatcatcattcttctgtctctatcagtttgacttatctatatacctcttataagtggaggcgtacagtatttgatcttttgtgactggcatatttcactgagcataatgtctttaaagttcatccatgttgtatcatgtgtcagaattctacctttctgaggcagaataagaattcattgtatgtatttacgggctgagtatacctaatccaaaaattcaatatctgaaatgctccaaaaatctgaaactttctgggcactgacattgtactcaaaagaaattctcattggagcatttcaggttttggaattttggattttcggatgagtgatgcaaaagtggtgtaatgtaaatgttgaatatttcaaaatccaaaaaatttcaaatccaaagcacttctgtcccaagcatttcagataaggaatatttaacctgtaccacgttaaaaaaaaaaaaatccattgattgtttgatggacatttaagttacttccatgttttggcaatcatgaatagtgctgttatgaacatggatgtacagataccattcttcttcctgtataaccagaataggagttggtggagcatgtgctaattctatgtttaatttttttgaggaatctccacattgtttcccacagtggctgtaccattttacattcctgccagcaatgcacaaagtactacattctccacatctctgtcaatgcttgttattttctggtgtgtgtgtgtatgtgtgtgtgtgtgtgtgtgtgtgtgtgtttatggccattctaatgggtgtgaagtggtatctcattgtggttttgatttgtatttccctaatgattagtgatgttgagcatcttttcatgtgatttttagccattggcatatcatgtttggagaaatgtctattcagattctttcctcatttactaaatgaggtatcatgatgttttgagttgtaggagttctttattctggatattaattcattatcagatatatacttgcaaatgtatcttctgttccatgggttgccatttcactctactgataacgtctttagtaataaggtttttaatgttgatgaagtctactttattttttcttttgttgcctgtgttttggtgacatccaagaaatcattgtccaatccattgtcataaagccttttccatatgttttattctaagaattttataattgaatgtcttacatttaggtctttgatcaattttaagttaattttgttatatggtgtaaggtaagggtccaacttcattcttttgcacgtggatattcagttttcccaacaccgtttgttgaaaaggctgttgttttttccccattgattcaatgtatttgtgaaagtttatttctagactctcttcggttttattagtttgtatgtctatactaataccactctctttcaattactgcactccttccttctgttaatgcttgtgttaacattattttttaaatgttgagccatccttgcatttcaggataaaatcctacttggtcatggcacataattgttttaatatgctgctgatttaaatttgcttatattttgtcaaggattattgcaacatgataattgtaggggatattgatctgtaattttctttcctcatgaggtctttgtcaggcttttgtatcaaagtgatgctgaccttaatggaatgagttgggaagtatttcttcttcaatttttttgtagtagtttgaggagacttggttctaattctttaaatatttgcttgaattcagcagcaaagctatctggttcagcgcttttctttgttagaggttttcagttactgattcagtctccttcctaggtataggtctattccgattttctgtttctttgtaattcaattattgttaagttgtgtatttccaggaatttgtctcttctacctaagttatccagtgtgttgggcaaactatttttagaagtgcgttttccaagtgataattagtggaaggtacagggtatattgcagtattacagcttaagataattataggtgttttacatcatttgctttgtgattatcccagtaaccctatgagtaaatattagagctgttagtcccattttacggatgaagaagctgaggtccaagatgcataggcaaaatagttgtacaaactacagaatgtaaaacttaacaaatcttgatagaaatatgaagaaaatataacaattttttttttctttttttgagatggaacctcactctgacgcccaggctggagtgcagtggagtgatcttggctcactgtaacctctgcctcccgggttcaagggattcttctgcctcagcctcccgagtagctgggattacaggcgcacgccaccatagccagataatttttatatttttagtagagatggggtttcaccatgttggccaggctggtcttgaactcctgacctcaggtgatccacctgccttggcctcccaaagtgctgggattacaggcgtgagctaccacacccagccaataattcttaaaagtggaggcacatattggaatttggggagtgtgagagttttttttttttttttttttttttaacttatcaaggaacaggtttttaaataacctgaaaaataccacaccacatcgtctttcattcttaatcttcattatctttagccatccaaaaaggctagtctttttatctaagaaatcagtcaagtaaagtaatacactatagaaaaataccatgtaaaataactaacttggtttaaaaataaaaaggtagatcttcaacttacatgtcctgaacaatacattccctttaataaattatttttaaattaaaaaactgcagagtttttagatgtctgaggatcctgtctgtattttcagctgaaactcttaagatcatattttaaagctctgaaaatttcagggtttttttgatggagtctcgctctgttgttcaggctggagtgcattggcatgatctcagctcgctgcagcctccacctcccaggttcaggcagttctcctgcctcagcctcccaggtagctggcattacagatgtgcaccaccacgcctggctaatttttttgtattttaagaagagatggggtgtcaccatgttcgccaggctggtctcatactcctgacctcaagtgatctgcccaccttggcctcccaaagtgctgagattacaggcgtgagccaccttgcctggcctgaattttttatttgccttatttgagtgggggtattgccctttgcctagctttatttagctgttagtgctaattttcagtttcttatttttcatcttaactgtggcttatattacagtttagaacaccaaagaattatttactaagctgtttatttttcaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcactagatgaaaccatatcttaaaatgcagaaatgattggaaggtagatcttatctagcctttggatttcaagaatatcatagtccttttgattttcaaagtttatatgtgaagttcaccatgtatgtggtgaatttcgtaaggtacttggtatacatatctgcctatgtttcttttcaactcataattggaagaattatgatggattatagggtttggttaaaaatccagttactgaaggaattaatgaaaacgtagaagaaagtactaaaaggaatatcataagggctgtagctcaaacttcataatacataaatcactggggtctttttggatttggttgtttgattcgccttccttttttgacatatgtatgccttaattcttaaatctgagggaccatgctttgaaatagactgaaaattaagggtcaccacctaattttactttgtattcagtatcgtaagtgaggttaataaagtcaatactttctaccatatattacgtttttgttattaaaaaacttcattggccactagtgaagttagtcaataaaagacttgtttttctgattttacatagtaaatggctgctaagtattgagtaattcttaactaattctaaaaactaaaatgtgcatttcgacttgataaggtaaaactcttatctagaggctaaacccatgtattttcagaattgaatttttctccttgtagctttcagggaacaatttcattgacattgcttgcttcctgccttttaccttttaataaaaattgtgatgctactttattctaaagatttatattttataaccagatgaatttcctcaaaggtttccaaacctatatcatatagggtgaaaagcaggaaagtagacatttttcttggcgtgggaattctctacatagggcagtagatttcttaagccaatgaatttctgcttttcagcagtagtcatataatcagtatcataaagaataatgtgtaaataacagaaggcatatgagagtgtggtgttcctagatgaactgttacagattatagtaaaataaggaaatctaagtgctttaagtttatacagttaactcttaggataagagggatgtatgctgagatgtttgtgcatcccagatagcactgtacaataacctgtaaagtattactgaatactgaatagctgaaactgcaattggaaaatctgatgatgacgaggaaatattacgtttccagtttttttagctctatctgctaatttctttgcctgttttcactttcgccaagtaccaacaagctcatgttgtatttctttttaagaacttcaacattataagctctcagtaccctattttgttgttgttgttgtttgagacagagtttttgctcgtctgccaggatggagtgcagtggtgcgatcttggctcactgcaacctccgcctcctgggctcaggtgatcctcttgcctcagcctcctgagtagctcagattacaggcgcgtgccaccacacccgcctaatttttgtatttttggtagaggcggggtttcaccatgttggtcaggctggtcttgaactcctgacctcaagtgatttgcccaccttgacctcctacagacgtgagccactgcgctcagccatagattttactgtcttaacccattttaattcctctgttgagtctctgtcctcccctccaatttgatttgggattttgctgatgagatgatactaaacattgagagtactgctttttactctgacttttattgtgttgtctttgaaagacaaatagtacaactttttacaaggaaacacgtaagagatggatgtccatgaaaacaatattagtatattctattattgtttcttattaatagttacttagtatttacaaacaatttattattagctgtgttaacttttattctatgcttcatatgctctgacattgacatagtggatttctgctgatttttttcaaatccgcaatctttataaccaactgaagtatataatagagcattacattttatctttatttgtgttctgttggatcaagtatttaacatttgctctgaaaaaaatgtttttgtgatgtgtctttgttgccttgagatagatccatttatcctgcctcctagggagaagtttctgcctggattgaaacaaaaaaacacaggcgtcacaagcatgttacctattaagagagagagggtatctctgaagactaattaaaatggtaatttttaaaaagatgtgaccagttgacttttagtatatcatcccaagtattatccccaaaatgataatgcaaaacagaataatttggagaccaggagaaaaactggtatgattactggggaggggaagaagcacaggtggtcaagataataatgcatgtttggcctcagctgtagttgccaaagaaactacctgcctcacagatgagcacgcacgggtgcattgtcaaagtctgagaaggatgtattgtactttgaaggaagactttccatttctaagctaccatggagaagtatatgctcctcgagaccagagactgtgacttctgcatctttgattccagcgacatatgataaaatgttttgcacatagttgaatccagcgttgatacatgaaggacagcattacatcttttttctattatacttagaaatttcctctttgttctgcaccaccaacctgtatatcaagcctccttgccccacaaagcttccaaagcccgtaaatttgttaatctagagcaggggtcagcaaactaccacccatgggccaaatctggctgctgcctatttttgtatggcctacaaactatggtttttatattcccttttgttaatggctcaaaataatattttgtataatacgaaaattacgaaattttagtttctctaaataaagttttggaaagaactaccattctcatttgttttcatgtcatctctgaccacttttgtgctacaatggcagagttgaatagctgcatcagtggcaccatctggccagcaaggccaaaaaatactactgtctggccctttatggagaaagtttgcctacccttacctcccttatgtaatgcaatatataagttccatcaacaaacaagaaatgcgactgtgatgagagcgtagagctgaatgttaaggtacaatgatacttgcatcagacatttatggagcactgttaagtactttactccattgtttagtaagaatctggtgatggagagaggcattctctgcagtttacagatgggaaagttgaggtccagagcggttaagttgccaaagtttaagtagtgggagctgtagattctggcagtatggcttgagccttgctctttatctctgtgctatgctgcctcccgttgtagactttggcttaacctgatattccaggaacaggtaggttgtcctaggtagaataaacatcttcctgtatggtttaaactagacattttcaatgcgattgtactaaatgttgcaaatcaggaggtaatttgatgttcattctttgaatgaaacaatataaaatactgttaacttctaatgtgaccagctgtaaggttttttcggagatggggataagtggagaaggagaacgatttttgctttaaaatttcctccatgttcttgagattagaaatgttagtgtcttgagtttataatgacacagaggctaaagggcttaagtttgactgatgaagagttggaagtacttgtttttctggattccttaccaagacttgggtaaggggcggatgcccgaggctttaaaccagatctgcttttctacttgcaagtgaatgttctcaaggtaaatttcattagatttgttttaggatgaatactgctcaatcattgtggagccacaaggcatgcttcattttattgcacttctctttatgtgcttcgcagatactattttgttttgttttgttttttaacatactgaaagtttgtgtgaatcctgtgtggagaaagtctatttatgtcattttcccaacagcatactttcacttcatgtctcatattttggtaattctccctatatttcaaactttttgattattattatctctcttagggtgatttgtaatcagtgacttttgatgttactatcatggtggttttggggcaccacagaccacacccatataagacaacgaacttaattgataaatgtctgtgttttccccatcgctccctctccagacctacctattccctgagacacaatattgaaattagggcaattaataagcctacagtggcctctaagtgttcaggtgaaaggaagagtcacatgtcttccactttaaatcaaaaactagaaatgattaatcttaaagaggaaggcatgtcaaaagctaagacgggctgaaagctatgccttttgatccaaattagcaaagttgtaaacccaaaggaaaagttgttgaaggaaattaaaagtgctgctccagtgagcacacaagtgataagaaagcaaaacagccttattactgatatggagaaagttttagtggtgtggataaaaaatcaaactgcaacatttccttaagccaaagcctaatctagagcaagactgtaactgtctcatattctgtgagggttgagggaggtaaggaagctgcagaagaaaaatttgaagccagcagagattggtccatgaaatttaaagaaagaagctgtctccataaaacagtgcaaggtaaagcagcaagtgctgatgtagaaattatagcaagttatctagctaagatctagctaagttatctagctaagatctagctaagataactaatgaaggtggccacaccatacaacaggttttcaatgtagatgaaatagcctattcgaagaagataacatctaggactttgatagctggagagaagtcagtgcttggcttcaaagcttcaaaggacaggctgattgttgttaagggctaatgtagctggtttaagttgaagtcagtgttcattaaccattctgaaaatcctagggcccttatgctaaatctactctgcctgtgctctataaagggaacggcaaagcctgaatgacagcacatctgtttactacatcatttactgaatatttgaagcctgctgttgagacttagtgctcaggaaaaaaaaaaatctgttcaaaatatgactgctcattgacaatgcatctggtcatccaggagttctgatggagttgtataaggagattaatgttggttttaatgcctacaaacacaatatccattccacagcccatggatcaagtagtagttctggctttcaagtcttactatttaataaatacatttcataaggctgtagttagcataggtagtgattcgtctgatggatctaggcaaagtcagttgaaaaccttctggaaaggattcaccattctattctgaatgccattacaagcatttgtgattcgtgagaggaggtaaagatatcaaccttaacaggaatttgcaagaagttgatttcagtcctcatggatgacttttaggggcccaagacttcagtggaagaagtcactgctgatgtggtggaaataccaagagaactagaagtgaagatgtgactgaattgctgcagcctcatgataaaacttgaggaattacttcttacagataagcaaagaaagtgatttcttgagatggaatctattcctggtgaagatgctgtaaacattcttgaaatgacagcaaaggatttagaatattacataagcttaattgataaaccagtggcgtggtttgagaggattgcctctaattttgaaagaaggtctgtggatagaatgctatcaaacagcatgataaagagaaatcttttgtgaaagcacaaatatcagttgatggagcaaacttcattgttgtctcattttgagaaactgccacagccactccaatcttcatcacctaccaccctgatcactcagtagccctcaacgtttgaggcaagatcctacaccagcaaaaagattatggcttgctgaacactcatgattgttacctttttctagaaatttaatctttaaggtatatatgtattttttagacataatgcttttgcacacttcatagactattgtttaaatttaacttttatatgcactggggagccaaaacatttgtgtgagttgcttcattgtgatactccctttattgcagtggtctggaactgaacctgcagtatctctgaggtatgcctgtatatagtatgatcaagagcaagtttagaatacaagtcattttttttttctattgagtaaaagaacaaaagaggagcaaggttgtgattttctgtttgctaatgtagtgtggcacaccatcactggtgatggcagattgatggagggcagcgattgagccttccccttgaagtgtccattcttgcttgccgactctgcacctttgaacatagacctgttttccctttggatttatttttgtcagtgggaccatgattatcacagtcacataggattgaaaccatgaaactcatagtccctccctcccccttttagcacaatgtcctttattgtccagtcactttatcctcaccccagcctctgttatcatcattgctacacagactattgctaaaatttaacagacttctctcttgctgtctcttcctgtataccactgtcataaaaaaccttcctaaaatgttgctttgcacactgatctcagaaaccttcacatttctgatgggataaaactcagctctctgttggcatataagaaccttcacagtctgatttctgtctgccaacttttacagtaaccatctgctctagggtaatagttactcccctcaccatcacactcgcgttgagtcgcatgtgcaccatcctacttctgtccccaggaagttagcccatcagtcttattctcttgattctgttttgttaaagacctgctgtgatttcagccttcttcccagacagcccggacctttggcaacaactccctctatttgttcattgcacttttgttacattcattgggcccttcatttgtgctgcagagattcatatgtactgtattgttgggttttttttttttctgtttccccaacaggagtgtaaattattcaggcacaggttcttacttgtatctcaagaacctaagacacaatgggtgcttagttaaaaataattagtgatggtaaaatgtatcttgtaaggttagtacctgttcctgaaattgcaaaaggtagcgtaagtcctgactgccgtgatgaatgagttactgttttggcagagttacagataggagctatcccctttccttttactgtgcaccataaataaatttttagaggctctgtctcgagtagaaatgtttaatccctgtctatgcttgactttccccctaggtgccaggaaaagcaaacaaatgttaagctgtccttcctagtagttcagtctgtacattgctgatttaaaaaaaaaaaaaaaaaatctgctccaagtatctttggccttgaaaaaggtcattggttgcctttcctctgtgttgagcactgatttttcaaacttttttgcacaagtactccctaatacttgaaaaaaattgtttgaaaaggaaactgtacctatttgcacatttaaagctattcctaagttcatagtataaatattgacatttaaaacaaaacaggcttcattatataatcagtggagtctccataccatagaaatttagtaccatcatctgcatagaaaatacataaaggcttttaaaattcctctttctcctggaacttctatttttggtgcagttctcccacaaggttttattctaatgtaatacagtagtcccctcttatccgtggttttgctttccatagtttcagttacccaaggtgcagtaacaagatattttgagagagggagacaccacattcacatccagttttcatgttatagcttgtcatcaggttttactctgtatttttctgcctgaaagtcattgatcatactatcatacatctttgtaacaagtgtatatacatttaaaattatatatggctgagtgcagtggcacatgcctgtaatcctaacactttgggaggctgaggtgggtggattgcttgagctcagttctggaccagcttgggcaacatggtgaaaccctgtttctacaaaaaattcaaaacttagctgggcgtggtggcacaagcctgtagtcccatctacttggggggctgacttgggaggattgcttgagcccagcaggtggaggctacattgcacggagatctatttattgtgaccgtaaggatgtgtgaagtttcttctatatttactcagtcatttgcataatggatcaagatgtaaatatattaaaatttttggaaatactttaatgagataatgtttttacaattagtttatatatctggattaatatgacattgctagaatgaaagggggtccagcatcaattctatagctttacctgaaaggcttttactcagttctttaatttccgtgacaaaaatcacattgtgatctgtgatgataaatcattcttcagctgacagcatgattagtttcttgtttatttttgttgaaaacagaatttttgaaaggtgcctaacttttagaagtgtttacttagaatttactcgttcttatatttggggatgtaaacccaaagggctttaccaagactatcaaataattattcattatacctgttactctttaacctagaaaacctttatttcagtatattcataaagggttgggaaaatccaacctgttactttcaaaacaccttttaggatataatactcttggcacagttagtgctttaaatatatttttattatatgtttcgtcaaaaccttggagctacagatttagtcattcatttcatgatacatgttcatcatataatgaaatcaagcaaaatatccatgtcatgaatcaaatcagactgactttgtcagaaaaaggtctggcttgaaaattcaggttgtgttactgaattttgaacatacaaaaatcattaaaaaccatcacagaacaccttttgtaaatgattagtgaaaacagtcaagatttaaaatttcccttatttaacttataacaagtcgcagtcatctgtggcaaaaacaagttatttaggaagcaagttaggttgatgaaaggcaagatattctttcaatataggtgtgtacgtatattgaactaaggtatttggcttttggcagaattaagaatcaaataaaattctttagtgttaataatattaacttttactaggattacgcttttcctatagaatgttatcctgctaaaaactaactggcagatatctagaacctaatttattttctgttaagaggtagtaaatatttcccatttcataagatgaagtagattcatatttgactgtatttggagtaaatatttcacaaaatgattgtggtcagtttttttcattttttgtgagcagttttgtctataggttttattcagtgcctcatgaaaattctgatagtcctgaaaattattccaagtacaattaaaatattcagcatcactaaactctttttgttttgactgtccaagggtatttttccttccagtcaatgattgttctgtggatgagtttttaaatagttgaaaaagtaacttagaagaacagctgtttgtagcagtcagtatttctcaccgatgcttgctgctttttgctgttggggcctccaccaagagtgatttatttcttgacaggagtcttggagagggaagtggccaatttgttcaataaaaatcattactttcactttaccacatattcacattttgaatatcctaacaagtccccaaacatccccatttctaaatccccttttacggaagtttagaacggggaaagtcacaaagccctaaggccttaagctgacttgagactttccgggtggtaggaggcttctgctttgttctctgtgttcgctaacgccttggggcagcagtgccaagtgagctgggaaggtgagtggtgtctttgttttgtagaacggaagaaatagtgtggatgccacggttttgcttttgttagagggctgtatgaaagctcagaattaccttaaattccaaattaattaggtcatcctgtaaaattacccttgctgaggcaccccttagaaggtttcaaggtggccctagggttagacatatcccacatgaagacctctggtccagtgttgaaaatttctgttatttttgtatgttaataaaatgttttcatcagtaatatagtgtgtgtgtggggggggggtgtgtgttagttcacatttgataaggttcttgtttaggacttccttagcgctgacaaaacgaacttagacttttgtaaggagagtggagcacaaacctgcccctgcctcattgtcaagaagcctctccatcagcccgccagcaccaagccttttgagttcctttagataaagtcagtaacacctgggttagcattattcccacctcggtctagtgcttactcagtcctgggccatgctgaaattgcatgcatacaaggtatagcgtaatgagaccgttttcagtgcagacagctgagcccccaggcacttgctccgctgagtgtttcagcgattacgctgcacttctgctcgcctgcctaaaacgcatgaagagtacagtgggggaacaatgagcatgacttttgttcattctgtgtgtctggtgagaaaaatgtgggaattccaagcaacaacgtattagggatgattctggaaattcaggagaaacaagtaaaatacaaagaaaccttaagtcgtaaaatttatgttaaatcctacattccttactacaggcaacttccttgtattctcccaagagagaatacaaggaaggtaggagagtaggagggggagcttttaaaaatcaggtgtgttgaggcatacacgctcttctcatcggcacatggaacattctccagggttgaccataggttaggacacaaaacaagtctcaagagcttttaaaaaatcgaaattgtatcaaacatcttatctgactacaacggaattaaactaggcatcagtaacaaggaacattcaaaactaaacaaacacgtgcaaattaaacaacatgctcctgaatgatcaatgggtgaaagaagaaattaagaatgagatttaaaacttccttgaaacaaatgaaatagaaacacagtgtaccaaaacctatgagacctagcaaaaacagtattgagaggcaagtttatagcaatacgtggctgcatttaaaaactagagagatttctttctttttagacagagtttcgctgttgtcgcctaggctgaagtgcagtggcgtgatctcggctgacttcaacctctgcctcccgggttcaggcgattctcttgcctcagcctctcgagtagctgggaatacaggcatgcaccaccacgcccagctgattttgtatttttagtagagacgtggtttcaccatgttggccaggctaatcttgaactcctgaccttgggtgatcctcccaccttggcctcccaaagtgctgggattataggcatgagccaccgcacccagccaagagatttttaaatgaacaacctaacagagtacctcaaggaactggaaaagcaagaacaaaccaaacccacctgggggaaagaaattagatgtagtagaataagataagcattaggaattcctcaaggccaagagaaatgtctgcacagaaaagagaaggaacttggaggctgcattgccagaatgcctcacccagcgtatgttttgtacgctgtgtccttggtcctccctttgcgataatttctctctgtggcacacaagatttcaactatcccttctctgcaaaaggttcctaaaatctattgccctgatctctcttttgagatccaatttcttgagtatttcataggtgtcaccagcgttttaaattttatacattaagaaacaaacagatgcttatttcctcaactgctacgccctctcccgcctccaacacacacacagcctactcttgtgtcactcaagtcagggaacaccctcccattatactcaaatctgccagttccctgttctttgaggaggtagcgtcatttgtcacaccgcaggccttctggggctttgtggccctggaggaagcctagatgcgatgggtccttgtgtccagaatgaaagttagctaacaaaactggagggaagtgttatgctttgaggaggtaacacaggttgagcatccctagtgcgagaatcagaaacgatccaaaatctgaagctttttgagtgttgtcatgatttcggattagtgatgctcaacgaataaatatcaatataatacggatattccaagatctgagaagattcaaaatctgaaacatttctggtccctagcatttcagagaagggatgctcaacctacacgtgcacctgcttcagtcagttaccctgcatgctcccacgcgcagtgccgtatgtcccccggcacatgctctgcagtctgcaaggatctggagaagaaaggtgtggctgcacttcctggcagtagacacttcatttctgctgttggaatagattgtgtttgattctactcttacgtctaagggcatctctttaggtttctggccttggaaccatgcttgactgtggaaggggtacataattcggatttatttttaaggtgttattctacttcttcgtgtataattgatgcaaaccatttctgacatccttcaaaacacttgtgtcttcttgaaactcccacctttaagacaagcaatgagtgtgtttttgtgtggctcagatatgtaggtgaaacctgtgtatgcagcaccctcccccaaccacccagtttcaagcccagcttttgtgacgcttttgtgactcaattatgaataatcagagctgtgcctggaccccatcattctgtcttactttttacattcttcacccaagcatgtagaggccaggcctaaatcaaagagctcagaggaagtggtggttctttggagttcaggaacatctcttatggaagatggagacaattgtggagaaatcttttcatcatccatgataggcagatgagatgcaaataggcctagactcactttggtagaaacttttaaatagatagttctagaaaattattatgtatttggtattccatgagaggttgggcaattttggaagcttttttaaagttcagtccagtgacacactatccataattgtgttgtttattggagatattatttttgttttattttcgttggagacagggtctcactatcttgctcaggcagaacttgaactcctgtgctcaagccatcctcctacctcagcctcctgagtagctgggactacaggccataattgtattgtttatattcaacaaagaaatatttactgaatatttaattctaattgagaaaataaggcataagcagggaaagatagttaacaatgtaaagtaagtttcaaaagaggcctacggtgtagcatggtgtttaaggctataagagattggaattagacctgggtttagatcttggttctgagacttactggtggtgggacctcagcaagttacttaacctttatgagctcccaattttccttacaaaactcttcatagggttgttgtcggagttaaataggatatcatctgaattatgggtagtgaattacagctgatttagcgagggtatcagagtaagataaaacatcttcaaataaaacatcttcaaaatccatcatggtgcgaaaggatgtccttgttagcatggcatgctggatgcagggcaacaagtctagagctccttacattttctctgattagcggataagtgatcccggatcctggaatggtgctgagattgttgaaagaagcgaggtgactttggtgtgggaatcaggaggatgtgaggaacagaagggaagccagcgaccaggtcagcagacacatcactgcgtcagttcagtaggagagttcacactggcccccatacaggtaggtctagttagcaaattgccaactacccatcatcaactggagatgatggagaaataattacaatccatgatgtggccaaagtacacagaggacagtgtaggagcagaagcaaagcttaatggactagggggtcaaagagggctctttcaggtggaaacacaagctaagccttgaagaacaaatcatgacattagaaagagaagcaatcgtttaccaagcagcagacacagcatgttgaagaaacagaaacacagaaacatgaaacaccactggagtctccaagacggtattttcccagtggagttctccttttcctcaatgtgcagatagagattccaaacctgcccttgactctcaccctgacctgccacacctgcatcatcatcttgctaacactgagccagatttcacatggtgagaactgttctgaaatctcgccttagagtcctgaccacgaagcccttaagagtagtaatattgccaggcgtggtggctcaagcctgtaatcccagcactttgggaggccgagtcaggcggatcacgaggtcaggagatcgagaccatcctggctaacacggtgaaaccctgtctctacaaaaatacaaaaaattagctgggcgtagtggcgggcacctgtagtcccagctactctggaggctgaggcaggagaatggcgtgaaccagggaggtggagcttgcagtgagcagagatcgcgccactgcactccagcctggacgacagagtgagactctgtctcaaaaaaaaaaaaaaaaaaaaaagtagtaatattacgttcagccctaagctggcttctcagatttccactagactggttctacagccagtgctctgtagggtagggacttccccatcccacttacgtatacttgcactgaaacgaattgctcactccagctgtataggtctagcctccacgaatagatagcttaataggcaggctctcattagactttagtagaaacattcatggataccaaaaactgtgtttcagtggctctcaaatctgatgtattgaccctgggcatggtggctcatgcctgtaatctcagctactggggaggccaaggcaggaggatcacttgagcccaggaatttgagatcagcctgggtaacatagcaagacccctatttgtattaaaatataaataaatctaatttatcatcagaatctatagaattttttttttttttttttgagatggagtctcactctgtcacccaggctagagggcagtggcacaatctcggctcactgcgacctccacctcccgggttcaagtgattctcctgcctcagcctcctgagtagctgggattacaggcatgcatcaccacgcctggctaatatttttgtatttttagtagagatggggttgcaccgtgttggccaggctggtcttgaattcctgacctcaagtgatccacctgcctcagcctcccaaagtgttaagattacaggtgtgagccactgcacgtggccatatctatagatgaatttttaatacagagtcccagaccccactcagagattctagggggcggagttgggcctgtgttaaagaaaattcatttaaaaattaaattaagaaaacaaattcccacaggtaactgtgatccttagatctggagaccttggctgagaggaccgctgctgggccatcagccatcgccattggtcttgctgatggaatgtgaccagtgaggttctctgtcctgagaagcggttctgaaagatgctagttcttctgagcatatctcttgagtggcagtgatgagtctgccctccgagtgacagtgacatttctccttgcagcctggcagtaaaagccagtcagcagagagagacatgagcagcacatatgcgagactgcctagaggagatgaggcagagcagccctgagacctctgcagttcctgaggccacactgcacacggccacactcctctccttgcttccatgagatgctcctttatttctttgagaaattcccctctccggctaaggacagcacaagttggtttctgttacttgcaattaaagagcccagtgactacgactcttactcaaatagcatccctaaagaacaatgaagggacacactttaaacatgctaggtatgaaatatcaactttctccccaaacaactctggaaatgagctcttgctcaggaaggaaaaagcaaaaacacctttactattgagtcttttatgcagctattagcttggtacaaagaacatccccttaggaaaagagaaattcaagatgctgtctggattggaagaaatggaagaaagcagtggaagttccactctcacaagcagggcccacatcggcctccccttgggaagaggaaatacaatcagttttgtggcacagatgagctccaggcagagccaatttcacacacgctgattgcagcctgtaccttctgcctcaccctccgaatcagcctgaggctggcagaggtctgtgaactgggctgagatttttttgacctgttaggttttagcatatggcagaaacaatcaatactgcccaagaaccgaataaagcacggctgttcccaacagggaaaacaggcaagctgctctttcccagaaggagcactccttgccaagcctgcatgccctgaccatcttcctgcacagggcacttagatattcacctacttaggaaacacattccagcctctagccaccatcccacacctaaaaatcaaacagagacattcatctggctggggactgggagtttatagcagtgcctttcgggtgagttggtgagctcagctagtggtggcttactccactaattagcctgtggccagaaagccacttaggctaaggagcccttctctgctcacttctgtggccacagagtggtccctgggcctagccagtcagctggctggcagatgcttgccactaggagatgggaaatgggctgcagaagttctgaagctgaaaatgtcacctgaccagcctgggcaacatagcaagaccccatctctaaaaaaaaaaaagtttttaaaattagccaggctaatttttacacacctgtacacaggtgcatatctgcagtcccagctactcaggaggctgaggtgggaggatggcttgagcccaggagtttgaggctgcagtgagctatgatagcacaattgcactccagcctgggcaacagagagagaccctgtctcttaaaaagaaagaaaaggagagtgaagcctgcatctctccctcccctctccccttccaacagagcagttccacctatacctatttattaattgagcttcctatcattttgtttgaagaagggattcatcactgctaatactaatcgttcacgctgtgtgttggggtgcacgagtgcacacacgcccaccaggcaccatgccaggtgttccagatgccttggcttgatctcttcaaacaagtccaagagggagattctgttattatgtccatagcacagctgaggaaatgaaagtcaactctcttgtccaaggccacaaagccagtaagtgggaaagccaggacttgaacctaggtcccccagactctgcagcctttcttgcattgtcctctgggaagggccacaaccacctgagtgaagaaaaacaaagcccagtctttctctaaagcaactgtgctcaaccttgtctgcgtactggagtcatcaaggaagctgcgaccagcgcagacgctgggctgtcatctctggaggcactgatttgcttcatcgatctgagagcagcttgggcatagggatttgttttttttaagactgaaaatcactgcattagggaagcagtgatgagaattcaataattcgaattacatgtcagcactgatgtgagggttcaagataggaatttccctcctggcacattactcaattgatagtttaaaaaacgtccttaagaagaagaaagacagccaaactccttctgcagctctggtggaaaatggagaagacttttcctttcctccatctcccccagggcctggtggagtgaggcgttgcccagctataaactgtggtcactcttctggtggggccagcagataacagctgatgtgtgaaggaggcagggaaggacatggggaaaaggtccagtggaaatcaaagcccattgtcataattctgtcctttgttttgagacaggatcttgctccgttgtctaggctggagtgcagtggtgcaatcatagttgactgcagcctcaatctccctagctcaggtgatcctcccacctcagcttcctgagtagctgggaccacaggtacgtgcccctggctaattattattatttttatttttagtggagatggggtcttgctatgttgcccaggctggtcttgaactcctgggctcaaaaaatcctctcccctcagcctcccaaagtgctgggattacaggcgtgagccaccgcgctcggccagcattctgttctttatgcacccagtccaggatcaagataggtggaggtgagcgagatgtaaatgcagccgtccacataaataatgtttgaatgccatctttacaaagggcagctgggcgcagtggcttacacctgtaattccagcactttgggaggtcgaggtgggcggatcacctgaggtcaggagttctcaagcttggccaacatggtgaaaccccgtctctactaaaaatacaaaaatttgcccggcgtggtggcgggagcctgtaatcccagctactcaggagactgaggcaggagaatcgcttgaactgaggaggcagagcttgcagtgagccgagagcacgccactgtactccagcctgggcgacagagtgagactccgtctccaaaaaaaaaaaaaaaaaaaaaaaaaaaaagagcaacattaatgcaaaaaaattaatggtgaaaaaaaaatgtcaagtattgaaatatggatagcatctgacagggttgctgaggttggggtgaagggagtgcggggagtcctgcaactagacctttggatcttgtctttatttgaattttgtggattttttggcattaattttgactttaaaaaaaaaagcatgaaaatattatttttcttaaattgtgtgcctaacagtgagtcccaataaatacttcctttaggaaatacttaaaggagttaaacaacttttgacttgctgatccttctgcattgagggaggagacatctcagaagcatgccctttgaaaagtatcagaatactaggcatcctcctgtgcctcccacaacccccgcaaaaaagaatactagccctcccaaaggccggatgggatttctgcatcaaagagaagacatcaacggagagataacctagtcattcagaggccgcaggtgaggagagagggacagtggacagcaatgcccagagaaggcaatttgagtgcatgaccatcagcccatgccaagggcagcctgcagagttcctccctctgttgattcatttggctaggatgagttctagacctgaacacgtcctccccatcatacaggattacccactgttaccttggtaaattaacctgtttaaccttcggctccctggtctgtaagatagaactaatactatacccctcacagtgatgttttaaggataagtgaggtagaatatatataaagcactttacagagtgcctggtacattctaagtggtcaaaaaaaaaaaaaaagatagctattttcgccttactattagattttctaggtcaaggctgggcgcagtgcctcacacctataattctagcactttgggaggcaggggctggtggatcacttgaggtcaggagttcgagaccaccctggccaacatggtgaaaccccatctctactaaaaatacaaaattagctgagcgtggtggcacatgcctgtaattccagctacttgggaggttgaggcaggagaatcacttgaacctaggaagtcgatgttgcagtgagctgagacggtgccattacactccagcctgggcaacaagagtgaaactccatctcaaaaaaaaaaaaaaaaattctaggtctgttcttgaagctagaacagaaaaagagattttctaggtctattcctgtctgagtcctcattgggaacgtttcactgctgactgataagtcaccagagtgtaggccaagccagtgagctttgatgcgtattaatataaaatctgggaaattgtccctaaaatgagtcagagttacggaaggaatggagaagcctggattccggtctcagcttcaggacttgttagctgtgggaacttaggtctatcccaccacaactccgggcctcttccttctttatgcaataaaaataacagcatcattcctattgctcttctgctgtggggaccaaagagataataaggtgcaaaagtgactcagggcagcacctttggatggaaatgagctttgttaaggcgttgttctttcagtgggctcatttctttgtctgggctggttcatctggttctgatcctgaacttaatgatctttggaggtagattctttattctggactttaaaatgatagcagaaagaattagctgaaagtaacaaattattatttaaagtaggtacgatagatattagttctggtattaattatattactttcccatagggaattggaggtatatatgaatatatatatgtatgtatatatgaatatatatatatatgaaaaggagtttatttcttacagtatggtggctgagaagtccacggttgagggactgcatctggtgagggccttgttgctggtggggactctgtggagtcctgaggtggctcacagcatcacatggtgagggggctgaaactgctaacatgctcaaattggaggtgtttttaagaagcatgactaagggctgggcgtggtggctcatgcctgtaatctcagcattttggaaggctgaggcaagcagatcccttgaggtcaggagttcgagaacagcctggccaacatggtgaaagcacatctctactaaaaatacaaaaataagcagggcatggtagcatgcacctgtagttccagctacttgggaggctaaggtggaaggatcacttgaacccaggaggcagatgttgcagtgagccgagactgtaccactgcactccaggctgggtgacagcgctgagaccctgtctcaaaaaaaaaaaaagaagcacgactaagggaaacgccttcctcttggtcctgcctagaaccacttctttagtttttctgagtttgtatgtttagatctttgtaagtgtcctatgtagttatacattttccttgattatgagtttgaatgatcacttccttttctcaggcgaatgcactcacttatgagaattttcagtcatttggactataattgcttaaacttcagactgtagctgcagagtcgttttgtagccatccttagagagtgagtatggtgtaaggattgagagcccaggctcagatgccatgccacaaaataagtgaccttgctctgttaaacgggggcatgccagcccagatctcatagggtcgtagtgagaaatgaaagaattaatgtttataaagtgcttaaaatagtgtttagtgaataataacccttcagtaaatgttagccgttattgtactgaccctatttgtgttagctcttattacacgggtctgcccaaggctgaaacttggggcttatcctctatgggacgttttctgtgagtttcagctactgctcctagtacacttcctggcagtgtttttgtctctctctgtgttctatttctctgctttcttccattcttccgtgtccatggaaaggactagatatactttttttttttccaataaatcccctttaagcaaaattgagtcaggcgtctcttgctaccaaaagaactggacaaactccactagtttgagaacagtcacctcctattctggtgctgattggttgaactcgcctagagcactgagtctctgggattctggcaaggtaccgtcactgacaccagcagcattctgggtaagcagcatataccactattacccgtgaacgaatcaaggaacatgctaggtgcacacgtatgaagggacatcttttgcacacagaactggggcacagttggcaaggaggttaaatatgttaacttcaggatacatttagggaaactgcaatcaagagatttacccagaaaacacatttcagaactatggtataataaaaaatatgtttggtctttatccctgactcctggcactgagcatcaaagacccttggaaatttccgagtggttcgaatgtctgttgttatacatgaatcctttctgatcataactaagtttatgctattgaggtgaatcaaggtgggcccttaaatagtttcaggagagaggctggccacactacaaagaccaagcttatgattagagggttggaacttttggctccacccctcaacctctggagagaagaggggaactggagattgagttcaatcactagtggctaatgatttatttatttttgtttttgtttttgtttttgtttgagacggagtcttgctctgtcacccaggctggagtgcaatggcgcaatctcagcagactgcaacctctgcctcccgggttcaagagattctcctgcctcagcctccagaatagctgggaccacaggcatgcactaccacacctggctaattttcatatttttagtagagatggggttttgccatgttggccccactggtctcgaactcctgacctcaagtggtccgcctgccttggcctctcaaattgctgggattataggcaagagccaccgcgcccagccagtggctaatgatttagctgatcatgcctaagtcatgacacctcaataaaaactcttgagcaacaagcttccaggagcttctgggttgataagctcatgatgtgctgggaggatggcatgcccagagagggaatggaagctccacagcccagccactagccccatacctcgtcctacacgtctcttccatttggctgttcttgagtcgtatcctttatgggaaactgtatgtgaatcatcaatacagtgctttgttgagttctatgagtcaccgtagtctgttaatgaacctgaagcagtcatggaaactcctcaatttatagtcagccaggtagaagtgcaggtagcctggggaccccactggccctggacgttttgtggaactgaggccttggtttgtgtgatatgacagtaactcctgatagtaccagaattgaactgtaggacacccagtgaatgttagagaattgatgttgaaaccctaagaactttggaggaactgattgtaagaattctcttctgaaaagcagccaagtcctctattgcctccagagaaccacgttcaaatcattgataacagagtatagtattctctttctctgctttcttcctctctttggtggttttcaacaggttgtttggaagtgaaaggaaatatgtctgtgataggggggtaaacaacaccctgtggcattcaaagttctaaggcctgataggctagaactcccatttccacattcacatatgaagttgaccagatttgtgatttattctgctgaaattccccagagatggtccaactcttttaccatggaaaagcaacatcaggggattgcatacattaaaggtgatataaattgtagtgggaatggtgttttagagcacattttaaataacctattttggactcatggcaggctcccattagaaaacagttgtgagggcaaaattatccccatcaaaatacatcagttatgtacccacttcgtcctattcggctgcacttttttgtaggattcagctttccttttctacaaatacatttcttctcttttttatacttcttacatttttgtttctattctttatgtaattggagtgaggattgtagcgacagaaaggggatgatccctttcctccccatcgtaaggctcacggctgacacccctacaacaaaagacaggaaaaaagcacaacaaatttatttgattctagttttatgtggcacaggaggcttcaggataaagacccaaagacccagagtaaactatccgtgtttacatttaggttcaaggaagcagggacagccacgtagaaacgtgattgggccaggcaccatggcccacgcctgtgatcccagcactttgggaggccaaggggggcagatcacttgaggccaagagtttgagatcaggctggccaacatgacaaaaccccatttctactaaaaatacaaaaattagccaggcgcagtggcggcaggcacctgtaatcccagctagtcaggaggctgagacaggagactcggttgaacccagggtgtcaaggctgcagtgggcagagatcgtgccattgcactccagcctgggtgacaaagcaagactctgtctcaaaaataaacaataaataaataaaatcaacacataataaatagaaatgtgattggacaaaaagggtatgaactgttaaaagaaaaacttcagctgaattacatttaacagagtttaattgagtaaacaacaattcgcgaatcagcagctgcctgagccagagtaggctcagagatgccagcacagccccgtggtggaagatttgtggacagaaaaaagagagtgacatacagaaaacggaagtgaggcacagaaacaggcagattgggtataggttagtgtttgcgttatttgaatgcaatttaaacagttggccacatttgattggccaaaactcagtgattggcacaagagaagactacagtctatttacaactccattgaggttatagttcatgatgtgctttaggtcaaacttaaaatatgtaaggagagagctttaagccaaacttgacttaacagaactgatggtaataaacggaatggggaaacctagccaggcttgcctgttcagattcttcttggcctctcgtttgcagcatttcttcttccttggtgtagggcaggacccctctggaatgagggtctttatttatggccggctgatacattgacaggtgggggaaggtgagagtaatattttgttgttgtcgcctagactggagtgcagtggtgcgatctcggctcactgcaacctctgcctccctggttcaagccattctggtgcctcaacctcctgagtagctgggattacaggcacccgccaccatgcctggctaattttttgtatttttagtacagatggggttttgccatgttggccaggctggtcttgaattggcctcaagtgatcctctcccttctcagcttcccaaaaccctgggattacaggcatgagccactgtgcccgggaggaatatttttaagctttatagctagctttgagggaaaggggttctggtttctatgacctaccttggggaagaggaatactagtttctgtggcttgcctcagggaaaaatgaggggcaagagacagaaaggcaggggaaggtcagagagaaacttcactcctaagccttcactttggggcatcactttctgagctccaacattgttacttggatcctaattcatacacatccctcagaagctctgggatctcacagggtgcctatgtgctatgggttcctggagcttcgaggagacatcgtgaagaagagtttggaaatggaaaggtttctgggccttggagctgtgatccccagctccgctggaagtggaagacactgtctctgcggatttgggatcagctggatggggcactccctgaagtcagagaatgcaggagcacagctctgtcctgctcctacctctgttgtgatttgacctgccttttccccttatctgttggggtaaggggttatacagcatcatattaggacttgcccacgttgttaaactattagtgagtccctaaaacagaatcgagttgatgagccgtgtatagtttgcttaaccatgttcttatggccagtcatgcaggttgttttcaagtttggcttttataaatgcatctgtaagtaaaatatttgtccaaaaaagatgtttccacatttaaggtaaattcccacaaatgaattcctcaacatcttaaggcttttggcccattttcgaaataacttcgcgaagggctcggttttctaaagggcaaagtctaaagtgcatttttttcgttcctttgccagcactattatagtttttaaaaacctttaccaatgtagtagctggaaaattgttgtattgatttgataaatacttccctgattacttttgatgtaatcaaacacttttgattacccgtcaattttgactatcccatcaattacgtgggaacactttccccatgtaattgtctgttttttgagacaaagtcttgctctgtcacccaggctggagtgcagtggcaagatctcgtctcactgtaatctttgtcatctgggttcaagtgattcttctacctcagcctcccgagtagctggaactacaggcagcaccaccatacctggttaatttttgtgttttttatagaggtggggtttcaacacgttggccaggctgatctgaaactcctgacctcaagtgatctgcctgcctcggcctccaaaagtgctaggattacaggcctgagccaccacaccggcctgtttttttgtttttttgttttgttttgtttgagacagggactcgctctgtcgcccaggctggagtatggtggtgcaatcactgctcactgcagccttgacctcctgggttcaagtgatcctcctgcctcagcctcccaaagttctgggatgactgacgtgagccactgtccctggctcctgtgtacgtgttagccactaatttttttcaggtgctttgcccaactctgggctgtgctgcctcacacaacttgtaattgcagaatgaaacgcactagggactggcaacaactccaatcgccacctagatgacccagcacgtagctcacagacccaatcacttttgcggtccaagtttagaaatcacagttgttaactagtgtgtggtttgcaaaacaagtgttaggcatctagtcatttgctgattcatcacatattttttatgggccctttatgagccagacactattttaggcctggtgaaaaagacaaaaatccctctttgtacggactgtacattctagtgaggagaggaagaaagtaaacatccttaagtctgttgtcaaataaattaaaagatgttcattgctttaggaaaatgagcatcaagggtagggggtggtttggagaaaactggagggtgaaacctgctgcagatgtaaagtgtggtcaggacagagcccagcaaggaggtgagagagccttgggagctgcctggggacactgcgtctggcagaggcaccaaccatggggaagaacagtaggaaaccaggaaggccgaaacggggcaagcaatcggagtaataggacttgatgtcagagaagtccagggggtggatctcatagggtcttgggggccgttgcaagcatttgggctttcctaagggtgagatgggaggaccagaaagttttcagccacaagagtgatgagatctgtctgccgtttgaaaagagtagctgtggctggctgctgcattcaaaacagactgcagggggtcaaaggcaggagctggaggagagggcggagcagacagactgctgcaaattacccagagccctcacgtggccctggagctggtgagtgaaaagatccaggaatccggcagagctgatgggatttcctgatggagtgaatgtgcgctgagagaaagggtggagccacgggcagtttctatttaagacctcgtaggttgctatgtgccccatggtcccttaactaatgtctgagcatttccagagttaaaccaggaacacatttactcatgggcctagctcctggtatgaagggcatgataactaatccctgccgtgagaattcagaaggggcaatggttttctccatgttaatgaggtgatgaataaaaatgataatgacattgtggcatttggtccattctttgatgatcttcatgtattcctgtttaacatttttttctctacacgtttagaggaacttctctagtagcaaactacagaaatgatccctgaaagtatcgtcttctgtttaacttgacttaattgaattggcataggtatttcctatcttggcaaccatgtgtggatcttatacaagatttatgcatgatgtctttgctgttgttgttagaacaactcagcaaaataaaattccatttcatcgttggacaacattgtttcacacatctgtgaaataggccaaaaaaaataaataaataaacagcaacttcattgataaataaataaataaataaataaataaatcttttatctttggcctttttaaccgtctcatacaaaccaactttcatgcgcgtccgtgtgaagagaccaccaaacaggctttgtgtgagcaataaggctgtttatttcacctgggtacaggtgggctgagtccaaaaagagtcagcgaagggagataggggtggggccgttttataggatttgggtaggtaaaggaaaaagcggggttgttctctggcgggcaggagtgggggtcataaggtgctcagtaggggagcttctgagccaggatgagccaggagaaggaatttcacaagacaatgtcatcagtttaggcaggaacaggccattttcacttgttttgtggtggaatgtcatcagttaaggcaggaagcggccatctggatgtgtacatgcaggtcacaggggatatgatggcttagcttgggctcagaggcctgacattcctgtcttcttatattaataagaaaaataaaatgaaatagtggtaaagtgttggggtggcgaaaatttttgggggtggtttggagagataacgggcgatgtttctcagggctgcttcgagcaggattaggggcagcgtgggaatctagaatgggagagagaagctgaaggaagattttgtggaaaggggtgatattgtggggttgttagaagaaacatttgtcttatagaattattgatgatggcctagatacaattttgtatgaagtgaaaaaagaagggaataagacaaggagaaaaacaggtattaaaggactaagaattgggaggacctaggacatctacctagagagtgcctaaggaggttcagcatagccttgccagcaaagattatttatttactttaagagttaagagtggcggtttggggatagcaccaggcgatatcagctgcgatggcttggagaaacagtgtgaaccggcagtgtaaacaagagcagggcatgtatgagtagttgagaatggtgaataggagtatgactagacagaagatagtagggatgacaagttttctggggcacagtccaagttggtctggtgtctggaatgagactggggcttaataaaaaggagcgtccatacaggagctcaaatgggctgtaccctgtagcattccgaggacaggcctgaattctgagaagggaaagtggtaaaagtattgtccagtcctttttaagttggaggctgagcttggtaagatgtgtctttaaaagaccattagtccgttctacctttcctgaatattgaggatggtaaggggtacgaagtttccactgaataccaagagcctgagaaactgcttgggtgatttgactaataaaggctggtctgttattggactgtatagaggtgggaaggccaaaccgaggaattatgtctgacagaagggaagaaatgaccgcggtggccttctcagaccctgtgagaaagacctctacccatccagtgaaagtgtctacccagactaagagatattttagttttctgacttggggcatgttgagtaaagccaatttgccaatcctggtggggggcgggggcaaatctccaagcttgatgtgtagcgaagggagggggccggaacaatccctgaggggcagtagaatagcagatggaacactgagaagtgatctccttgaggatagatttccatgatggaaaggaaatgagaggttctaagagacgggctagcggcttgtaacctacatggaagaggttatgaaatgaccacagaatagaatgggcctgtgaggctggaaggagatattttccttggtctaagaaccatttgccttgtgtgggaagagattgataggtggaagtttcagcgggggagtaggtgggagtgaacgatgtgaaggagagaaactggccgtgaaggacagaagttggaaagctagctgcttgtctagccaccttatcagcataagcattgtctagagcaacgggatctgatgcgttttgatgccccttgcagtgaatgaccccagcttcttttggaagtaaagcggccttaagcagagtttttattaaagaggcattaatgatggaggacgcttgcgtagtgaggaaacctctttcagcctgtataacagcatggtggtgcagaatatgaaaggcatatttagagtcagtataaatattgacgcgtagtccttttgcaagagcgagggcttgagttaaggcaactaattcggtttgttcagaggtaatggaggggagcggagcggtagcctcagtgatagatgtggaagatactatagcatagcctgcctttgctgatgagtggcgattaggcctgctggaactgccatcaataaactaaatgtgatcggggtgaggagcaggaaggaaggaaatatggggaaatggggtgaatgtcaggtggatcagccagatacagttatgagggtcagatgtggtatccagaataatgtgggaggccagattgaagtccgggccaggaacaatggtaattgtgggagactcaacaaagagtgagtacagctgaaggacccggggagcagaaagtatatgcatcaggtgtgaggcagaaaatagacttgggaagttatgagaggtgtagaaagtgagttgaccatagtttgtgattttaaaggtctctgaaagtattagggcagtggcggccgctgcacgcagacatgagggctaggctaaaacagtaaggtcaagttgtttggacagaaaggctacacagtgctgtcccagctcttttgtaagaattctgaccgcactaaccatgcctgggaaggaaaggagttgttgttttgtaagggattgaggtttgggagattagccagacatgatcagcagggagagcatgtgtgtttttatgagaattatgccgagataggtaacagatgaggaagacatttgggcttgactgaagtaatgggtgctgtccgtgaagttttgcagcagtatagcccaggtaatttgctgagcctgatgggtgtcagggtcagtccaagggaaagcgaagagaggctgggatgaagggtgcaaaggaatagtaaagaaagcatgtttgagatccagaacagaataatggattgtggagggaggcattgaggataggagagtatatggttttggcaccacggggtggataggcaaaacaatttggttgataaggcacagtcttgaactaacctgtaaactttgtctggttttaggacaggtgaaatgggggaattgtaaggggagtttataggctttaaaaggccatgttgtagcaggtgagggaaaacaggctttaatctttttaaagcgtgctgtgggacaggatattggcattgagtgggtaagggtgattaagttttaatgagattgtaaggggtgcatgatcagtcgccaaggagggagtagaggtatcttatacttgtgggttaaggtgcggggatacgagaggagaatgcgaaggaggctttgaactggggaaaagggcagcaatgaggtgtggctgtagtccaggaacagtcagggaagcagataatttagttaaaatgtcttggcctaataagggaaccgggcaggtggggataactaaaaaagagtgcaaaaaagaatgttttctaagttggcaccagagttggggagttttaagaggtttagaagcctggctgtcaatacttacaacagttatggaggcaagggaaacaggcccttgaaaagaaggtaatgtggagtgggtagccttcgtattgattaagaaggggacggacttaacctccactgtgagagttaatcagagtatctgtgatggtcctgtaggcttccgaggcaatccggcagtgtcagtctacagccgctaagctgagaagatctgggaaggagtcagtcagagagccttgggccagagttccaggggctctgggagtggctgccaggtgagttgaacagtctgattttcagtggggtctcgctcagatgggacgtggcttaggaggaatcccgggctgtgggcattccttggcccagtggccagatttctggcacttgtagcaagctcctgggggaggaggttctggaggaacccctggcagctgcggttcaggtgtttggagttcttgtgtgctggagatgtggctggggtttgtctcacagtggaggcaaggaattgcaactcagaaatatgttgctacttggctgcctctactttattattgtacaccttgaaggccaggttaattaagtcctgttgtggggtttgagggacggaatttaatttttggagctttatttaatgtcggcagcagattgggtaataaaataaatgtatattgagaataagacggccttttgaccttttagggtctagggctgtaaagcgtctcagagttgctgctaaaggggccatgaactgggctgggttttttatatttgatgaaaaagagcctaaacactaactgatttgggagaggtcagataaagaaaaagcattaaccttgactatgcctttagctccagccacctttttaagaggaaattgctgggcaggtgggggagggctagtcatggaatgaaactgtaagccagaccgggtgtgaggaggggaggtgataaaaggattatagggtggaggagcggaggctgaggaagaatcgggacctagctcggcctggcaaggaggggagaggtcagatgggtctgtagaaaaggaagattagaaagactcagcgatgcttggggttgggactgaggggacaggcgggagggaaagaaggaagatttgggatgagttgcatggggaacagagactagggagggtccaatgtgtaaaagaatgcctggacatcgggcatctcagaccatttgcccattttacaacaagaattatttagatcttgtaggatggaaaaattgaaagtgccgttttctggctatttggaaccactgtagagtttatactggggtcaagtggcattgcagaagaaaataaggcatttaggttttaggtcaggtgtaagttgaagaggttttaagttcttgagaacacaggctaagggagaagaagggggaatggagggtggaaggttgcccatagtgaaggaggcaagcccagagaaaagagagagtagagacacggagggaaggggttcaggggttcttaccctccagaaaagcaggaaaggggttggggtgtgtaaataaggggttggggcacagagataagaggttggagtgtggaaataaggggtcagggtgcagagataagaggtcggggcatggaaataagggattggggcacagagataagagatcggggcatggaaataagggatcggggggttcttgccccctagagaagcgatacttgccgctaagggtgaaggagaaggggggttgggggggtttcttgccccccagaaaagcagagaaggggtggagacatggagagaaggagttggggggttcttgcaccccagaaaagcggtacttgccgctaagggtgagggacaaaggcaggcgtccttgagtggtcagacacctctgaaacatgggtgaattatcagagaggcgtccctacaatgattaaacaccaagggaaggctgccttccctagtccgtgactggcaccggagttttgggtccacggataaaacgtgtctcctttgtctctaccagaaaatgaaaggaattgaaattaagagaagtgagagattgaagggtggtgcaaagattgaaaggagaaagtggttgagggatagtgagagaggttggagaagagagtaagaagaggctgcttacccaatttaaaattggtgagttgttccttgggctggtgggtctgaggacctgaggtcctaggtggatctttttcacggaccaaagagcaggaggacaggggattgatctcccaagggaggtcccttgatccgagtcatggcaccaaatttcatgcgcatccatgtgaagagaccaccaaacaggctttgtgtgagcaacagggctgtttatttcacctgggtgcaagcgggctgagtccgagaagagagtcagcgaagggagacaggggtggggctgttttataggatttgggtaagtaaaggaaaaagcggggttgttctctggcaggaaggagtgggggtcacaaggtgctcagtaggggagcttttgagccaggatgagccaggagaaggaatttcacaagataatgtcatcagttaaggcaggaacaggccattttcacttcttttgtggtggaatgtcattagttaaggcaggaaccggccatctggatgtgtacgtgcaggccacaggggatatgatggcttagcttgggctcagaggcctgacaccaactatctatagtacagctaagtgcatgtacaaaaaaagttactggaatgctcagaataagattgtttagttgtttttgcttctttctacgaggtttcttttgttctttgaggtgatgatgaacttggtcacaccacaagtaaagtcagaagtaaggcagaggatgctcagtaggctggtttgatcacctgagatcattaaaaatggctgactgccagctgggcgcagtggctcacacctgtaatcccagcactttgggaggctgaggcaggcagatcacgaggtcaggagatcgagaccatcttggctaacgtggtgaaacgccgtctctactaaaaatacaaaaaattagccaggcgtagtggggggcgcctgtagtcccagctactcgggaggctgaggcaggaaaatggcatgaacccgggaggcggagcttgcagtgagctgagatcgcagcactgcactccagcctgggcaacagagcgagactccatctcaaaaaaaaaaaaaaaaaaaaggctgactcctgacaatacgtgcaaaaatataaaaggaaactaaaaaatactaacaaatctccttttaaaattacttaaaaaaataaaaataaaaagcagggccttggaagttttgattcctttttcctctcctgttgcaaactcatgttgtggttttgggtgggtggtggagagtgtgtcaccagcaggtggcgctgtcggcagtggctgggcctctctctccaaggtgaccatgtctagtttatgagaagggaagtggagggtgaataggtcacggccgccttttttttctttgacttttctgctgcctggctatcctcctcatcttctgctttgcgatatcaacaccactatcttctctatctgcagtgccctgtttgccaccaggggctctagcttcttcattcatctccaccctcttccttgcctccaccttcttcctcctcctcttcctccccaccttcttcctcttctttgtcctccttatcgtcagcctcatctccccattttcttcattggggttcccactagcaggggcatctcttcccctttctccacctgcacaacttgtttcttctcctttaagtggttggtggtcatctcagagttggtgtccacagatggatgtctgtgacacagcgggctccccggtgatcccatgtgttggataagaagaaagcaagagtttgaggactctgccaataaaatggggacaatgcaaagatggcttttcagagcggccagtgggcacctgatgacttttgaactcaccaacactggcagtgatttgattttgtgttcacctggcctttgggttgttgggcacggtgaaggagggtgacaaatgacaggcagaaaggaatcagatgcatgattttgtgaagatgtaggacattttgttattcaaggaatgttcagttatgagtgccggtcattgtttttaaaggaagggacatacttaacattttaagtattctattttcttacctgaaatttaaaagaaaggaagaaataagaggtctggcagcccccactgcagagactaaaatgtgacaggcgggtgagttgagagggaaacagctggctggtttgtctctgtggtggcttctattttgggaaagttggtgatcgccttgcctcactgttctgatgttctcagtggcctcagctgagctgcagtggagtgaggggtggaggaagcacgaacggtgacagtcgttccagctaccttgcaatgtggcagatgggaataaacgcccatgaactgggagaagatttgacggctgcctattgctgtgtaaacctggccaaggcattttacacttctaagcctcaggaaaaaagaaatcattctcattgccctacctatttctaaaaatcgcatgagtctccaaaattgcaagtgatatgacataaaatcgttttgggaacactaaagacctatacaaatataagcccccattattgatttagctgcagggtacgtcattcatacacatgaagtatgttatactcaaagactgtatacacgttcctgtatcagcctgaaatctgtattaagttttctagatataaagagtccattattttatgactggaattttcctgctctatgcacttgtttattataaaggtcatgatgggatttcatttttaacctgtgtgcatgtgtgtgtgtgtgtgtgtgtgtgtgtgtgtgtgtgtgcaatatcaatagtagaagggaaaaaagaaaggtgacctagcctgggcaacatagagaaaccccatctctacaaaagatgcaaaaattagctgggcatggtggcatacacctattgtcctagctacttaggagacttaggtgagaggatcgcttgcacccaggacctccaggctgcagtgagccaagatcgcaccactgcactccaggctgagcaacagagtgagaacctttctaaaaaaaaaaaaaaaaaggtgacaagaccttccataacatggataaggccttacagatgatccagtccaatttcctcaagttttaaagaagctgggttccacggtattaactgaatgatttcaagattacacagctagtctgagcagaactgggacaggtccccaagtcaacaaactcctgccccagcaggtttttttacctccttttccttctttcacattttctacaattttgccatacatatgagcacagagagttatgctacaaatacacacacacacacacacacatatatgtatatacacacacaaatattatataacattctttcctcaacagtctccttcccccaagcaagaagtttccactaaaccttgaacaattttgctcaaagctttatggctaaaaaagtggaggaagcagagaacatatattttcagagcaacatctaatccagaattgcttttctccttagcccttaattaacttctttttaaattcaaaaattttttcagatatatctaaaatagtattatatacaattgacctgagactgtctcagatttaaagaagcgtttctggaaatctcgcccaacaccttccctcgcacctcatgtggctctcctgcccttggggaaagtagtttgggtttcatagtttgcttttagtagaggttctctttctctctctctcctttttggagacagagtctcattctgttgcccaagctgcagtgcagtggcagcatcatagctcgctgcaggccagaacctctgggctcaagtgatcctcctgccttggcctccctagtagctagaagtacaggtgtgtgccatgacgcctggctagagactgtcttatgaatgctgagtggaggctggattggtgggagcactggccaattgccataggggtctttattgagcaccaagcaaagcaacctcctccctcgcctttagggtcctcatatccatgcttgcttctcttcctaggatgcattgtgtctgagtttatcttctttctttatctgtgtacatatgtattgtcttactctctcttcattagaatgtaagcttcctgagagcagagagctggcttgtgttgttcacctgcgtaccttgagtgaccagagagtgattggcactgtttttaaattttttaaattttattattggtttttgagacagggtctctttctgccacccaggctggagtacagtggtgcagtcatggctgactgcagcgttgactccctaggctcaagcaatcctcttgcctcagccctccctagtagctgggactacaggtgtgcaccaccatgcttggctaatctttttattttttatagagatgagggccgcgctgtgtggcccaggctggtctcgaactcctgggctcaagccgtcctcccacctcagcctcgcaaagtgctgggattacaggcatgagccaccacatcggccattttaaatatttattaaaaggacaaaagggttgtggggttaacggtttgaacatcttgatccatattctcagatcaccttcccaaaaatgtcagaattcacaatcccattaggaatgtctaggaggatcttttcacttgaatcctctctgaagctgggtatgatagtttttaaaatccttgttaatatgataggaaaaatttttaaaagcacttatgttttaatttgcatttctttgttgcaatgtattttagaaagatttttattccaacagatttttaaaaggtgtggtaacattccattatgtcagtacctccttggtaatcttccctgacaatgctggatggatcaaaggggactgtatcaccctctcttagttatgggcatcaaacatgtttgaaggtattttgagaagtataaacaagttatgcaatcagaatgatttcttttgctcaagatgagagtatagaagacaatgctttcactcaaatagcacttgaaaattactctaatgcttgccacctaagtgacaagatcattcgtatctcagcatcgtgcaatatacacatgtaacaaaccggcacatgtaccccctgaatctggaataaaagttgaaattattaaataaataggtaaataaaaaaagtaaagtattactttacaaatgtggcaacaggaggaattatagagaaggaaatgattatactattgaacatattatttcctccctgagtattttaactattgtaagtcaacagaggaatttgcaggttttagaaagtcgctccagtcattctgattattgattagttttgcttaattttaaatagtctattatggctgggtggaggtggctcatacctgtaatcccagcactttgggaggctgaggtgggcggatcacctgaggtcaggagtttgagactagcctggttaacatggtgaaaccctgcctctactaaaaatacaaaaactagctgggcttggtggcaggcacctgtaatcccagctactctggaggctgaggcaggagaatcacttgaacctgggaggcagaggttgcagtgagctgagattgcaccactgcactccaacctgggtgagagtgagacgctgtctcaaaaaaaaaaacaaaacaccaaaccaaaactaaaaagactattaaaaaataacaaaaataaaaaagaaataacatatatgtctaaaaatggagtagtctaaagaagcagggtgtggtggctcccacatataatcctagccctttgggaggctgaggccaaaggatggcttgagcccaggaattcaaggctgcaatgagctatgatcccaccactgaactccagcctgggcaacagaataagaccttgtctcaagaaaaacaaaaaggactctaaagatacctagttatatttgggatacattggcaggttcagaactactagtatggaacagaaaggaagaaattgattgactcatttcccaactacttattcacccacggaacattcctaatgaacacacacaggagtcattgctcataaggttcaattagtccacttacgcagtggagtccatccttgcaaatgcacacagaaagagaacatttggcgtctgaaagaatctggttcaagtcgcatgtctgtggatcaaagtaaaaatttaaaaataatttttactaaagctccatgaaccacgtttgtaacttggggatgaattagtttgaaatctcctttttcctcagcatttttgcagcccatgtgtgcagggccgggcagggaatcatggtggtggccccaggtggcagggttgggagctgggacagagacttacaagggcacccatggctgccatcactctgtacccctgcggagactgcagagtgaacgggctctatcttctctccacccatttcttctggctgttttggtctgttgatttccagtttcccaaagcaacatatctttcttggcctgtttggaaagagaactgttgctaagattattgaactcgcaagggaaagttcttgtgtttacagctgtctaacgcggggcattattctaagcagatgattgcattgttatagacagacatctacgaggtcagtttttcctaaccactgtaataaatctaatgataaccagttaacttgacaaagccatttctcaaagcagcttcagtgtttgataaatacttttccttttctggaatttctattctagttattacatttgggagtagaatgcacacccatcacaaaatgcctagcctttaagctcccacggtggaattcaatataattaaaagcaacaagtatttaagtttctagtaatgccagctctatgtgaaaaatttggggaacatccaagaaatataagtcttgtaaatgatgtcctaattacgaaaagaaataaaaacaccttctccagttttccgtttccagtttattcatctgaggaatgctttctccagataggacgggataattgactcctttaacttggtaacccattctacagggaaacgggagaagtcctcccctgtggctcactctatatggccgatgccttcctttaaagagttcaaactgtagcaccttcatcacacctttggtttttgagctccaacagagcaaggtgattcaactttggaaatagaatgacagagagagactgggtgcagtggctcatgcctgtaatcccagcattttgggagaccaaggtgggaggactgcttgaatccaggagttcaagaccagcttgagcaacatagtgagacctcgtctctacaaaagacaaacaaaattagcaagcgtggtggtgcgtgcctgtagtcccgcctatttgggaggctgaggtgggagaatcatttgaacctgggaggtcgaggctgcagtgagtggagattgcaccactgcattccagcctgggtgacagagcaagaccctgtcacacacgtacacacacgcaaaaatgacagagaggcagaattctcctaagtggaaatgaaatacagaataccatgatttagttttcctgtagttctttccctaacgtttgacaatagctttccttttgggtgatcagtgtcctttggttttacctcatagccctgtgaggttgccgtgttgagtcttgttttcataccacattgacggtcctttctagtggcctgaaggtttttgttattattttgaaaagctttattgatatataattcacataccatacagttcactcatttgaagtggacatttcaatatttggaagcctattcacagcatatgcgcaaccattaccacagccaattttaggataattttttctttctgttttttactgtggggttttgcagtgaaaaccagaaaacctgctagacaaattccaaaagagctgtaacacgcgatttcagaacgtttaatcacctcaagaagaaacctgaaggatccttccgtcgccgcctctatctctgtcccctccagccctcagaaacaactaatctatgttctttctttaaaaaaaaaaaatctttgaagccttcataaatcagccctttgatttaaatctccatctcactccgccactatttttgatcaattcttcaccagagcttcatcttgacatgtgctctgccacagtgctaaggaacagagtgaccccccaccccactcccgacagaagcagccccagagagagaagcagagggtcagggtcagggtcagcaccgagtgtgctcgggtgaactgcaagtcttgacttagtcttgaggacctcctcagtcttgcaccccttccttcagcaacacctgccgggatgcgtctttcggcctcctctgaaatacaaaaacattttgtggtctagctgctcactgtattttcactctgtggttttctttaatttacacccctcttctactctgctggccttcaggatttttttatttttattcaccacactcatcagggaacaaatgcataatccttcatctggcttctgctgtcagtcagtttgaatcttggttgccttctcagccataaactttatcacctggcctcatgccttcggctttgtccttgattttggaagcgcagtgaatcaacattatttatctttgcagaaggcagtatcttaaccaccacatagtagcattaatctgtcacatcgtcccgaacatgcaagacactatttgttattgaagaggagacttctttatggaaggatattgtctactcttagtaaagtatctcaacttatgatccccaatacttccaagaagggtaagcgtgagagaagatacagttgggggtgtctggggggaggttaccgatggacaggttagcaaatagagcattgtaaaggagatcagtgaagtaagattttcataaaataacaggtagaattttggtgagttttccagttcaatttttaaccattccatattcaaatattgttttgaagaggcattaactcaggctttaaaaaatgttgctgaatcagtgtgcaggagggagaaaaataattttaaaatgtcgctgaaaaattatattcttctggtatgaaataattatatgcttctggtatgaaataattatattcttctgatattagaaagcctcttatttcttaaacaggcttaaactatttcaattaatctttctctatgcaatcaggactctaaggactgacatgaaactacatagaatccagtacaccttctgtttagggtcttttacttattcacaactagcttcttaaaaaagtcaaaccctataaaataccttataaaagactaagtaaacattgtactttacaaaaattttattatttttaaaatttattttttaatttttatccttacagaggaggtcttgctatgttgcccaaactggtcttgaactcgcaggctcaagcaatcttcctgccttggcctcccaaaatgctgggattacaggtgtataagccaccgcacccagccatacttttttgtgtgtgttattttttcgtttttgtttttttgagacatggtcttgctctgttgcccatactggagtatggtggtgcaatctcggctcactgcaacctccgcctcccaggttcaagtgattctcctgcctcagcttcccgagtagcctggattacaggcacccgccaccatgcctggctaattttttttttttcagtagagacagagtttcaccatgttggccaggctggacttgaactcctgaccttgaactcctgacctcaagtgatctgccctcctcagcctcccaaaatgctgggattacaggcatgaaccactgcacctgatccatatttttaaatttaaatttaagtttttatttttgagacaaggtcttgctctgtcacccaggctggagtgcagtggcaagaacatggctcactgcagccttgacctcctgggctcaagcaattctctggcctcagtctcctgagtagctgagactacaggtatatactattatgcccagctaattttttgtagagctgaggtctcactttgttgcccaggctggtctcaaactcctggactcaagtgatcctcccgtcttgggcttccaaagttgctggggttacaggcgtgagccactgcgcccagccagtactttatatttattgtgcctgcatttatatgggaacttcctgtcatatttcctttttaaaaatttctaaattcctaaaaccttaattaatagagcacatcgtcctcttaggttgtgagtccttctaagggaaaagcagtatctcctggtgtggtctggtgtggtcttaatcttcagtgtcacaagagcaagcctgcccccaccagcgccacagtgaggtgacacagaagagcgccgggcaccacgtgtttacttgcattcctctggtcccgtggaagcccattattcctttcctgaatcgtatctgagccaaaggccctatatggccaagattccctgttcggtgatgaaatgccagcacatgacattctttctaatgagtcacagtcaataaaaaatgttttctaaatgaatctgactatgtctccacaccaagcaacacagaagaaaagtcttatcaaaccaaaacatcttatcagctgagcccagacagacctttcagttttgcaagcaaggtgaaatgcgttcccacacaaagcgaaaacccagtctctccttagttttccttggatacatgtgttatatactatgaggaaatgagggagacatgtattgggaaatattttcagggtttggagactgatgagagattaccgaggagtttgtgtacaataataagaacacagctaaagacattcacttttgagagcctccatgtaaacattaggttaatatcacatgctgaacatgccttttttttttttgcaatgctttattttcattatgaacacggtctttacatggaatagcactgaccctattattagaagtggaaatctattagccatgcattttgttgttgttgttgcttctaaagagacttacagggggcttaggaaagccacaaagaatccccacggtgtgcacacatcaaccacagacaggttaacccttcaggctcagggaaaatgaacatgaactgaagaaataaaatgtaatgatcacccagaggttaactattaggtttactattacagtgaaagggaaaaataatcttaaaaaattttttatttattattttttatagagacaaggtcttgccatatgcccaggctggttttgaactcttgggctcaagccatcctcctgcctcagcctctcaaagtgttgcgattacaggggtaagtcactgcacttggcttttttttggagacagggtctcattgtgtcacccaggctggagtgcagtggcacaatcatgcaatcatggctcactgcagcctcaatctcctgggtccaagtgatcctcctgcctcagcctcccaagtagcttgggactatgagtgtattcctccatgcccagctaatttttgctgctgttgttgttttgtagagacgagggctcacttattgcccaagctggtctcaaacccctgggctcaagtggtcctcctacctcggcctcccaaagtgttgggattacaggtgtgagccactgtgcccagccagaaaaaagaaaatctgaaggaaaaaatacaagcaagccatgtatacacagttttgtcccctaaaactacggtacagaagagagggtataaattacaggactggcatccataaaattccctaaaggaaagatatacaacatctagggttcatctgtaagtcaaagcaaacccaagtcagaatgagatgaaggatttaaatatgaccaaggtgccaacatgtaaatgataccatagacaagtgagaactcatctgggccttgaacttgactttctctcaagtactcccaataaagttacccagtaaggaaaagaggtgggtgggggattaagttcttattggcccatcaagagtttgtttctttaaattatccattgcctttggtaataccatgtgcttctctttctgtgggagaaactacataatatccagagaagggtaactagaatggtggaaaagccacttcagtgagaaatggctgaaaaactgggcatatttaacaagaagagaaatctgaatgaggacaggagggctgccaagaatctttagggggaagcggggatgtgtgttctcctgcagtgctgcagaaggcagggctaggaccacaggagagctgccccacctttgaaggagctctctggggcagagttgatgatttagaagatagagatttattataaggccacaccagtggaaggtgaggacatgggaataaaaccaaaggtgaggtagagatagctgttaaagaatgtggacttcacagctttcgctgcctccatgctcttccccttccaatgtacctcatacgcatgccagtgttacttatctgctggtcagaatgtttattagctacccattacctactgaagtatgctgaaactccttttcctggtattcaaagctttctgtggttttacacttcttttccagccatatcatcagattaataattttctcatgttctccagttcttaaatgtgacatgcatttccctgccacattccttccctgcttaattccctgcctgttgaaaaccttcagggcccaccaaaaattccacctgtttcatgaaacctatgtagaggcaaagggaactttccttttaccttctgaaggttcaataatttgagtccctggaagaaactgacaatagacaggttaacaggagaaaaggcatacaaatttatcatgtgcctatgtgcacaggagccgcacaaactgtgactcagaggaggaccagctgactgacgcttttataccccacagaaaaaaaataggggctgggggctcctggagggtggtggtgatgagatgtgggagacagaggggcagaaatgcactgtgaacaaaggctgctttatctgcttataatgcagagaaagtgtctcaggcagcagacctcagaggaatacattggtagcctatggtaaaagtctctctgagcaagaggtcagacctttagtctattttcctgagttaagcttccctggctgatgattgcattcctctggaggaactcccctttagtcagataagagaggactagagaaagctcttctctgcgtttgcccctccgcaggtactctctgtttgaggtccaaagcagcatatttggggaatttttttctgatccccaacaccaaccccatccaacctttctttctgccaggggaatgcgctgctttcttcctgtgttcccagaatactctcatggtcttggtgacactgatccagcctatctttttttcttttttctttttcttttgagacagagtctcgctttgtcagccaggctggaatgcagtggagtgatctcggctcactgcaacctccacctcctgggttcaagtgattctcccgcctcagcctcccgagtagctgggacgacatgcgtgcgccaccacgcctggctaatttttgtatttttagtagagacaaggtttcaccatgttggtcaggctggtcctgaactgctgacctcaagcaatccacccactttggccttccaaaatgctgggaatacaagtgtgagccaccacacctgccctaccgccctgtgttttttctaattaggtatctgtatagcacttttttttttttagctcatacagtatttttacaaacacaagtattacctccctgggagagtagtattcccatttcacagataactcaggttttgagagtttaagcgacttaaccataaccatagagctaatacttggtaaggttggaattcaaactcaagttttttaacccaaagtgcagactctgcttcccctcacactgttgtgagggtgttttttaagtctaatcaatatgacagagattttcaaattctgaagtgctacccagatcaaaagagggttttatccattagactgcagccttgtggaagccagagaccaagtcattttcatctgtgcatataaatgcatattctcaggtccacccagacctgctgaatcagtgactccagggtggggtccagcagactttgttacaacaaagccttccaggtatctgctgcatgctcaaagtcagagaaccaaaactgtaagagaagattatcttttttctcttcttttgtttttgtggggcccttgtcctacagagactacaggggcattatgggatcattaacaagtacacaaacctcaattctcagaggagagaatcgctactagtgctgagtgagcaaagattttatcaggataaaaaaaatgtaaagactaacctggcaagattatgagctctaaggggtgttgtcttacctggaaggcaggtgtcaagtgaagctttgagtggagaaggcaagaagacaggatgttgaaaggaaaattctttatgggtgtcagaaaaactcatagggaggggaaaaaagatttattagggaattttaatatgagaaagaaatgacacttttgtaaaaaaggctatttactgaaaattgctgacagcaggcctttggtaaaagggtggaacaatggggaggaatagcagatgttgagagcagaagatgaagcactgaaggcaagggtaagccctgatctccggagaagagctttgagttcctgtgagcatttgattccggaaaacactaacatgagttcagctatagaccgttttcattttccctaaacaaatgcattgttctaaagaagaaaacaaatacatgtgaagggttcctggtttcttgaagctattttaaataatgcaaaaatgttggttgtgactctcatttaaaatgtgtccagaatgggctagcaaaaaagaggagcttgctaaagttcaaatgactgtgtcgatctaaaagaaagaagctgaggcctaaaatataactggaatagtttagccgaagtgaggacagctgctgggaagactcagccccaggtagccttggatatgaattccattcgatctttgttacgagcaggtttgtttgttttttgagacagggtctcactgtcatccaggctggagtgcagtggatcacggctcactgcagccttgacctccccaggctcagatgatcctcccacctcagcctctagaggagctaagactataggtgcacaccaccaggcctgggtaatttttgtattttttgtagacacgaggttttgccatgttgcccaggctggtcttgaacacctaggctccagcagtcctccagccttggcctcccaaagtgctgtgattacaggtgtaagccactatgcttggcccacaagcaggtttttaaagacaaaaaaaaaaaaaaaaaagtttgagtgacagggagtaggctgatacaaagttgtttgtcaggagctggcttacaggaataacactgattagtgattggctgtacattgttaggctatagggtgtggttatagtgtttgatgtggcattattaggttattttacagcgacttgtggtaatagaaagcagttttaagaggggagtaggacgtgattgctgtctcattttaatgtctccctgggcctgataatttaagaggacttgcattcctcagatcaaagtccatttattttctcaactgtataacccaagtagcctgactagatgtgccctgctagtgtctaggagcctctgttgtccatgttcatgtgatgtcctgacaggatggcttgtgatgagtctgccctctgagtgacagtgacatttctccttgcagcctggcagtaagaaccagttagcagacagagacgtgaacagcacacatgctaggctgcctagaggagatgaggcagagaggccctgacacttctccagttcctgaggccacactgcacacctttgtgaagtgcagcacccctgccctgattttcctgcaggttttcacaaggttcacgttcacccgttccaccttgctattgccttattccccattgtctcttgttttctagacgtgtctttgggttctagcagcacagagctctgagtgtggaatcgtcaccagtgtggaccttggccacttcttcatttgcccctcccccaaggcaccactctctcggctcctgcaggaacaagcatttagtgcagatatcagctaaatggggggtggagggcagcggtgcaaagaatggggcagacagcacagcccagaattggctactacttaagatttaatgctatactgaaatgttcactgacaaaatatgctatctggatttattagtccagtctcacactgctataaggatactacttgagactgggtaatttataaacaaaaaaggtttaattgactcacagttcctcatggctggggaggcctcaggaaacttaacaatcatggtggaaggtgaaggggaagcaaggcacgtcttacatggcagcaggtgagagagaaagcagggacaactgtcatttataaagaccatcagatctcttgagaacccacttactatcatgagaacagcctgaaggaaaccacccatgtgatccaatcacctcccaccaggaccctctgttgacacatggggattacaatttgtgatgagatttgggtggggacacagagccaaacaatatcactggagattctttcaagataattaatgggagaaaggtgagtgagtggggcattttagatgaaacaagattggctgtgcattaataattgttgaagctgccaagggtgcattgaggttctttatactagtctggttacttttgtacatacttgaaatttcccacaataaattattatttttttaaagtggatgctggaatccctcaggcattgccagctcagccattttctctccggccatccttcccctgatatgttccctgggatccctcttcccctctgctacccatttcttcactctctttctttctatggctctcagaattcttgtcttccctacctaaagggaacacttaaaacaactcccatttcttcctttcctcttcttcttcttttgtttttgtttttttttggtttttgtttgtttgtttgtttgtttgttttaaggagcagggagtttaataggcaagaaagaagggggaagaaagaaagaagctcccctgtacagagacaaagggaggggtgctccaaagccaagagagggaacccccacaactcccatttcttatgaaaaataagcaatttaattattctatgtctagacttctcattagcctgcactggaagaccaaataaacccattaatattgtttttctgagcaaaagttgttctctctgtatgaagaattctgccttcatcttagtccatctggaccctgcagccaacttttaaagtcactgtgtccccccaccccattagaactcttaatatttgtttaacctcagagtagaatggaaagcatgaatggcagatatttcttacgactccaggaagtgaagtttagtctctttctagaaccttccatcaggtgaggtccactatgagcctggtttagaggggaaggagaatggagaccctcacaatgtcctaagactcttgttttctttgtttttcttgttttcctcttactccttttaccagaacttctggcaagtaacatgttgactcatggtgttttatcacttccttcctctggctcacgtccagtagacatgctaatgagttgccaagtcaccagtaggcaggaaaagacagaagggcttctctgccatggaaacctgatcatctggtgttaatattctgaaaatgacattcacaaaatgagagttaagctggatgagaaggtatctcctgctttctggcatgaaatcattcttcctttgtttcctttgaagtccatatctgtgtaaaagatgcaacagcaggaatgatctgtacttcttgggggtcttaatctctgctgtgttgaaaggatattgaaagaaatggatgaggacctacatctgggctcctcatcttagaaagtaggcacctgcttgggaacacttaggcaaatggattctctccttccccatttcccttcaggggccagaaggtcggacagaaagtccacccttgaacctatctaacgtctaggagaaagtctttctagaaacatagagaaagtgaatgatgagatgcccgaagagtcataatagcaagagtccggtctagtcagttcagggtgaactaagacatggaatgcattggagaaaagtggggatgatggaatatcctaaattttgtaagtcataaaagtagggttaccagataaaatatggaatatctaccttagtgtgaacttcaggtaaacaacaaataaatttttaacataggcatttcctcaatattgcatgggacataagtatactaaaaaaatgtatttgctatttatctgaaatttaattttaactggggccctgcattttttatttgctgataaccctagaaaagcccagccaaacagagcttttatcgctccattgaatgtaacaagtggtcactgtgcatttgtcagggggaagcaaagtcaatgactgtggcaataatcccttatcttgatctactttcagtgaaaaatattacttcttttattccttttggaatgttgctaaaacaatggctgtgctctgacggtaacttccatccaaagatctcttattacatggtatctgccccctaaagaaagcataccgtaacaagagaaagcataccatctaggggtcaaaaattgatgtttatctccattctttttctttctgctttcgatgccttataaacttttatctctttattaaggaaaaatttaaacatataccaaagaagagagaacagtgcgatgaaccaccttgtactcagtatccagccttagcaatcatcaactcataatcaatactgcctcatgatgctcactttggcagcacatatactaaaattgaaatgatacagagttttgcatggtccatgttaaaaaaaaaaagcgggggggaagaatactgcttcatgcttggcacagtggttcatgcctgtaatcccagcactttgggaggctgaggtgggagaattgcttgaatccaggagttcaagaccagccaggacaacaaagcaagaccctgtctctatgatttttttttctttttttttgagacagagtctcgctctgtagcccaggctggagtgcagtggtgtgatcttggctcactgcaaactccgcctcctgggttcacgccattctccagcctcagcctcctgagtagctgggactataggcacctgccaccatgcccggctaattttttgtatttttagtagagacggggtttcaccgtgttagccaggatggtctcgatctcctgacctcatgatcaacccgcctcggcctcccaaaatgctgggattacaggcgtgagccgccgtgcccagcctaaaatttttttttttagatttagcctggtgtggtggtgtgcacctgtagtcccagctacttgggaggctgaggcaggaggatcacctgagcctaggagtcggaggttgcagcagtgagctttcgtggcattactgctttccagcctgggaaacagtgagattgagaccctgtctcaaagaataccgcctcatctattccaccacatttttgtccattccaactacattattttgaaatgaattccagagagctggactttattgctttgtaactttctacttctcactgtaccttttctttgcccgtagtggaattgtatggacagtggctgccctaaacctgaacattggttgccccacgtttatcattgtgtagttgcctgccttcccgatatcaaatccccaaatttgcattttccagcctcccttaactccacagctcagacactcaacttcagtttggaaagtcagaccttcttgctgcaagattttgactaggactcgggcttggaggaagcgggaggggttgggtgcatgccatcaggtcagctctgcaatggcattctgggggctgctcctggaagatgacccaggaaaatattcctccctctttttccaaggagtttgtgagtaccctaactacattaataaagcccttcctttacacactagctagagagattccactgacttttaccagatagctggactgatacaaaagctgatcattctaaccttctgaagaagctgaagtggagaggtgtacacaagcacttcagtcgctcaggagaaaaatgttgtgatttgtatgaatatgatgatttattaagtatgggtttatgggaccaccttatagcagtcgtttccaaaatgtaatcccccctgcatccccctccagcccaccaaccaacagcatcaacatcacctagaaacttctataaattcagattcttggacctattcccaagacctcatgaatcagaaatttgggggtggggcctaccaatctgctttgtaacaaaccctaggtgatttacatcagcaaattccagcctgagggctacattctgtgcccaccgctttttttgtttttctttctgtttttgtttgtttgttgctgttgttgttgttttgagactgagtcttgctctgtcacccaggctggagtgcaatgacatggtctcgacttactgcaaactctgcctcctgggttcaagtgattctcctgcttcagcctcccaaggagatgagattacaggcttatacttccatgcctggctaatttttgtatttttagtagggacagagtttcaccatgttggccaggctggtcttgaacccctgacctcaagtaatcacctgcctcagcctcccaaagtgctgggattacaggcctgagccaccgcgcccggccctaccatctttttttataaataaatttttactggaacacagccacactcattcatttatgtattgcctctctctgcttgtgtactaaacttgtagagtgtcgtggttgtgataaagactgtaatggcccacaaagcctacagtatttactatctggcccttaacagagaaagttcagggcccctaatttagattcactctaagtgatgagacagtaaaagttagaggaggagtcaataagaattaaacaggaatatgtgacgctaatttataacaaagtatagctgttgggattggtgtccataaaatggtggtctttccttagctgaggtctgtgagacgcagaacagcaggttttttctaacttgttaatggcagtctccatgctgaggacaaatttagcaaactcttatatgatcaagatgctttttttaaagtgtgtgcataagcatgcatgtgttggtttgtgtgtatctagaagataatctcttgagcaaccaggaggaatcacagaaaagagaattttatcctactattaggaaataactcccgtcctctttcaagtcctaatttgtttgtctagactgcggcatttaccatgaatgctaaaaaaacagggatagcgggccaggtgtggtggctcacacctataatcccagaactttgggaggccaaggtggacaaattgcttgagcccaggagttcaggaccagcctggacaagatggtgagaccaccaatgctacaaaaataccaaaaattagctgggcatggtggcctgcacctgtggtcccagctactcaggagactgaggtgggaggataacttaagcccaggagtttgagaccagcctgggtaatatggcaaaaccccgtctctacaaaaaatacaaaaactagatgggtgtggtgatgtgcacatgtagtcccagctactctggaggctgaggtgggaggatctcttgagccagggaggtcgaggctgcagcaagctgagatcacgccacgtcactccagcctgggtcacagtgataccgtctcaaaactaggcaaccgaccaaccaattcattctgtttgacccatagtttgactcttaagaatgcattgtaacaaaataagtaaggatgtgttcaatattatagcaagaagcctgttggtttcagcactgtttataacagtaaaaaatgaaaagcagcctaaatgtcctacctaatcaaagtggttaactgtgataaacacacattatagaatattatgtggccattaacatgatgttgtaaaaacatacatattggcttggataaatactcatactgttgactgagcaagagtgtcaaaccattattctgtatgttttcctgcaatggacttactattatgtatacccatttatatgcctacattataatctataagtgtacacaggaaaattctcaaaattttaactagttttaaactagttagtgctgggcggtaggattctgagtaactttgacctccttctcaccttctcatcttattttttttttaagttttttgaattttactttaagttccaggatacatgtgcagaatgtgcaggtttgttacataggttcatgtgtgccatggtggtttgctgcacccaccaacccatcatctaggttttaagccccacatgcatcaggtatttgtcctaatgctctccctccccttgccccccaccttcatcttatttttatttatttttaaattatatttattatttatttatttttgagatggagtttcactcctgttgcccagtctggagtgtagtggagcgatcttggctcactgcaatctccgcctcccgggttgaagccattttcctgcctcagcctccctagtaactgtggattacaggtgcatgtcaccatatgtggctatttttttttttttttttttttttgatttttagtagagacagggtttcaacatgttggccaggctggtctcgaactcctgaccttaggcccacctcggcctcctaaagtgctgggattacaggcttgagccactgcaccctgcccttatttttattttgatttttattttttatttttatacagtgatcatgtattccttgtgtaattatatgtgttttaatgcacacgcagatacagacatcttagtttggagatgtagcaacacatttcaatagataaatttagatcccctactttctgctcaagttgacataaatgtcctccccatgcagctgggtgggagcatcaggccccacaagggtttgaggttccctactttcacagagagggaaaggggcagattcaggtagggacaacacattaaggaccccttgcttcttcctcatttcctgggtgggatggtcaatcacaccagtatgcctggaagtgagggatttcccaggatacaagactttcagtacaaataaggaaaatcccaggcaaactgggtccagttgatcatcacattcctggcagatttaaaaagaatggcatatacgcctacaggtgcacagagctacatgtgtgactcacgctgcggtatgtggtttcatgagaagttacttatgaaatcattgctgatttctgatcctcatggccaggaaaggagacaaaatcagcagggttgaggtcagttcaaaaaggaggccttctaaccccgaagaaagcagaatccatttcaggagataacaccttctcttctctgcatttaacaccagtgcatgcatttgttctgtgtctgagcctctgtaaattaaaaaaaaaaaaaaattaaagtgttttctgaataattcaggtcaaattagccattcactgactcaatttcccactttctttgctgttaaacattgaactatttaatgtcgctgaaattgcatttacggtattccgttagctcaagttgtgcccattctgctaaagctctcgacattcttattatcattaaagagaaagaggaaaggaccaggagtggcgaccggcaaaccacagcttgtgtgggaaggaaatttgacatgtgatgcaagcggacgtttgtgtaaactgctgggagattaacagtgagtatctctctgtgtgttgcccatccacccatttataagtggtgggagagatggcgcagagggggagcaatgcccattcagccagtgcaagttgtgggctcagctggctgctagtcagtcatcctttgtttgaaagcagcacacttccttttcaccagctgagtcaggagctgttctcctgggtaatttcagagaatccacctcattgctcacatgcacgtcattgcctttggattgtagcatgctggagggtttaaccagggagttgacaatgagtgtctctgcagaacaggccaaacacattccctgaccaggtcatgcgggtgagttaataggttcactacgtgctcctcctaccctggagagcagcgtgacgttagttcctaagctgcagggttagcacgtacagtgttatgtggtggccttggctttagagttagccagacttagggtagaactgtggctcaaccacttcctcactgtgtgatatttggcaagttattcgccatcactaaggctcggtttcctcaaatagattagggaaataacatggttcccgcttcactctcctctttccttttcttcactgagtttctctcacctgtgcttctttgttgcctgtaaaacatataggccaaagggaaagatgattctggcatattccagaccattctcaccttctttaatttatttaattttaaaaatatttataaatagagatggggtcttgctgtgttgcccaggctggtcttgaactactggcttcaagtgggcttcctgccttggcatcccaaagtgctggaattatgggtgtgagctaccacacgcagcctggatctctttccagtggggaacttaagattcttcttccttttctgagaatgacttggacacaagggtttgcaaagtatgttccatagaccactggtggttcactgtggtcccctagatgatgcaaacttcagagggaagaaaatgccctatgaggaggaagcagagaggagccccactggctctgagtggagactcctggctctaccttcagaactccactcctggtcaccatcaaagtcctgcccggagcccacagattccaatcctatgctgttctccccacctcttcttcactagctgtacaaaatgacgaggtttgtgtagccggagcgatgccttgggtttttgttgtttcccaccattaggaaaaacagagggattaggtggcagagtccgcttagcttttcagtgaagaaatgaaaggtgtggcaggatgggttcaggtgcattttgctggtgggaatggaaataagattgggaggaggaggatgtgaatgtgaacaatgagacagattccctgaaattatccaagagaacggctcctgactcgaccgttggcaaagagggtgtgctacttgcaaagcaaggatgacggctgagatgatatcacatttgcatttttttggattgtcatcagtctcattgtgccatgtttccaatctgcacgtgtgcggatgtgcaaccgggagacacagacaggcaccaagagccagtaatgaaaatcccaccttctccttgtaagcaaaccttatccaaggacccaggacacttgcttgacccaattatgcagaaactccactgcttcttcctcctcctgatatgctgtgagagaggaaaggaagaggggccgacagagaaggggtgtggtgagctcaggtgcattttgctggtgggaggacaccttggtgccaacttgttctgtttctccagtgatgtaaaagcctttcaaagttctcattggttgacccaatcattctagttctaggaatccagccaaaggaaataatcagcaatgcagatgaagatctatgttaagggtacttactctagcttattgattatggtaaaatattggaaaaaaatctacatgaccaggagtggaaaatgaagtagaatacgttggaattacacagtctgtgaagatgatgttttaggagtattcgtttttaaatggaaaaagttacacatgcacacggttaaaagtttaaataggacaaaagagaagaaatgagaaaggaaactctctctggggtcctcctctatagataaaactatgtcctcagttatagattgtgctttagaaaagaaataggtgaaacaagaaaatggtttcaaagtaataataagtggaggaaagacacaagatcaaaaaacaacaacaacacaataaaacaatgaactttccagtataattgcaatttgagaggcttgagaggagagtaagacagagaagaaatattccaagctgtttctgagtgatgaaatttggggtaatatttattttctgtattttataaactttttatagtgtgtaatattactttctaatacttagcatttaaggagctagaaaattgcatttaagttcagaattcagcaagggacaccaatgatcttctgaaaatatttttttccaaaaatcaacagtctttatattaacacatatatgttcccctattttatttatgtgtaagtttaaaataatgctgcaagttaatttttcaagaacacccagaaattgcattttatctccctgtcggcccttcttcagcatctgacttaatcaccacatgcaagaaagttagaaaacaacaccacaagaaagaattcttggccgggagcagtggctcacgcctgtaatccaagtactttgggaggctgaggcaggtggatcgcttgaggtcaggagttcaagaccagcctggacaacatggtgaaaccctgtctctactaaaaatacaaaaattagctgggtgtggtggcatgcacctgtaatctcagttacttgggaggctgaggcaggagaatggcttgcacccaggaggaggaggaggttgcatcatagcactctagcctgggcaacagagcgagactctgtctcaaaaaaaaaaaaagagttcttgccattatttggtgatattgtgctcaaataaaaatgttttgcttattttgcatttcaatgtcaaacacagaagtctgaactttgcctttctataaatgaatccatcagggaagataaatttgactgtggttcttaggtcaaggtctaatgttatgagagttttcaaaagaatcccaagggaaagcatctgtctggttagcatatgacagcacttaagaacaaattattcccagtttccaaaaatgtgaaatgtacatttgggagtcaagtcaagtttctggatttacaatagtatttcagaatccatccacatattttaaagagacagacattcctaaatgccctctaaaaagacccagtaacaaaattgttaatttgtggatgttggaaagagctttctgaacttacgctgaagtgtgtgcatgtgtttttgttgttgttgttttgagacagggtctcactctgtcacccaggctggagtgcagtggtgcaatctcggctcactgcaacctccgcctcctgggctcaagtgatcctcctacctcagcctcccaagtagctaggactacaggcacgtgccaccacacctggctaatttttgtagtttttgtagagaaagggtttcgccatgttgcccaggctggtctcaaactcctgggctcaaacagtctgcctggcttggcttctcaaagcgctgagattacaggcctgaaccactgtgccccgcctgtgtatgtgtttcagcgatggcatccccacagtgtgaaggatcttaagtgtgaagacccttatttggagaggatttggaggggtgttggcttctcgttctgttcagaatcttcccgtctacaccattgcacacatggcctgtggtcaggctcacctctgagtctgggctggaatgagcaaatatcttgtttatagccacaaactggttcattggttaagtaggtgaagatgtcaggaaataagatttgctcttgtcatgggtaaacagatagggaacatcactgaagattacggggaatcaaatgagcaattgttttccttcggtctttctcacacatatcaacctcttcggatgcatgacggctgtgagctgagagcgctgagagcaggaaggaaccagggctgtgagcagtggtttgccacttggacaagattcagatttatgcttcttcataccctgagttcttgagaccagggatttatatttttagagatgtgttttgtcttagtttcctaggactgccataacaaagtaacagaccgggtggcttcttaggtcccagaattgtattggcttacagttctggagactggaagtctgagaccaaggtttcggcagggttggttccttctgagggctgggagggagaatctgttcaggcctgtctcctggcttctggtggtttgctgggagtctttggcgttccttggctcgtgggcccatcactctaatggttgccttcacgttcacgtgctgctttccccgtgtgagtatgtctgtctccaaatttccgctttttataaggacatcagtcatattagatcaagtcccaccctattacctcattttaacttaatcacctttttaaagaccaggtctccaaacacagcaggggtgaccaatcttttgacttccctgggccacattggaagaagaagaattaattgtcttgggccgcacgtaaaatacactaacactaatgaaagctgattagctttaaaaaaatcttaacgttttaagaaagtttatgaatctgtgttgggccatattcaaagccgtcctgggctgcatgtggcccaagggctgcaggttggacaagcttgaaacacagtcgccttctgaagtactgggggttgaaactttaatatgtgaattttgggggcatgcaattcaacccattacaaatatagacacaggtatatgcatacacctggataatatttttggaagggaagaccttgtctctaaaaaaaaaaaaaaaaaagaagaagaagaagaagaaagtaagaaagtttgtaaaacagcttaagactgtttatttatttttgagacggaatctcactctgtcacccaggctggcgtgcagtggtgcaatctccgctcactgcaacctctgcctcctgggttctagcaattctccttcctcagcctcctgagtagctgggattacaggcacatgccaccatgcccagctaatttttttttgttttgtatttttagtagagatggagtttcaccacattgtccaggctggtctcgaactcctgacctcagacgatccactcgcctcggcctcccaaagtgctgggattacaagcgtgagccatcatgcctggccaagactttaaaataattattttgtcaatggaagagctaggtgtgacttttacaggaagaagcctgtgtgtttaaagtgttacttatcattcaaaagcaaataaaggaaacttcttttttattttatctttttattgtggtaccctatacaccaatcagctagcttcaactattactaataattgttataaactaattttttaataataacaagtatagtagtaattatcagcaatttaaaagctttgctggagaatattatcaaatacaaatagcagacaaggcattgaggacaattgaaacattagctacggtgtttcttgacaagctccaatttctaaaataatagcatattacaatatgagcatgagaatcgtcgtggactctcaggacaaatccaagcaaccaggagagtctcctcaaggggcagaggatcatgccctcattctcagtgcagacttgggcagcattccaaaagcctctccaagagttaagcattgatatttgcctcgcaatccctctctctgcaattgctgcaagggctgagtctcaaacttttcaatccacgtacctctttgatgaggcaaaaaccctccccaccatctgccccacctgtttgctctgcgcacagggtagagagattggctctgttccctctccttctctgtgtcctgtgtgttgatggatgatgagtttccagcaacccaactgctcagaacaaagaccacatctccttttctctcttctctgtgtgctagttggggaacataaatgtgtttctcattatttggtctgttttacaatgtgagttcctgctggagttcactgctttggggattacaaggtatttcatctcctgtaggacgggcccttccctaacacttaacaatggcagcctgtctgaagacaggaaaccctgaagtgttttgctaaatttaaagactcagacaaatattaagattggagagatttttcctattttttaaaaaaacgtaatccttttatgtagctagtatgtatatgtgttacgggggttgggagagtcctgaaatgggtggtaggaaggatccaaagataattaattctcagcttaaaaaccattatggcacaaaggaaagagaatgggctttggagccagaaggtgggatatgaatcctgccgttttcctactggcagttgcaacagctttacttccatcagctgcaagatgaggattgtataacctgctttcttaggactggtgtgaagactaaatgagatgctgcatgagagcatctggcacgctgtagggcttcatgagtgctacctctttgaaaacacttttaaattttagattcagggagtacatgtgcaggtttgttacatgggtgtattgggtgatgctggggttctgttgaatagattgggtttgtattaaacccatcacccaaatagtgaacatggtacccagtagatatcttttcagtccttcccgttctctctacctctccctacttggagtccgtagagggctatctcttaataaaacctaattctgtaatggtaaggagttcagcattgcaaattcaaattggctacaggatgcccaaatccatgggacaggtcttttgttgttgttgtttgtttgtttgtttgtttgtttgtttttgagatggggtctcactctgaaacccaggctggagtgcagtagcctgataatggtttactgcagcctcaacttcctgggctcaagcctccctgcttcaggtgatcctcccaccttagactcctgagtagctgggactacaggcacatgccaccatgccgagctaatttttgtgttttttgtagaaatggggtttcaccatgttgcccacgctggccttgaactcctgggctcaagacatctgcttgccttggaatcccaaactgttaggattacactgcgctcggccaggacagatgtttatataatagaagtttgctctgtgtttaaggatcatctgtaggggtgggtcggggggcaaggcacttggccttactagcctcattaaagaaatgtttcgggagccctcgccgcctagctgcagggcactgggtcatctggaatatagaaatcataataatcccccttgcgtcataggctgacctgaggatcaaatgagataatgtctgtgaaagtacttgataagcctgaagcactgtctaaatgtattgctgagggcctgaggtagagaggacgtttactttgggccattcatgaggttcaagtacaaactctccattgcatggcattcagtgcagagcaaacacattctatttggctttagccttgaatgaaaagtcaacagtgccttttcagttgctttgcttcctctcttctcctttcaaaacaaagccaggtcctctaagggtttcctgctgagtttataaagaggtgctggattacaaatccagccccggctcccaggatcttggaggctggggaagagtatggcctcaaaacaaggggtgtctgaggacacctacccttggttcttcatcaagggattggccttctctcaagccttgaaccagggccaagtaccccagaagcaatgctttctttcccatggaggtagtcacaggagaggcaccatgaaagaacttggacaacgtcactgctggactgtgaaagggctcactgtgaggatgatcaggagggaggagcggtggcttggggctgacctcggaagtgtggtccagctgcctgatgttgattgtacatttcaggcatgctttgagaagaggcctaagtgatccaaagtcccgttctatgaaatgaaatgtccatctctttacttctattgccatcttttttttttttttttttttttttttcttttcagacgggatctcactctgtcacccaggctggaattgcatgatcatggctcactgcagcctcagacttttgggctcaagcaatgctcccgcctcagcctcccaaaatgctggattacaggcgtgagtcactgtgcccggcctctgttcccactttctgtctgactttctcctgacattcttcttttcttcaatctcacgcacccatcctgcagatcctaaatattgcctttatgatgggagtcagggctcttcactctctagacgaagccacctttcctacccaggtcccaaacgaacccattccctctctgcctttactcttctagctctcccgcttcctctggaagtccccctttcttctctcttcccatttacaccccctccatccttcaggaccctttgtgtgtgcctccccatgaagccttttgtgactattcaatccccagcgctttctccccgctttcatatgctacatattttttatattttttgtattactctttggcttttcatgattttctgttttttattcactcattaacagtcgagtgtttttgtgctaggcattgcatttggtactggggacccagtggtaaaccaaacaaacagggcctctcttcagaagtaatttatcatttagggccaggtgcggtggctcacgcctgtaatcccaacactttgggaggctgaggcaggtggatctcctgagtatcacaggctgagttcgagaccagcctggccaacatggtaaaaaccggtctccactaaaaatacaaaaattagccagacacggtggcgtgcgcctgtagtcccagctacgcaggaggctgaggctggagaatcacttgaaccagggcggcagaagttgtagtgagccaagattgtgccactgcactccagcctaggtgacagaatgacactctgtcaaaaaaaaaaaaaaaaaagagtaatttatcatttagtaggcagttaagagacttttttaaaagaaagaaaagaagaaagaagaaaagacataaacaagcactatatacatcataaagaatgtggattttattctgaaagcaataaaagccattgcagaagtttaaatttttgttaattaaaaaaaaatgcttaacaacccaaatgcccgtcaatcaaatagtggataaagaaattatggtatatgtatatacaccatggaatactactcagtcataaaaagaaatgcaataatggcatttgcagcaacctgagtggaattggagaccattattctaagtgaagtaactcaggaatggaaaaccaaacatcgcatgttctcactcctaagtgggagctaagctatgaggatgcaaagacatgagaatgatacagtgggccgggcacagtggctcacacctgtaattccagcactttgggaggctggggtgggctgatcacttgaggtcaggagtatgagaccagcctggcaaaaatggtgaaaccctgtctctactaaaaatacaaataattggccgagcgcagtggctcacgcctgtaatcccagcactttgggaggctgaggcgggtggatcacctgaggtcaggagtttgagaccagcctggccaacatggtgaaaccccatctctactaaaaatacaaaaaattagttgggtgtggtagcttgagctgtaatctcagctacttgggaggccgaagcaagaatcgcttgaacccgggacgcagaggttgcagtgagccgaaatggcgcctttgcactccagcctgggtgacagaataagtgagactccatctcaacaacaataacaaaaagaaggatacagtgggctttggggactccaggcaatggttgggagggaggtgagggataaaaagactacaccttgggtacagtgtacactgcttgggcaatgggtgcaccaaaatcacagaagtcaccacaaaagaccttattcatgtaaccaaataccacctgttccccaaaaacctattgaaataaaaaaaaaatttttaataaagaaatagaaaaaaatgttaaacagccttattgaggtataattgacttacagcaaattgcacatatttcaaatatacaatttggtaagttttttgtttgtttgtttgtttcagacaggctctcactgtcactcagactggagtgcagtggtgcaagctcggctcactgcaacctctgcctcccaagctcaaatgattctcctgcctcagcttcccgagtagctgggattataggcgcccccccaccacatccggctaatttttgtatttttagtagagacagggtttcaccattttggccaggctggtctcgaactcctgacctcaaatgatccacctgcctcagcctctcaaagtgctgggattacaggcatgagccaccacacccggccacaatttggtaagttttaacatctgtatatacccataaaaccatcaccaggatatgatgagcatatccatccaaccaacaaagagttcttgtgctctcttcttccttctccccaagtaagatttgaactccaatgctactgattagttcaacttttttcagaattttgtataaatcatcatacagggccaggcacagtggctcatgcctgtaatcccagcacttagggagccaggaggtttgcttgagcccaggagttcaagaccagcctggacaatatagtgagactttgtttctacaaaaaataaaaaattagccaggtgtggtggtgcatgcctgtgatcccaactactcaggagactgagttggaagaatcagttgagcctgggaggtcaaggcagcagtgagctgtgacggtatcattgcaatccagcctgggcaatagagcgggacactctctctctcaaaaaaaaaaaaaaaaagaaagaaacagaaaccccaaccaaataaataaataagcatacactatatactctttttcacgtggcttttgttctctttaccactgtagagcattccattgtatgatacagcaatttatttatccttttacctatcaatggacctttggggttgtttctactttttggttattacgaataatgccgcagtctttgctaacggtattggtattatggacacatgctttcatttcttttgggcagacaactgtgagtggaattgctgagtcatgtggcaaactaccagttctgttgaacctcagggccatcattctgttcatgtcagctcgttgtagaaccacatcgatgaagaccaagatggtaaagatgaaaaattgtagctaacatttactgcacatttactacaagccaagcattgcactatgaagtttaagtgcattattcattaaccccttcaataaaatttgtaattttcatttcagaagcaaatattcgtgttgtacaaatttctgattgccctaaatgtagagagactgatggggaaagtatgatgggtttgatttttatatcaaatcatcaggcatggagaaatatcttttagaagtgttaaaataaatgttcctactgtatatttaaaatacaaaaaatgataataataataataacaattcctctgaaatagttaccgtgaataccctcatttaaaatgaggaagctaagccttttcaaagttaagtaacttgcctaaggtctcttaacaactagcgaaaaggatagaactcaaacctaggtctttctgaccctgcagtttgtgtttctatccacggtgtaagtgaatgagtcaatgtatgctaaagtcaagactcttatcttctgttttgctttctttcagcatggacagaagcacattaacctagtcacaggtgccagtgaggggcattctgattagctgagatgttggtttcattttgctttactgttagtctaagaatctaaggaaaatataatgtgcaagatacatttggcaatcattttatagattttgttaaaactccataggaatcctttataaagttgtctaatctaaaatatatgactatatttaagatgcatttgtttgcttggtttagatggtagtttttttaaagggcctcatccatcaaaacacaataaatgggaattgactgtagaatcctgagaatttgtaatatttggaggcataatgacatagcagaagaatatgagtttgcaggtaaaagagacttggattgaatattcggtctgatgtttcacagtggaaaagctattgaaacctcattttctcgttggtagaatgaagatagtaatgcctatttaaagggtggttgtaaggattaaagaagatgacagacccgttacccggtgacacattagattcttggtgagggtcaggtcctagttcatttctagtcccccccgcaacctttttttttttttttttttaaagggatcacacctttttatcctggcttaaaatctaaatcccttcctgctaggagttggtgatccttcccaaactgtatgcaaaatttagtatgtttgtacatgttcattttgcgagaaaatatccctgtgtattagttccttttcaaactgttataaagaactacctgagactgggtagtttatgaagaaaagaggtttaattgactcacggttccgcatggctggggtagcctcaggaaacttacatttttggcaaaaggagaaggggaagtgaggcagacggcaagatgcaggggaagtgccacacttttaaaccatcagatctcgtgagaactcacttactatcaggagaacagcctaggggaaaccacccccttgatccaatcacctcccaccaggcccctccccatggggattacaattcgagatgagatttgggtggggacacagagcaaaatcatatcaccctggcttccatcagatttcaaagaaatccatgattcaaaggcaatttagaaccactgggagattgtttttcattcattcaacagtatttactgaatatccactatgggtcaagcgttttgctcagataaaccatgtccctgactttcaggaaggtacagcctagactggtgaataaaagtatgacctgttttgtgaatctgtgtgttatcacgctattattaggttggtgcaaaagtaattgcggcttttgccattgaaagtaattacttttgcaccaacttcatgcttacttgtatggagatgacacgtcagagagaaaggagagtacatgaaacaaaaagcagaagaatccagacagttgagtggacatgaaaaagaggccctgtaagcaaggaacaggcatcaagaaaataaaccttcctgactttgactgacagccagctgctatattaaggtgtaggattgtgtaggttctgccccacggaagtgccggccaagggttgagtggagagggttggggtggggaggtgaccagatgcagcttgagctcccttcaccaagctgggggccctgaagactctgcctacctggatagagtaactttttctaatatgcttcaaggtgctataagaggctgccagcccagtgtattgctgctacacagagagtcagattttcctttaggagctgagctgttaaacttgaaagtagatcaactctagttctgaaaaagaaaaaaaaaaaagtgggttctttggctctttgctcagttgatcccttagaggacatgatcaagataactaacagttgggtcactatgtcaacagtgtttggagaacaaaggaggtgtcattcagcctcacacctttccaggcagctagtaaggtgagttggaaaaatcctaatgcaggagaggaatttgttttttttgcatctcggtcctctcattttatagatgaagaaactgggacccaggatgattatttcccagccttttcttaagcatgcagctggagagtggatggtaaaggcaggaggccttggaggatttgttgtactcactatgagcacttgacaatgggaaggggcccctctgcagtggcactggctctcctggccctgttcacagtgtctagctccacccacctggcatatcttggggccagagcctgtgcatatttactctttcgagtcttgcactttgctcttttatttttactggccctgcacttgtgtttgctcttggtgctctcttcatacatattgcaggaggccccctgtttaacttgagcttgggactaaatataaccactgctatcaccagaggcatccatacatgtcagccctttttcagtgtttgtctgctccaccccaggtcgcaggcacggggcaggcccccgcgctcctttcataggaattcggttttaaatggaaactatcaccaaaagcaggggtgactggggccgggaagaaatcaattcttatcacaagctgcactcatgctttgtccctggtgtgcaaaagcccagtccccaaatctccaaacctctcttctccgtttaacagcatggtagatgcccctctcgctgactccatttccatcctgtgagccctttgaaaggaactgcaaagtgtctgtagctttgacatgtgcttttgtcttctggggccttccaaagcctttaggtcatgccacagacctgcaaaccatggttcttggacattgttcccacactgcacattgcaccaggagaagcttccacctcacctcctccaggaagctctctcccacactcctatcaacactgcccttgcctgtctatagtaatcgtggtgattaaaagttgcctgcgtggttcataaattattgtgtggtttttcatcttgtcaaaatgagagcaaaagcccttcattacttgaattagtgtcttccactcaccaatccctgatcccttttctcagtgctgagaaaacaggtgcttgccaatatctcactctcttgagaacactgaagaagattcaagctcgcgtttcctacttctctgaatacggtaggatctgctctgaccttcactgcaggctggggaatgccaggccagaagaggggcttggaggggcagctggagctcctagagagaaaagagggcacccgcccagccagctgaatcaacccgggataatgaaacagcagaactcgaaaccacattgttcttgcagcttccactgggtctgaaatcagatcctttacaatttcttcaaggtctacaagttcagaaactcactcctttgaaagaatactgcctgcagtgacatcattttctgaatcaatccctttttctctccatcccttctagcaattgtgagcacctgctgcgtacaaagctcggggttaacaagaagtctaagatgtactccttgtacttctagagcgtgctatctaggacaaaagacttatttaaagttatgttcaaaggaagaagaaaggacccttggataagtcgactgggctgctcttgggggctgtcagcagcaggggttatttcgggcacaaattcagggagagtgggtgatgatagagtaaggagatgtacaggggaaagaggaagggtttatttatgtgttcatttgtgaacttgtttcaaccccggggaaagaagcaagtggtgaaggtggagattgcaaataccagaaaaggcagaaaggaagagtacccgagactccattggagaaagagtcaatgcagtgtggcaggaacatggggccacacctcggacgcttctccatgaggacaggtcgtgattgttccatcagcctgtagatgcacagctagcagttttctatatggctgcccagctgctcaggctgttctccaaaaggtcttcttaggtcacgtgttggctgtaggtgaggactgggaatacgtcttgttctttgccctggatcctgtgtgtacaaggtcaccctcatgccatcgggactttgagtgaggacacagtgtccgacgccattcatggaaagaactattccggtcagggtacatctgaaactggctacagtttgctggtaggggtggcgtggggtagaggcatcagaatttgagagtctctctggcttcaacatctctactgcagacaattaacctcaagaggccccaggaggggatcttcctggtgccattaagaacacagagcatgaggggcctcccgtcttcaaggaggtggagctggctgtgagctcaaggtggggccttctgattttcagtgatttgttgttagaaccggaatttcagggtttttgcagcctggggtctatccaggcaggtgttagaaaactggaatgactagatcattaagtggtgttgagtgtggccatgccagagtatgaaagctttagcaggaacacagagcaggagcttatctccgctgcctcagtcggacacatgatattgcattagacataagctcaaagctcacatctcccttggaaatacacagtaacatctaaaaacaatgaattgagattaataaaatattcttggcttgtgttttaaatcaaattggaagtccagttcattttgatcactaatagatgctttttgctgttccacaatccatgcaaaataagataatatgttgtgtgtatagcccaggacctggtggacactcagaaatgctggttattttccttagtctcgtcccacctgttccccatagaagaaagtctgcaccccatacatttgaaaccctgcacaattttttccctttcttgtgttcaatcatatgtaagcactaattatgcgccaggccagggaacacaatagacaaagtccttgccctcatagaagttatttatttacttatttcttagagacagggtattgctctgttgcccaggctggagtgcagcagtacaatcattgtttactccagcctccaactcctgggctcaggcaatcctcccacctctgcctcccaagtaactggggttacaggcattcaccaacatgtccaactcctcatggacattataataggagagaaagtcaagaaacaaataaagcacagtactggcatgaaccagtaccatgccaggtaatgagaagttctaagaaaaaagtgcagcagggtcagaggattaagcatccgccttaacatctttactttacacttagtcaccaaaggagccctctgctagagccaggctcacatccagcctcacatagtacagagtctcttgaaggtcaaagtgtatgcatttcaactatttctttccataaaagccctccaagtcccctaactcagggatcccccagccccaggccatggattggtactggttcatggcctattaggaactgggccacagggcaggaggtgagcagcagtcagaagcttcatctgtattgacacccgcttctcatcactcgcattactgcccgagctctgcctcctgtcagatcagcagcagcattccattctcataggagcttgagccttattgtgaactgtacatgtgagggatgtaggctacacgcttcttataagaatctaatctctgatgatctgaggtggagcagtttcatccccaaaccatcccctgcccctaagtgtgtggaaaagtgaaacaaatccctgagaccactgccccaacccttgttttgcacatttattgtcatgttgtttttgattaagattccaatgcttcttgtatctgattctttccacttgggttcagttttcttctttagaaaatatactctttttcattgagggcctgtgaataatatattatcttagtcttaatttgtatatatatataaagagagagatggagtcttgctctgttgcccaggctggagtgcagtggcacaatctcagctcactgcaacctccgcctcctgggttcaagtgattctcctgcctcagcctcctgagtagctgggattacaggcacccaccaccatgcccagctaatttttgtatttttagtagagatggggtttcaccatcttggccaggctggtctcgaactcctggcctcaagtgatcaacccgccttgcctcccaaaatgctgggattacaggtgtgagccaccacacccggccttaatctgaatatttttttgtttcatctctatatttattcaatagtttagccctctatagtttctagattaaaattactttccacgagcagctggaaatattattccaccatcttctggtgtccatcgctgtcgctgagaagccttttgtcaggcgaattgttatgctctgtgtaatctgtctttttctctcattgcttcctcctctcctcccttctgtttttttttttttctcctctctctctctcccttttcccttgtatatttttaaggttttgtaaatcgtgtgtgtgtgtgtgtgtgtgtgtgtgtgtgtgtgttcagtagcttcagtacaaggcttcttgctatagatttggtttcctctgtcctgcctgggactaacatcttcaagtatgaattcttattcattctctcaaaactcaaatccggtgaaatgtcgactcttcatctccattactcttaacatgctgtaatattttctatctctttatctctctggttgcagagggtaatctgtgcatatattttacaatcgcagatgacaatgatctattttacaattcccatattcgctattcagttttgctgatctgcagttacgctgtgccctgcattttaatctcaatgatgagacttattcattaaaattctttttttaaatctttttttctactttcatagtgccttgttctcttctaggggttttgtcttctgtagatatgtatttaatcatttcaaacatttttctttcatattgtctttctgattgccattctgttctatcaagtctaattctcctgtttattttgtctgctcattcttggtgaatgaatggtgaattgttgtcttatgtattttgtaattttcaatttgtgctcttatatacattgtgtgtgtgtaaacatttctcatggcatgggttgtgagaatatccttctaatgttattatctctatttctgccagggactctatgggtatcacttaactaagacttgcttttttttttttttttttttgtttttttgagacagggttttgctctgtcacccagaatggagtgcagtggcgcaatctcggctcactgcaacctccgcctaccgggttcaagcaattctcctgcctcagcttcccaagtagctgggattacaggagcccgccgccatgcctggccaatttttatatttttagtagaatcagggtttcacgatgttggccaggctggtctcgaactcctgatctcaagtgatcagcccgccttggcctctcaaaaagtgctgggattacaggtgtgagccaccatgcccagtcctaagacctgtttttttttttttcttatgtttgttcctgaacttacgggttcctaggccgaataaataaatttgaatccttcatccatgcaaggtataggcttagagttccaatttttcaagagagactttatctctccacccagaaacagaaaaactttcttgtaataccttggtactgacgggtagatttttctagttgatcttataaccaaggaggcagctctagcagggttccagcttaatgcaggaatttcagttaccagctccatggttttatcaggctcaaagccttgctgaggttaacatgtagtctcaatgttggctttaagacgcaatgctacatagatccctagtgggggccctgaaccagcagccacagaagcagcatgttgtgggctgtcagaaatagacccttagtccccactgcagaatcagaatttttatcttagcaagacttatagatgactcctgtgtacattacagtttgagaagcaccacccgggtcacatgttttttaatgctcattcttccaacctctcccctagagaagttataatgtctctcatgttttttctgggctctttgttttaaacttctgtctgcatttttggaaacaagagatgtaattttctttcttgagagctcatctgtgcattgaaaaacatttttgttgaaaccttcttagttggccatattgccaggcctagaaatccaatcctactcattcttcaaagttaaactttaagcttttagcagtttcctatgctagcccctacctttgtgctttgtaatatagacactcaacaaactatttgtagcttttgcattcaaatgatggattagaaaaatgttctttatagtgaggtggtatcatttttgcttagttctgccccttctatggtattctcttttttaacataataccctctgtgtcccactatatactttttacaaagctggctctggctcaagccaaggcctcctctctggcaccatggaatttctgtagtgagataggaaaaatctattgtgctctcagagtcacagacactgaacagcacagcaggggccaggttatcagtggcctcttcttccagagttcctgtaggacagttggttatctcagcctgtgcccagtcagcctacacgtgggggtctgggtagtaaaagctgcagagaaagcagctctgtccagattcatttgattaactagacaggcacatcaactatacacccgttcattgcattgcagtatcctgaaactcaggggcacttgaaggggaagaggaagtagctcctgcctctggggtgcttgtaatcatatggtagtgagacacccatatccaaaagaatgagaagaaaaatcccaagatgttagagatgcaagtgcctcatagggaggtagaaactgtgtacacaatgctgagagaacatcaagtaaagagaagcaactccattggttgggacagagcaacatcatcccttgtttccttaaattgccagtaaatatttatcctctgcttgcttctgcttggggccaaatcattctcctttgttttagagagaaggaaggagcccctctgttctccccttcctgggaaattcatcgcaccaacagcggagatcttggctttttacactattttgggggctctgcttggcataaaataatacattccctgcctggggctaggacagattgctgcttttctcccacctcctgtagggtacatctggccaaccatcccgatcattgtttgcaaagcttctattcaaacatgtatattgttttatgaatggcaaaagaggaagccaacaataaccttaggtcttcatctgcttctttcatctgaagggcgggatgattctgtgaagttcccctccagccagtgtcccatgctctctgtttcctgggaagccaagatcatcaagatcatagtcttcttttgctcacagcacacccactcctggagtcccaaaccccattcctttctaaatcctactattcttaaatactctctttccctggtgactttgtatctgaatggattatttgaaacttcaatggtgccttatagtgttaggaattgtttttatgtctttctgacttacctccccaaatatattttaagctatttgaaggcagaggattcatagcatgtggcacaacggcaggcaagggcaagttctcaaagatctcaagaaagtctgttgagcccaaattcataacactgttagttatcatacataaggtcactcaccttccatatgatgcccaggttgttgtagaagtcatagtaaagaacgtctaaggacataggaatgtcttgttcataaaggtcagaggaataagccagactttctactgttgggggaggtgaaatgccacacaagtgcttacctgaacccagtacctccattgtcctgccaccaacagtttacttcctatcaccttctctcccatgtagaatcatcaaatgtcccatgcaactttctgatgttacgtacagacataccttggagatattgtaggttcagttccagaccactacaataaagcaagtataggctgggcacggtggctcacacctgtaatgccagcactctgggaggctgaggtgggtagatcatttgaggtcaggagttcgacaccagcgtggtctgaatggtgaaaccctgtctctactaaaaatacaaaaatcagccaggcatggtgttgggcgcctgtaatcccagctacttgggaggctaaggcaggagaatcgcttgaacctgggaagcagaggttgcaatgagccaagatgacaccaccgcattccagtctgagtgacactccatctaataataaaaaataaaaataaataaataaataaagcaagtattgcaataaagcaaatcacctgaatattttggtttcccagtgcacttaaaagttatctttatactatactaaagtgtattaagtgtccaatagcactatgtctaaaaaaagatgtacctatcatcttaatttaaaaatacttcaggccaggtgcgatggctcatgcctgtaatcccagaactttgggaggccaaggcagaggggtcacttgaggtcaggagttcgagaccagcctggccaacatggtgaaaccccatctgtactaaaaatataaaaattagtcgggtgtggtggtgtgtgcctgtaatcccagctactcaggagcctgaggtgagagaatcacttgaacctgggaggcagaggttgcagtgagctgagattacgccactgcactctagcctgggtgacagagtgagactccatctcaaaaaataaataaataaaaataaaaatactttattgctaaaaaattgctaacaattatccaagcctttagcaagtcataatgtttttgctggtgaagagtcttgcctcaatattgatggctgctaacttagcaggatggtggttgctgaaggttagggtggctgtggcaatttatgaaaataagacaatagtgaaatttgctgcgttcattgacacttgctttcacaaaagatttctctgtagcttgtgatgctgtttaatagcattttacccatggtagaacctctttcaaaattagagtcagtcctctcaaatcctgccgctgctgtgtcaactaggcttaggtaatattctaaatcctttgttgttgtttcaggaatgttcacagcatcttcaacaggagtagattccatctcaagaaaccactttcgttgctcatccgtaagaagcaacgcctcatttgttgaagttttatgatgagattgcagcaattcagtcatatcttcaggttccacttctaattcgaattctcttgctattcccaccacctctgcattgacttcctccactaaagtcctgaccctctcaaagtcatccatgatggctggaatcaacttcttccaaatcccggttaatgtggatattttagatgcatgcctgtaggcccagctacttggggaacagagatgggattatttgaggccaggatttcgaggctacagcgagctatgattgtgccacttcactgcagcctggtgacagagtgataccctgtctccaaaaatatttataaaaaagaaaaaactttaaaatgttgatattttgacctcctcccgtgacatgcaagaccacataatggcatctagtatggcaaatctcttccagaaggttcttaatttacttagcccagctccatcacaggaatcggtatgtatggcagctacagcctcacaaaatgtatctcttaaataagacttgaaatttgaaattactccttgattcatgggctgcagcatggacactgtgttggcaggcatgaaacggcattaatctcctgtacatctccatcactgttcctgggtcactaggtgcactgtcaatgagaagtccgattttgaaagaaaactttttttctggagcaatagttctcaataatggacttgaaatattcagtaaaccatgctgtaaacagatgtgctatcatctgggcttctttgttctctttatagagcacaggcagagtagctttagcatcgttcttaaggaccctaggattttaagaattgtcaatgagcattggcttcaactaaaatttaccagctggattagcccctaatgagagaatcagcctctcctatgaagccaggcactgatgtctcttctctagctatggaagttctagatggcatcttcttccaatgaaaagctatttcttctacatcaaaaacctgttgtttactgtagcaaccttcatcaattatgttagctagatcttctggataactctctgtaacttctatatcaatacttgctgcttcatcttacccttctgtataatggagatggcttattttcttaaacctcatgaactaccccctggtagcttccaacttttcttctgtagctccctcacctttctcagccttcacagaattgaggagagttagggccttgctgtgagttaggttttggcttaagagaatgttgtagttggtctcatcttctaagtagaccactaaaaatttctctatatcagcaataaggctctttcactttcttatcattcatgtgttcactggcgtagcacttttaatttcttcaggaactttgccttcacattcacaacttggctaactggagcaagaggcctagctttaggcctatgtcagctttcaacatggcttcctcactaagcttaatcattcctatcttttgatttaaagtgagagatgtgtgacgcttcctttcacatgaacacttagaaaccattgtaacattattaattggcctaatttcaatattgttattgaaattgttaacaatagcaattttgttaattggcctaatttcaatattgttatgtctcagggaatagggaggactgaggagagggagggagattgggggatggctggtcagtggaacaatcagaacatacacaacatttatcaattaagtaatcatcagattactaataaccaaaggcaaaaagaaaatcttgaaagtagctaaagaaaacatagtttacaatggagagcaacaatgtcaattatcactgatttctctgcagaaacaatggaggacagaagacagtggagtaacgtctttaaagtataaaagaaaaatactctcaatccagaatatctatatccagtaaaaatattcttcaagaatgaaagtgaaatgaagacatttttcagatacacagaatctaagataattaattactggcagatctgaactctaagaaatactacaatataagttctttagaataatggaaaagttatcacatcttaacccattgaggctggtacagcaaaataccgtacactgggtagcttgtaaacagaaatttatttcttacaattctggggcctgggaagctaaaagtgtcagcagatttggtgtctggtgagggcccactttctgcttgacagatgatgtcttcttgttatatcctccaccatatatatatggtgaaagaggcaactgagcttccttgggctcttttataaaggcactaaacccatttatgagggtcccatcctcatggcctaatcacctcccaaaggtcccgcttcttaatactatcaccttagggttttttcaacatatgaatcttagggagacacaaacattcagaccacagtacatagcaacttggaatttcaaggcggaatgaagagcataagaaatgttaagcatttgggtgaacatgaaagacttttcccctttaatttctttaaaatacatataactatttaaagcaaaaattaagacattgtttacaatgtgtacagatgtatatggatattggtaaaatgtatctagatacatgaaaactatatcaaaaagaatgggagagtaaaaggacctgtacaagtgcaagatttgtatatttcatgtaaagtggtgcaaaagtagccgtaagtaattaagaaagttaagagtgtatatattaatccctagaataatcactaaaaactaatgcaaatagtcataaataagaagccaatagatatattaaaataaaattctaaaatgtacaattaactcaaaaaaaatataggaaaggaggaacagaggaacaaaacacagatgggaccaacagaaaacaaatagaaaatagtagacctaaatccaaccacaacaataattataggccgggcacggtggctcacgcctgtaatcccagcactttgggaggccaaggtgggcagatcatgaggtcaggagatcgagaccatcctggctaacatggtgaaaccctgtctctactaaaaaatacaaaaaattagccggatatggtggcggccacctgtagtcccatctactcgggaggctgaggcaggagaatggcatgaacccggaaggcggagcttgcagtgagctgagattgtgccactgcactccagcctgggtgacacagcgagactccttctcaaaaaataataattattattattatattaaatattaatagactacgcattccaattaaaaggcagagatggtcataatggatacaaaagttagacctaatgaacactgcctatgaaagttacactgtaaatataaaaacactagattgaaagtaaagataaaagaatagaatagaaagagaaagatataccacatagacaataaacataagaagactgggtggcaataatatcagatgaagttgactttgaaactaaaattattaccagagataaggagggacatttcataatgataaaagtatcaacttatcaggaagacataacaattgtgtatgtgtatggaccaaataacagagcttcccagtataagcataccttgttttattgtgctttgcggatactgaattttttacaaaatgaaagtttgtggcaaccctgcatcaaacaagactatcatcaccatttctccaaatgcatgtgctcactttgtgtctctgtgtcacattttggtaatgcttgcaatgtttcaaactttttcattctttttagtgtaataccataaaccttgaataatatcatgagatccatatagagtgcccctagtgacactgaaattgctcccaagaaacagagaaaagtcatgacattacaagaaaaagttgacttgcttgatctgtaccatagattgagctctgcagctgtggttgccaccatttcagacagattattcatcttgtgaacaggcaatggaaacttacggtatcaatacatacagtacagtgctgtaaatgtattttcttctccttatgattttcttaataacattttctttagcttactttattataagaatatagaatataatacatatgcaaaatatatgctaattgactgtttatagtattggcaaggtttccagtcaaaagtcaactattagtagttaagtttttgagaagtcaaaagttatatgcagatttttgactgcatggcgggggtcagcctccgtaactttcacattattcaagggtcaactgtaataataattgcttatgtattctttgcaaggccctgtgctaaatgttccataaacattatctcatttggccttcccccaaacctttacattaggggcaagtattgttctcattttgcaaatcagtgagttgaaacctaaagggatcaagtaagttgtctctctgtcacacagctgagtgtgtttggaagcaagactaaaatctagatctgcctgacttgaaggccccttttcttatcagaatgtggtagatacaggttttatccatccttcctcacagacaaaaagtagcatggttcatggtcatgtaaatacacaccctgaatatttacccttctgatcaccttgtgtagagggaacatccgcatccaagagacgcctgcagtccagggggctccagagggagggagtcctgtggatgtggaagatacgcttttgtctgagagtcatgagattggactgtgggtccctgttgttgttaacccctgtgtgatcttgggcaattcactgttcctgtctttacctctacttgctcctcagtaagtcagagtgaactgagatctcttcctgaaattacttagcctaattctatggttggtttctggtggccaggaaccagaaataaatctctcagcaaaattttgcttatggaccatgaatcttagagtatccatggtatcactgatatctttaattcccagatattttccagtaatgaaattcatataataaagccaggatctctggttctt

SEQ ID NO: 443 - DNA, 17976 bp, Homo sapiens
acgcgcggaggcggggctgcggggcgcggcggcaggaactttcccggggacccctgcgggaaggcctggccagtaagcgcgcctctttggcccgaatcaacatggaaacctaaggaaaaacgtctgacctgcggaggtagtttgggtggctacttggtgttggacttggctaaataaataccagaggcagataaaacaagcgaggggcctaggtcaagagttccaagtttgttcctcgataaaaaacgacaaacgcggtcgggggcggtgatgcccgcctgcagtcccaacactttaggaagctgaggcggggggatcgcaggagttcgagaccagtctgggcaacataatgagaccatccccaccacctcccgtccttaattttttttaataaaaaaaatctttaagtgagaaatgcatctgtaatgtccttattaaccaaaaacgcctaagggataaagaagcacacgctccctagccaacgctagaggaacacaccccgagagctggtgctgtaggacccagttttcccgcgaaaacgctgccgcgcagggggtcagaccatctggaccaaggggggccgagcgaggcctacttctggtttacgcacgggcgctgaaagaagcggcactgtccccccctgccgatgcgcagtggcgcctcccggaggcggagccacgtacgagcgccgctgtgattggtgaggccccgccaggggcggagacgaccttgccgccggcgggaactctgggtctcgcggtttgggagcgctactcgccaggtggactcggagtccgcgagcgtcgtcggcaagcggccgcctttccacggtaaccgcgcgccggcggggagggcgtggcgcggagccgacgggaacgtccgcgctgcggagcagggcagggaagccgggaggcgggcccggcccgagcttgtccttgtcgcgcaggtactccgagcactatgtcgtccccggcgtcgaccccgagccgccgcggcagccggcgtggaagggccacccccgcccagacgcgtgagtcccccgagccgggcccactacagcccccggcgccgccccgtctgccctctcgccgcagctggcagcgctgggtgggtgcgcgggacccgggcgctcagcctcgggctgggcgctgccgcttggtgcgcacagacacccacagcaggctgtggcctgggtgctgcttaattcgattgccatttgcctctgtttggtttggttcagtggtgagtcataatgccccaaggaaaagacaaatccaggaaggccggccctgaaagttaatggctgtcttttctgttttgtgtgacacaagctcggagtgaggatgccaggtcatctccctctcagagacgtagaggcgaggattccacctccacgggggagttgcagccgatgccaacctcgcctggagtggacctgcagagccctgctgcgcaggacgtgctgttttccagccctccccaaatgcattcttcaggtgcgtgtctgaagatcttggttttgctgtgcttgatacacagctgatgctttatctgctcaggtttactggctttataacagttggcataacgcctaaagcatcccctctgcacgtgactgagcatgttcttaaccagaggagctgaacggagtgcagaaaatagtagttttagggcttagtgagcagaggaagcagcttctctggtgcttttttttaatagaacatttaagagtgctcagaatctcagccaccgcaggttgcaataaatattcagtttgctgttgcgattagatggtatagatcaacagacaacatgctgtaatttcaggtttgatatgccaccagaatttcctaattttgtttttatagctatccctcttgactttgatgttagttcaccactgacatacggcactcccagctctcgggtagagggaaccccaagaagtggtgttaggggcacacctgtgagacagaggcctgacctgggctctgcacagaagggcctgcaagtggatctgcagtctgacggggtgagtatgcagtctcctgaaaccatcttatggcgggtatcatgtgggtaactctgttttcatgattctgtcatgtttttctgtgtaggcagcagcagaagatatagtggcaagtgagcagtctctaggccaaaaacttgtgatctggggaacagatgtaaatgtggcagcatgcaaagaaaactttcaggtgagctacatgtattaaaattcttactttgggctctgaaaatgttgggagaccgtgtttataatctatatctaagtagccataatgactagaagggccacctgtggtggctcacacctataatcccagtactttgggaggccaaggtgggaggatcacttgaggccaggagtttgatagcagcctgaccaatatagtgagactccatctccaaattaaattttagaaaagaaaaaggaagaaaaatattatttatttctgtctcctgatagtgacatactcataactttgtgtgtttttagtagttgcctgttcccaaatgctatatgcctaatacagttttctctccacttaaagagatttcttcagcgttttattgaccctctggctaaagaagaagaaaatgttggcatagatattactgaacctctatacatgcaacgacttggggaggtaatcaaatactctttaaattcaagttacgtgttttaaaatagttaaattagcaaaatataacttgttcatttttattttctagattaatgttattggtgagccatttttaaatgtgaactgtgaacacatcaaatcatttgacaaaaatttgtacagacaactcatctcttacccacaggtaagaatttagctttgaccttgatgaattttagtaacagtctagaaagaatgtttccagataacagaaattcttcagtaatgaagatagtatgcgcaaacactttaagaaactgagtatcatctcctttggcccggtgtggtggctcacacctataatcccagcactttaggacgccgaggcaaatggatcacttgaggtcggaagtttgagaccagcctgggcaacaaagtgaaaccccatctgtactaaaaaatacaaaaattagccagacatggtggtgcatgcctgtagtcccagctactcgggagtctgaagcgatagaatcacttgaaccccggaggcagaggtgcagtgagccgagatggcaccactgctctccagcctgggcaacagtgagattccatctcaaacaaacaaaaaaaaactatgtatcatctcctttaagatgaacatttttttttcacattttaatgttcctgaaagtgggacttgtattactatcaatgacaggttatggtttacttggcagtgtttttcatgtagaaaaatgatgaatcttaaaactgatagcttcttgggtttcatgaagtaagttatcttaaatggaaatactttaaatgaattacatacttcctgctgctttgaaagaatatattgtactgtagacttttacttctaagcctcaggtcagtttctattaatgaagtatcagctctgttgactctgggtgtagtctttggaggcaagcagacttggtttttgaatcttggttttgctgattactggctgcataaccttggtcaagttccttagccaaccaaaagctgtttcctcatctgtaaaatgggaaccatatgttaagaaatttgaataaatatgatttaacttactttggtatcgccaggcacggtggctcatgcctgtgatcccagcactttgggaggccgaggcaggcagatcacctgaggttgggagttcaagaccagcctgaccaacgtggagaaaccccgtctctattaaaaatacaaaattagtcaggcgtggtggcaaatgcctgtaatcccagctactcgggaggctgaggcaggagaattacttgaatcccagaggcagaggttgcagtgagccaagatcatgctgttgcactccagcctgggcaacaagagtgaaactctgcctcaaaaattaaaaataaataaataaaaaacttactttggtatcacttcattatagaaggaaaataaagtgtgaggtcaaaatctttttcccttctaatagaaagcaaagaatatgccagtatacatcaagaaggcactttcgtataaattatgaaatttaacccaattgaaaatatgcagaaatagatagttcagcatacctaaatttgaaaacagcacgtgcatgattctgtagggtaatactttggggacatgacatgttgtctttttatactttgctaatctgacatgcctttattatatttaacactgagatatgaatacaaatacatcttcatatttgtttttacaggaagttattccaacttttgacatggctgtcaatgaaatcttctttgaccgttaccctgactcaatcttagaacatcagattcaagtaagaccattcaacgcattgaagactaagaatatgagaaacctgaatccagaaggtaatgtatttttcataggattacttttgttgaaggaaaatgccttacatgaaaatagccttgttttcattgagaaattatgaaagaagtaattggcggtggtagtcaaggtgacggattataaattgacaataatatagattcagttatcctatatacttatgaaccccctatactttttaaatttaattgaagtttctgatataagagatgtgactattggccgggcacagtggctcacgcctataatcccagcacttcaggaggccgaggcaggcggatcacctgaggtcaggagtttgagaccagcctggccaacatggcaaaactcctttactaaaaatagaaaaattaccagggcatggtggcacacgcctgtagtcccggctactctcgggaggctgaggcaggagaaacgcttgaacccgggaggcggaggttgcactgagcagaggctgtgccattgcactccagcctgggtgacagaatgagaccctgtctcaaaaaaaaaaaaaaattagattttaaagatttgaggatcacttgaggccaggagtttgagaccagcttgagtgacataagagactccatctctttttaagaagaaattagcaaggcacagtggctcacacatgtaatcctagcactctgggaggctgaggtgacgggcttacttgagcctggcaggttgaggcttcagtgagcagtgattgcaccactgtactccagtctgggcaacaggttaagaccccatctcaacaacaacaaaattgtagaggtctcatgaatcagtggcaggatagggtgatcttcacggctagcagtggctaaatacaggccagaacagggtagcttgtctgaaaccagcaggggaaattagttgcgggcagtgggaccttcaaagggaaaaagttgtctgtcaggaaaggttcaaataatagaggaaacgagcaagagtgaaagatcagagcatctaaggggttctcctgtgtggataataatgactttaaagtatagaggactttttctctaccaggtgctcttactaggcttgaagtacattggcacgttcagtccttggctctgggataggtgctgataccaccccattctataggggacacaaaatgtacacagaaaggctagggtcaggactcagtccaggctgtctggcttttttcctgacacagcagggtgtcatacaggaggccaggtgagtgaggcaggaggcagggagcagggtaggcagacaagaagggaacgagggatgcctgctggacaggggccctgaggaagaagggccagaggttcgctgggcttgagagtctcctgaagacatagcctgcagatgactggacacagaaaggtcgccctaggcagagtcttgggcacctagctcctgtctgtgatcccagctattcctggacctccacacctcaggtcaggtgtgctgacctctcttctcccctcacagacattgaccagctcatcaccatcagcggcatggtgatcaggacatcccagctgattcccgagatgcaggaggccttcttccagtgccaagtgtgtgcccacacgacccgggtggagatggaccgcggccgcattgcagagcccagtgtgtgcgggcgctgccacaccacccacagcatggcactcatccacaaccgctccctcttctctgacaagcagatggtgcgcagccaccctggccccccaggctatgctttgcctgtctgtatcctcaaaaggccaactataacttgtccctcggaccctgagcctcacttcccgaatggcatccatccctctctggtcttgtgggtttcgttagtggcctatgggctaaatatgcagagcacgcaaagcccctgcttcagggcactgtccctgtgctgttgccagtggcactgtctgttgttagagacactgtattttcatggcctaaaatgcttcaaacgtttgagatgagaatacttggttaaatgtcattctgctttttccattggtaaaggattgaggaatttttctgaaattttttcacaaattttactgtctaagaagtttggtcttttttctctatattcatgaaattttaagatgaagttattaaaatgacagaaaaaagtgaggggaaggtagaaaattgcttatttaccgtgattgtgactgtaaagatgtgggaggacaggatttgagtttttctgtgactgcgtgtgcatggtttctttaatgttgcatgggatggagagctggagacagaaaggcaggcaccctgctccgcaggagcacatggcctcctattctcagaatcatgcaggcccccaaagtggcttagagaaaagcccagcatccttaggcctctcagagggtacctggtttggaaaggccttcctcgaccctgctttatgaaaagcatctcagcttcccccaccgcagctccctacattccttcccctgttttgttgctgtctgttgcagcaacttctttagaagaagtaatttctaaggaaataatgagaaacatggacaatcatttatgtggggatatgcactgcagccttatatggcaaaagcagtacaaagacatgcagattttgtccccctgccctctctttgtggcccacatgttctctgtttgctgaccttcagatcaagcttcaggagtctccggaagacatgcctgcagggcagacaccacacacagttatcctgtttgctcacaatgatctcgttgacaaggtccagcctggggacagagtgaatgttacaggtaagagtgtaggtttgcaccagcacttgagcatgtctggcttgctttcaatgctgtgctttagtgagtcattggacttggtcacaggtccagttctacctccagttgtcactgcttgtctttgagactgtggggtatatccctgctttatctgccacctttttaactgagtaccatggcccagcagtatgaaattgttcagttcttcccaaacttgaatgttggagctcatggttcgtgtggtcactcgcctcttgatacctcagtatcctggagctgtgtgtgtctcaagtcagtactgttggcatcatgagagagcagcctcagacaggcttgtatgggtaaagttttgagttatgccatcagctcagagaagtattactcaccaatgctggagttttaagtaatttttacttaatttcccaaatgtatagccaagggttaacatttgtttgttacagagaaaaatgagtcagtgacttgtttccatgtgtagaagctgaggttcagggatgcatagacagcagtagctcagatgccacggtaaatcagaacccaggacccaggtctccttctcttgctgccacaagagtgctctttgcacagcaccatatgagtgtggcagtcctccttttgatgctgtagagtcacaatggattttggttgggggcaagggagtgttgatggcagcacggttcttcattgatgggcaaggtggcgacggtcgcggagtgcctgaatctgctcctgagcggagggcctggggcacaccacgcatcggctcttgtcttcagtgaggcagtgctcaccctgtttcttccccagtgtgaagtcccgcagttatcactggcaatcttccgtcgtaaaagtacttgaagtcatggagaatttgaaagaatgcgtagtttttagtgagtgacgtgcgcatttccagtcctgctaccctgaaacctttgataaagtatttagtccaatatttttgtttcctcacctacaaagtggagttaatgtgatgatacatgtgtgagagtgtttggggccaaggggctgtggaaagtgctgtgtagatgtgaaataagtatcaatgctgctctgtgagataaatcattccgggccactttaaacataatcttccatccctagcctatattggagtgaagaatagtgtgtattctaagaatgtgtgtaaactggtttgttgtgttaaacaagaattacactgacccactgaataaacaaggacagtgctctgtgccattgcgttgagatagctgtaacggggaaaggccaggctttctccaaaagctgcaggaatcagcctggagttaaagccttctggtttgaaatccagaaaagacgaacatcagatcagacctctgtatgtgaggagcctggcttccagaagaatgcatgatttgcatgcttttgtcgggggtggtgggtaggttggggggacctagtctagttttaatgactggaggattttagcattttgttgcagtcaagtaagtgctaggcagattctgtacactcaacttagggaagtaaaaatactgcttattaaaaacaaccacgaacccagcattgagctagaagcacagcagctccatttcaccctcagggtgactgtgcccgtgggcatgctcacgtagctacagttgccctggagcactgctgactagtgggcccaggtgaacacgtcctcgggtctatcatttgcagaaacctgggttctttctcttttgttttgttttgttttgttttgtttcattttgttttgttttgtttttgagacggagttttgctctcgtcacccaggctggagtccaatggcaccatcttggctcaccgcaacctccgcctcccaggttcaagccattctcctgcctcagcctcccgagtagctgggattacaggcatgtgccaccacgcccggctaatttttgtatttttagtagagacagggttctccttgttgattagggtggtctcgaactcccaacctcaggtgatccgcctgcctcagcctcccaaagtgctaggattacagacatgagccaccttggttctttcgagcttgtccgtttcctgctgctatttccctgcttgctcatagcaagcgggagctttgcaatgtgggcctgagtcctgggcttgggagggtcatttaagagacggtggagctcaccctttccagggccagcccgacgtggtgcctcgctctgaagtgcacctgttgcctacgctggttgctgagccactcggaggaagatatgggaaggtaaaagtgcatctcctggttgtgccctcaggcatctatcgagctgtgcctattcgagtcaatccaagagtgagtaatgtgaagtctgtctacaaaacccacattgatgtcattcattatcggaaaacggatgcaaaacgtctgcatggccttgatgaagaagcagaacagaaacttttttcagagaaacgtgtggaattgcttaaggaactttccaggaaaccagacatttatgagaggcttgcttcagccttggctccaagcatttatgaacatgaagatataaagaaggtaacagtggattttaaactaggggttgggatttacaattctttgggatcaaatagtataaacatccactccgccactcgagccatccgccataaaggacagagttgtggcctgttagagcaagtgctggcaacctgacttgccattggttgagaagaatcatagcattgtctatcctcatctctggtctaaacttaggtttctaaacagaagaggccacacagtgtcagaatagggacttgcatggccaccattctggtgtaatgataggtgctgatgaactggtcagtgataacttaaagcatatcaagcactttcacgagcctttttataccttcctgtgatttcttaattgtagttctttataagagagaaaagtacctctaaagtttaaactacatctcagttaactgtgcagaaaatgaatgtttagacatgtctctgattatttagggaattttgcttcagctctttggcgggacaaggaaggattttagtcacactggaaggggcaaatttcgggctgagatcaacatcttgctgtgtggcgaccctggtaccagcaagtcccagctgctgcagtacgtgtacaacctcgtccccaggggccagtacacgtctgggaagggctccagtgcagttggcctcactgcgtacgtaatgaaagaccctgagacaaggcagctggtcctgcagacaggtgctcttgtcctgagtgacaacggcatctgctgtatcgatgagttcgacaagatgaatgaaagtacaagatcggtattgcatgaagtcatggaacagcagactctgtccattgcaaaggtgagtcgccttctccaccgtgaacatggacgtgtttaaaatatgtggacccttgaaagacagggtctgtggaactgtgctgtgctaccttggttctaacttggggagattgataagtgctttccacatcatatttcagctaaatctcaacatgtcttctacagggtgtcacgttttgtctttattgctgtactagccttgaatttgtcctaaagctcttgcaaggtgcctgcttcctgagaaagatgtggttatagcacacattcatctaaactcagtccttggcatgaatctgaggacagggcttatccaggtgaactgctgaagtcagtaaaggcaacatggctcaggcaatagaaactcagtggagggaatatgggtttagtaggtggccgggcgaagacggtgcttgttaattgccagcgtcagggagaggcttctaactgcactctttgctctgataggctgggatcatctgtcagctcaatgcgcgcacctctgtcctggcagcagcaaatcccattgagtctcagtggaatcctaaaaaaacaaccattgaaaacatccagctgcctcatactttattatcaaggtattaaaacagatttttattttgttcatttgtagaatattcagggtgagattgaaaaggagctactaagatttcagcaactgctaatggaaactcttcactcttatcaagatgtttcaaatttggttggtcaagagttttcacgacaaggatgatgtgtgttctcatttgttttttaagcagttgggatgtttacctcccacgccgtttacacatggctgtcactcactactcttagtcctaaagccactgctgagagtcaacagagaacaattccgtacagtagatgaggctctgaaaagttagatttattaaagtgcaatcacataatcttcactcttggccccactacaaatattggacatttttcataaatggattttaggttttaattacttgcttttttttctttttttttgacagaagttttttttcccaaaaaaacagttgaatgtgttttcattcaaatctttccattgtcagccaggtacagtgactcacacctgtaattccagcactttgggaggctgaggtgggtggatcgcctgagctcaggagtttgaggccaccctgggcaacttgatgaaaccccatctctactaaaatacaaaaaattagcccggcgtggcggcgcatgcctgtaatcccagctactcgggaggctgaggaggcacaagaattgcttgagcctgggggagtggagattgcagtgagctgagatcataccacttcactctagcttgggctacagagtgagactctgtctcaaaaaaaaaaaaaaaaaaaaaactttccatcgtcaaaattatagtaacgtttccctaagggaagacttcctttgactcagctgattggtccccagccgttccctgggccgacctaaggactagggacagcacagggtgagtggggtgagtggatggacacgaaggccctttccacaccaggcaaagatgcttctccctgatggcgctcacagggtgcacattgactgcacatctgtggtgctcaagcagtctttagtacgtcgtttgtaggtgtattggtgtctcaactaggaaaacagtttttttgttgttgttttgggtttttttgtttgtttttttgagacagagtctccctctgtcggccaggctggagtgcagtgacgcgaacttggctcaccgcaaccttcgccttccaggttcaagcgattctcctgcttcagcctcccaagtagctgggattacaggcaggcaccaccactcctggctaattgttgcatttttagtagagacaaggtttcaccgtgttggccaggctggtctcaaactaccaacctcaggtgatccacctgcctcggcctcacaaggtgctggaaaaacagtatttttactttgttttcttaggtttgatttgatcttcctcttgctggaccctcaggacgaagcctatgacaggcgtctggctcaccacctggtcgcactgtactaccagagcgaggagcaggcagaggaggagctcctggacatggcggtgctaaaggactacattgcctacgcgcacagcaccatcatgccgcggctaagtgaggaagccagccaggctctcatcgaggtaaccctgctgaaaaaaggcttactgtgcctgtagcccacagcattaatgtaactgaccaatcatctcctttaaaatattaattattttgttacgaataacatactgttctcttccttgttttgagacagagcctggctctcttgcccaggctggagtgcagtggcttgatctcggcttactgcagcctgtggcctgtgcttctgggttcaagcgattctcctgcttcagcctccctattagctgggattacaggtgcccacaaccactccggctaatttttgtatttttagtagagacagagtttcaccgtgttggccaggctggtcttgaaatcctgacctcaagtgatgcgccagcctctgcctcccaaagtgttaggattgcaggcgcaagccaccatgctgggcctaagaataataaacttttcttttttttttttttgtgagacggagtctcgctgtgtcccccaggctggactgcagtggcgcgatctcggctcactgcaagctccacctcccggattcacgccattctcctgcctcagcctcctgagtagctgggattacaggcacccaccaccacgcctggctaattttttgtatttttagtagagacggggtttcactgtgttaggatggtctcgatctcctgacctcgtgatccgcctgcctcggcctcccaaagtgctgggattacaggcgtgagccaccgcgcctagcaatatactattttttataactgtttattacttcctcccatattgcaaaattgatctttccaaatgttgcaaaagggggaaatagttcatttatgtaggtagtacacacactttatatgtttaagtacttacaagcatagtgaatttaagatcaaagacctggtttcaaatagaggcaacactacacagtaatttggaaactgaaaaagtcatccagtttctgtaagcttccttttgcttgtaaaaaacagaatgagctgtcttttaggttcacttttcagcatcctggtacatgagctgaagtgcatgatggcacatttaggttattcaagcattgtgatattaagaaggttcctggtgctttgatgagctttgcatcctaactgagctcctaaaaattctaagatgaaagttacagacattatgtaatttttttgtgtgtcatagtcttgggggttgttaatgaagaaataagactgtgtcatctgtatgtgaaattgatacaacttacctttgcagcattctcccagcaatccttatgagccccattgtgccccatgtgagcacttttcccagacaggcctgattctccctatgagtgctcacagccttctcctctccccacatgccacattccttccctctgccacgccatgcccgtctctgttcttcagagctacgttagatgccaccctctccaagaattcttcccaagcatctcccagttggaatatgttcacccaccactgcacgctgcacgttgatgtcttcacctgcgatttctgtggtctgtctgtgtagtctctaccacttgatgagctccggggcccaggaccatatctgagttccgtttacttaatggaagcctaagtgttcaaaattcacccacaaaactaaagttgtcaccaaggaggtttgcttttgcttttgtttttctacctacaataggcttatgtagacatgaggaagattggcagtagccggggaatggtttctgcataccctcgacagctagagtcattaatccgcttagcagaagcccatgctaaagtaagattgtctaacaaagttgaagccattgatgtggaagaggccaaacgcctccatcgggaagctctgaagcagtctgcaactgatccccggactggcatcgtggacatatctattcttactacgggttcgttattttcagtgaacagaaaagcttttgaaaattatttcaatatgcatgtagtttatatgtcagatttaagctaacagttaaatcatttgaaacagaagttcttaaccttttttggattaggacccctttgagaatctgatgaaagttgccctttaatcttatcttgataaaaatattgattaacacacacagttttgtgtatagtttttttttgttttttttttttatactttaagttttagggtacatgtgcacaacgtgcagtttagttacatatgtacgcatgtgccatgttggtgtgctgtacccagtaactcgtcatttaacattacgtgtatctccaaatgctatccctcccccctccccccaccccacaacaggccctggtgtgtgatgttccccttcctgtgtccgtgtgttctcattgttcaattccagttttgtgtatagttttaaggagattctgtctccttgactgtctgggaagttttgttaacccattttagagaagttgtttgtttcttagcagcagctgcttgctgcacagatgtgtagactgttaaggaaagcagcagctagtggcttacagaaatttccaaataattaaaaactcattcccttcaaatgtactcagcccctgtcgccttatctttctaggtgatactactaaaggaatatttttgagaatttgaagcatttcatttcataatagcaaaaatgttttcattgatttctttttaaatcagggatgagtgccacctctcgtaaacggaaagaagaattagctgaagcattgaaaaagcttattttatctaagggcaaaacaccagctctaaaataccagcaactttttgaagatattcggggacaatctgacatagtaagtgtttatatgtattttttgtttgatagagctttctctttttccttaatattgcttttgggtttttttcctttatttattaaataataaatatagagaagaatgaagaaaaggaagatgaaccataagccatcatcaagaaataatcacaattaaaatttttggctgggtgcagtagctcacgcctgtaatctcatttgggacgctgaggtgggcagatcacttgcagccaggagtttgaaaccagcctgaccaatatggtgaaaccctgtctctattaaaaatacaaaaattagctggatgtggtgataagcacctgaaatcctagctactcaggaggcttaggcaggagaattgcttgaacctgggaggcggaggttgcagtaagctgagatcccaccattgctctccagcctgggcaccagagcggaactccatctcaaaaaaaaaaaaaaagaaaaaattgttatgcccctttcatagttgttataagtttgctttaggtatgaaatatttgggtgtccttttgtaaataagtaaggtagttgtttagtgaaaagaactatgcagtctttcagtgctggtccactttccatcgctgtgttgtgactgagagggcagagttgatagttacaacgtggactatacagatgccaagtctaccacatggaccatctggctactccactcctgatttagagcataaggcatgtgtacagccaccaaaaagagaaagattctgggtggtactttaacattataattattgtgtttctaacaggtaaaggagggacttgacgtgtacaatatttattttctttctcttccccacaggcaattactaaagatatgtttgaagaagcactgcgtgccctggcagatgatgatttcctgacagtgactgggaagaccgtgcgcttgctctgaagccttgtgagcaaggaaggctccctgcatgtcctgcttgctgcacgccacatgggtgtggtctgcatctcagttggccgccatcagtgtaaatagagcttaaagtcatggtttggctgcataaaaattttctaacttgggttcaatatttgtagtgaagtatctgttttcatttttttcacgttataaataaaaatactatgctggccgggcgcggtggctcacacctgtaatcccagcactttgggaggccaatgtgggtggatcatgaggtcaggagttcaagaccagcctagccaagatggtgaaaccccgtctctagtaaagataacaaaaaattagctgggcttgatggcatgcgcctgtaatcccagctactcgggaggttgaggcaggagaatcgcttaaacccaggcggcagaggttgcagtgagccaagatcgcgccactgcactccagcctcagcaatagagtgagactgtctcaaaaaaaaaaaaaaaaaaaaaacctgccaattttcaaacataccgtagagattattttcaggtgccattttatagtatagcagcagggcttttactctgtgtatgcacagatgcagtctggggcatggtttgtgtgctggactttctcatggccatcatcagtatgcttatggatttgatgacaggcatagcctgggcatatcacctcattggtaaagggctagagcctttcttttttatggcacttctttttttgagatagggtcttactctgtcaccctggctagagtacactggtacaatcacggctcaatgtaggcttaacctcctgggctcaggtgtatgtcactatgcccggctactttttgtattttttggtagagacggcttcgccacgttgcccaggctgcaagcgatatgcctaggctcaagcgatctgcccacctcaacttccggaagtgctgagattacaggtgtgagccactgcacccagcctttgttttattttttattttttgagaggtatgattctttctagagattttttctcatggctactattagatcaggaatgggtgattggagattattagattctaggttaacttctaccactttaccctaatacataaaactttttcctaaataaatgatggaaggaataatacttggttacctggcattatttttcagtaagaaaaaagctttactaaccactacatttatggaaatttgtaggggtaagtattttataggtcataaaaaacaccataatataacgaatctcattttctttaaatgtgaattaaatcctaacagtcatctttataaaatgaccataggctaaaatcttacgtgtaagtactactacaataaataatttctgaaacctttaaa

SEQ ID NO: 444 - DNA, 38758 bp, Homo sapiens
ctctccaaactaagggtctctcagcagatggccgggtttagagctgtacgaagacacacagctaatgaaaaattgtggaattctcagagcccgtgaagcctagcccacggatgcgaggtttggaccactgagggaacgcgcatgcgtgctaggcagggcagtccgaaggcttgggggtgtatcatagggtctcatcggaggtttgttggccgtaagacccctggaattggaactctaaaaacacagaaaggatatgagctcaggagacttgaacgaaagagttgtcttaggaagaggggtcagaagacaagggtgctgggcaaaaggctagttcttcgaatcagaatacggtggccagaaaggttcctctgacgaaagaggggcgtggttcgaagccgtacagtggccggtaaagctcaagaaacatggaacgaaaaggacgcgaagaatcggcagggagaagcggacaggatgtcccgaaaggctcatataaccgaaaaggcgggttaatgtgaagggacggaagggacagaacttgcgggaggcacatgctggccgagaaagtcctggagttcggagcatacagtgtttttattaggtggaaacaaacgggctgggagaaagacgagtacggtggccaggttggtccttccatagccggaagtggccttcctgagaggcgtggctgcggcactcttgccggatagggtggcccggcggggctaggaaagcgtgaaatctcgcgcgattgcgctgcgaagtcggggacggggcggggctggcggcgggggcggggacccggagcgggaagatggcggcggcgcaggaggcggacggggcccgcagcgccgtggtggcggccgggggaggcagctccggtcaggtacggaggccgagaggggactgagggggttcttccccagccggggggcctcccacggggcgtgtcctacctcttgtcacggaatcccgtgcactgggggctccttggccagagggaccttgaatacccggcccaggcagggccggaccgcccgggaggccggacggtgccgggaacagggccctgttgcgggtcggttcccctgcacgctcgagccgggcggccaccaggctcattgctcgatccggggagacagtggctcggaggggcgcaggcttgtaccttggcgcgctgggttctcaactccgcgattccatgctctgaggccgttcctagagtggtctggcgttcaggtctcgttgtagtgtttgaggtgtgcgcagtgattaattgggagttttctagctgtggggaagtcagtattagcagggcacggccgacagacccattttacagacgggaattcaaggaacagtgagactaaggcgcttctagaaggtcatcctggttaggtttgtaactttatgtagaagttacaagacactgctgacacagggactggtatggttgtggttttaatgtaaaatagttctatgggttaattagtcctggtgcggatgacttctgccccactgctgtcttaacacactgcagagcataccatttcaggcagctaccgttcaggcatttggggaatagatggagagacatgaaggtgctgtcgacccacccactgggatgtcactgacatgtgggaggcagctcaggggaaaggagtgcgggttgagaggggagaatgaagctgactctctgtgtgaccttgggcaagttcctttccctctttaggcctttatctctcccgtgttaaatgcagaggttggacaggagggccagccatatccctgctgtcaggggacgaagagaggagactgacatgtaaacagttgtaatcctgaatgattaggttggtgacaaaagtctgtgtcagggactgggggagcccagagaaagagcaagtggtatcacttgggtaggacacatggatgaaatttgtgtgatagagcccactgtatctgctctgaatcttttcagcattctcagccagggcctggcttcagggacagcttaggaaatgtttgttgagttagtgctggaatgaaggctcagttcctgtcttcaagggtttcccagtcttgctgaaaggaggtcgtttcccctctgggtttctgttgattattgggttgatggtggcttgagagaccagggcccaggttgttctcattgccctgagcttccagatggcactctgatcttctcttgtaccaactctgcttaaaaacaatcaagagttacccctttgcctttaggacaaagtacaaattctttaataaatcacagtcttgcacgatccgacacttttcttcagactagactaggatttctcgagctcggcactatcaacattttgaattggataatgctttgtttggggggctgccctgtgcattttaggatgtttagcagcatccgtggcctctacgcactagatgtcagtaggatccacgcccctccccagttgtgacaaccatatatgtctccagacattgccaaatgttccaagagcaggggggcaaagccatccctgcgtgagaacaactgcgctaaaggggatccgctgctctgaacctattttatttctaaacctcttttattgcctctcagtctctttcctcatagtctatgcacaggtctctcccctctttagctagttgatgtgtattagtcctacagatttcagatgtcccttcctgcagaaagccctctttgactgtctgggctccgctgtcccagccctgccctactgggtttcactgtctggggactgggaaccccaggagggcagagccaggactgccttgatcaccactgcttccttagcaccactcagctcagcgccaggcacagaggaggtgctcagtgtttgtggaatgagcggatcttgaaacagaggctgggctgaggtggaattccctgatgccgtggtggatccaggtaatcagtgaagacatgccgcaaaacctagcttcctcctgctcttgcctagccctggtggtctcagctacttcttggaccctttagcagatgttgctggggattgtgtgtgtgcgtggacgtgcagatccgagagcaggaactgtgtcttagtcactgatgtgtccacagccactgccacccttctcccatgcccagggcctagtgcacagcaggcacaccctctgcacagtctgctgctttagctagcctgctcctgtagccaggaactcggacacagaacccacagctttgccattccttccttcagcgaatgcgaattgagtctactccatgctaggcctttgctgatgctggagatacagctgtgaataaaataggtgctgccctcttgaaggcccttacacttatgttctagttggagctgaatttataggggaagcacagacagggacacacagtgaacaagataaataagaaaaacagcagttcagatggctctgcgtgccatggacagaaataaagctgggatggggataggaagtgaggggtgggtagaagagttgcaattaaatagggtagtctagaaggcctctctgaggaggtgacgcttgaacaaagacctgaaggaagtgagagagggagtcccaaagatacacgagggaaaagcttttcaggcaaaggagcagccagtgcgaaggccctaaagtgggaggtgcctggtgtgatgaaggaagggcgaggaggctggagcgggtgaggggagaggggtggctggggacagatgcagattatgccaagctttggaggccatggggaggacttggcctttactctgagggaaataggagctgaaaagagtgactctttttttttttttcttttttctgagacggagtctcgctttctcaccacaatctcggctcactgcaacctccgtctcctgggttcaggcaattcttctacctcagcctctcaagtagctgggattacaagcacctgccaccacacccagctaatttttgtatttttagtagagacagggtttcaccaggttggccaggctggtcttgaactcctgacctcaggtgatctgcccacctcggcctcccaaagtgctgggatttcaggcgtgagccaccacgtccagccttgtggtataatttagatggtataacgttcacctgttcttaggatagagtccattggctcctggtccatttatgcagttgtgtggtgcagccatcaccacagtctggtctgagaaagcttctgtcccctcaaaaagttcccttttacagtctctgctgctcccaatcctaggcagccacagaggtgctatctctgtaattttctaaaaatgtcttaaacaaggatctaaacaacatccagtcttttgtgtccagcttctttcattgggcataatgggtttgaggttcatgttgttacatagatctgcagttgttcatttttattttattttttacaacctaggatcagggaaatttggcctttggggaaatcctaaagtacgtgctcacagttgttccttttcactgctcagtggtagtctgcagacatgacacagtttattctttcagtccttgaaggatatttggattgtttttagtttttgtctgttgccaataatgctgctatgaacattcatgtacaggcttttctgtggctgtattttgtttctttttttttttttctaagtaagagagacagggtctccctgtgttgctcaggctggtctcgaactcctgggctcaatggatcctcctgccttggcctcccaaagtgctaggattataggcatgagccaccacacctggccactgtttgtttttgagacagagtcatgctctgtcgcctaggctggagtgcagtggtgtgatcctggttcactgtagcctcattctccaaggctcaattgatcctcccgtctcagcctcctgagtagctgggaccacaggcatgcactaccacacctggctaatttttgtatttttatagagatgaggtcttgctgtgttgcccaggctggtcttgaactcctgggctcaagcagtcttcctgccttggcctcctgaagttctgggattataggcgtgagccactgcgcctggtctggcttcatgttttctgcctcctgggtagccattcaggatgggtttgctggattgtgtagtaggtgcacatatgacttgttcaataactgccatattttccgaagtagctgtacttttactttcccccctagcagcatacgagggttcctgtttttccacatccctgccagcacttgtgattgtctttctgctgatagccatcctaataggtgtgaagtgacacctcattgtggttttaacttgcctttccgtgggaaggttcccagccagattgcccatcactaacgggtaagcgaagagacctgggagtcagtcagatgcagcttcaaatcctgacctggcatcaagtgtcctttcctgaccccaaatcagctcagacccattgaaacccatacttggacccctaaatttcccaatagctaggctggccttgaggagggggccttgtgcctgtctgatttcccttccccagccgacccccgccccatagatctcctcatcagaatgtggctttctctgtctcagcctaagggtctcacccagacgacccagacgtcaaagggagctcctcagggaggcctctctgaccacccactccaaagtggatccctgttcccaactcagttgctgtcacttccccctgcttgttttccatgtaccatttttaattatcctgtttaccgttctagtgtgtttccttctagatccccagctctgggtaagcagggcccagatttctgtctaaaatgttccagtattttcacaacctggtccacaggtcagagaggtgaagtgatgtgcccaaggtgtcacagccaagaacggtgggaccaggactatagctgaggtctgtttgaccctggagcccctccaatggtgtcctgtgctttgggagattacaggaaagagctcttgctggtgaaggggacaggaggtgacaagtgacacatttaacacatgtagcccctctaaccatgctcctgggacatttgctatctggtgggtaaggtgaatggagaaaacattgcagaggagtggactaggggctgtggaggagagggccagacactggagcctcagagggaagtgggtttgggtgacctgagcgtccggggtgagtccttcaggcagcggtggccacacaggtgtttatcacagccttgctctgtgccactggtgctcttgagctaactgtgactgtgatagccctggtcctgcctcttgaaggctgatggctgaggggacagctgggaggaggggtgaatgagaacaggactggggagctagcagggtgcgtgaagggtgagcagaacatccccttccaaacctggcattcagagagtctctgattgtgaccttctgtgtctgagtgaagagtcctcctctgggaagccgtgcctggctcccttgcctgccccccttcccttctgtcattctgcttctgcggtccttcctgagtgaccagacaagtggcttcacctctctgagcctccctttgctcagcagccggatggagctggtcatagttttggcctcaggattagtgtgctgtgtgctgtcacagacatgtcttgtggccgtggcttatggtagcagctgatagtctggttgtgtttttctgtgtctgtcccacctgctggaccaggggcccttggagggcagggttggccacagagggggcctcaggaatggtttgcccagggaaggctctttcagctaagccccagccttgaagaatctggcacctgccataagactccttctgttgttgtccccaatagccacctccttgcatcctggctccagccccagggaacagtggacagtcatcagaatcagactgtgcctctaatcttctgtttctgcacctgctgcttctctcacttcctcctttgtgccaccaacttgctatgttttaggtctcagcttcaatgcccccttctccaggaagttgccccgaaccctagactggaccaggtgcctctcagggctcctgcattcctgccccgttctggacagtcactgtctagagatgaatctttctcccccaccgggctgttaaaccccaggaggacagcaaaagactctctaggtcaccactgtccctaggtcacagaggtgctctgcgagtgttttcctcctaaaagaagaggaccgcaccttcccaggtgttttcactgattcattctccagttattgataagcacccactctttgcccagcctgtgcctggccttcatgcatgatggtgtctaagacagcccccgtgtccattctccctccttaccctggcctctgtcccccacaggtgaccagcaatggcagcatcgggagggacccgccagcggagacccagcctcagaacccaccggcccagccggcacccaatgcctggcaggtcatcaaaggtgtgctgtttaggtgagcagacgggacttgggtttgttcaccgaaaacattcaaataaaaataaggaagaaaggaaaagtcagctgatcagctgaggatggtgatcattactgtatggtagagttgctttttttctttttttttttgtatgatggaatgttttctaaaccttttttttactctggtaaaacatactgaagtagggagtctccctgaacctgttctggtttttggggggctacctgatttgtgaaaaaataaaaacacaaaaaatactgaagtagtttgctagggcccttgtatcaagtaatatagacggagtagcttaaacaactgaaataggaaattcattgtcttacagttctgaaggctggaagtccaggatccagctgtgggcaggggcagtttcttctgtggcttctctcctgggcttgcagaaggccgtcttctccctgtgtcttcatgtggtctttcctctgtgtgtgtctgtgtcctaagctcctcttatggggacactagtcatactggcttagtacccaccataatgacctcactgaaccttacttttttacagaccctatctgggccaggcacaatgactcaccctcataatcccagcattttgggaggccaggttggaaggactgcttgagcccaggagtttgagaccagcctgggcaacatagtaagaccctgtctctactaaaaataaaaaaatctggctgggcacggtggcttacacctacaatcccagcactttgggaggccgaggcgggtggatcacgaggtcaagagatcgagaccatcctggccaacatagtgataccccatctctactaaaaataaaaaaattccggaggctgagacaggagaatggcgtgaacccgggaggcggagcttgcagagagctgagatcgcgctactgcactccagcctgggcaacagagaaagactccgtctcaaaaaaaataaaaaatacaaaaaaaatacaaaaattagctgggtgtggtggcacgtgcctgtagtcccagctactcaggaggctgagggcaggagaatcgtttgaacccaggaggcagaggttgcggtgagctgagatcgtgccactgcattccagcctggggacagagtgagactccatctcaaaaaaaaaaaaaaaaaaaaagccaggtatggtgacacgtacctgtagtctcagctattcaagaggctgaggtaggaggatcacttgagccttggaaatttttttatttttattttatgtatttttttttttttttgagacggagtctcgctctgtcgcccaggctggagtgcagtggcacaatcttggctcactgcaagctccgcctcccgggttcacgccattctcctgcctcagcctcccgagtagctgggactacaggcacccgccaccacacctggctaattttttgtattttcagtagagatggggtttcaccgtgttagccaggatggtctctatctcctgacctcatgatccgcctgccttggcctcccaaagtgctgcgattacaggtgtgagccaccgcacccagcctatttttatttttgtaatggagtctcgctctgtttcccaggctggagtacagtggcgcgatctcagctcactgcaacctccacctcctgggttcaagcgattctcctgcctcagcctcctgagcagctggaattaaggtatgtgccaccatgcccagctaattttgtatttttagtagagatggggtttctccatgttggtcaggctggtctcgaactcccaacctcaggcaatctgcccgccttggcctcccaaagtgttgggattacaggcgtgagccactgcacccagtgcctagctaatttttgcttttttttttttttattagagatggggtttcactatgttgaccaggctggtctcgaactcctgacctcatgatccacccgcctcagcctcccaaagtgctgggattacaggcgtgagccactgggccctgcctgaccctcagaagttgaagctgcagtgagccgagatcacaccactgtactccagtctgggcatcagagtgagaccttatcgcaaaaaaaagttggggggaccctgtctctaaatctagtcacggtggtactgaaggttgagactttaacatatgaattttgggagacatgattcagcccacatctgcacataacatcaaatttaccattttaacctatgttttcattttaaccttttttttttttttttttttttttttttttgagacagcgtctcactttgtcacccaggctggagtgcagtagtgcaatctcggctcactgcagtctctgcctcctgggttcaagcgattctcctgcctcagccacctgagtagctgggactacaggcacctgccaccacgcctggctaatttttgtatttttagtggagatggggttttgccgtgttggccaggctggtctctaactcctgacctcaggtgatccacccgcctcagcctcctaaagtcctgggattataggcgtgagccaccacgcttggcccattttaaccatttttaagtatgtagtcctgtggcattaagtacatctccactgttgtgcccccatcaccattatccatcccgagaatttactcttcccaaactgaaattccatacccatcagacacaagcttcccatttcttcctccttgcaacacctggcagccacttttctatttcctgtctctctttcactactctagttagctcctgtatgtggaatcagacagcatttgtccttctgtgactgcctggtggtgacccttttacctgtgggttcacatgctattcctgggcagtgggaccccagggcctgttttttcaaagcccagcttctgtttgaggccctggggagatgctgggtggtggcgggggaatatgcttggcactgggttctatccttcctgcctagacctagtgacagtcaccttctttgctctgagcctttgtttactcctctgcaaaatagatattccttttattttttttttgctttttggagatgtattttagcaaaataagagaccacaccatgcagttaggcaatcagcttccctacttatgagatagaaggaattgcacagcagagatgtttacaacaatcatcccgccaggtgcggtggctcacgcctgcaatcccagcactttgggagaccgaggcaggcagatcatgaggtcaagagatcgagaccatcctggccaatatggtgaaaccccatctctactaaaaatacaaaaattagctgggtgtggtggcacaagcctgtagtcccagctactcgggaggctgaggcaggagaatcacttgaacctgggaggtagaggttgcagtgagccaagatcgtgccactgcactcaagcctggcgacagagcaagactgagtctcaaaaaaaaaagagaaaataaaaataaaacaatcatggctgggcgcggtggctcacgcctgtaatcccagcactttgggaggccaaggcaagcagatcacgaggtcaggagatcgagaccatcctggctaacacagtgaaacgccgtctctactgaaaatacaaaaaaattagccaggtgtggtggcgggcgcctgtagtcccagctactcaggaggctgaggcaagagaatggtgtgaacccaggaggcggagcttacagtgagcccaggtggtgccactgcactccagcctaggcgacagcgagactccgtctcaaaaaataaaacaaaaataaaaaaataaaacaatcattcctttggctagaatgtcttcacatggccatggccagctgcacgggaggctgggaaatgtggtctttaatctgggaaactgagcaccctgctggaaagcagggctcctattactgaggaagaagaggagagtggttatggggggcagctacttatctcttccataaaatcttattactggtttcccttagcttataaattatgagtgtttattttacaaaattaagtagttcaaacaatacgaagagtgaaaagaaaaagctaatgaaaaagtgtaatgtgggccgggcgcggtggctcacgcctgtaatcccagcactttgggaggccgaggtgggtggatcacgaggttaggagatcgagaccatcctggctaacacagtgaaactgcatctctactaaaaatataaaaaattagccgggcatggtggcaggcgcctatagtcccagctactcgggaggctgaggcaggaggatggcgtgaacctaggaggcggagcttgcagtgtgccaagatgccgccactgcactccagcctgggtgacagagcgagacacagtctcaaaaataaaaaagtgtaatgtgttggtggccatcccataggcacacatttttgtaattggccctaaatgggattatatatagatgctcacagatagagttgtttaaaatagagaaaagttaggaggcggggggcaggtagtgtcagatagcgtgtaagagcacagccctgctgacatctcagccctgccacctctgagctctgtggcctggtcaggttatcacccttcttgagcctcattttccacctcacagacagggaatcttgacaattagctcagggtgcatcagaaggattccaagagaattcatgtcaactgaggggtgcaggagctggcacgcacacagacaatgttggccatgattccttttgttgttcaacgtggaaaaaaaaaaagcctgagcaacacagtaagacccccatctctctctctctctctcttttttttgggagacagaatctcgctccgtcgcccaggctggagtgcagtggcgcgatctcggctcactgcaagctccgcctcctaggttcacgccattctcctgcctcagcctcccgagtagctgggactacaggcgcccgccacagcgcccggctaattttttgtatttttagtagagacagggtttcatcgtgttagccaggatagtctcgatctcctgacctcgctatccacgcacctcgggctcccaaagtgctgggattacaggcgtgagccaccgcgcctatcctgaccccatctctgtaaaaaactaaaaaattagctgggtgtgatggcgcacacctgtagtgccagctattagggaggccgaagagggaggatcgcttgagcccaggaggtcaaggctgcaatgggccgtgatgatactactgcactccagcctaggcaacagagtgagactgtatctcaaacaaacaaaaaccttaggaaatatatagtgaaacagtgaaaaaaaaaagttcatgaggccgggtgcagtggctcacgcctgtaatcccagcactttgggagaccaaggtaggtgaatcacctgaggtcgggagttccagaccagcctgaccaacatggagaaacccatctctgcaaaaaatacaaaattagccgggcatggcggcttatgcctgtaatcccagctattcaggaggctgaggcaggagaatcgcttgaacccgggaggcggaggttgcagtgagccgagatcatgccattttactccagcctgggcaacaagagtgaaactctgtcccaaaaaaaaaaaaaaacaactcatgatccctgatgtagtcactgatcacattctagactagagcagaactgcctgcctggtgtcctccaagagtgtcacacaggacactgagaaactgcaggaaagaaacctccccactctgttaagttgcaaaactgacatgtgtgcctcaaaaattcctgccatgtgccctacgcttctcagtcatgcgcccctgtcccttaccgtctccacttcacctcccctccccatggccacgtaaagacttcagattttcttatatatcaccttcttttttttcatgctgcaagcagctctgcatgaaaattatttttatctttcccttcatttttacataagaggtagcctgttttacacactgttctgctccttgatttttttcattaacaatatatctttgaaatctttccacgtcagtgcatagggagcttccttcagagagacatttttaatacaagtcacactgtaggctaatttcctttcttagaactaggcagcatcaaacatcagttcgggtgggtgctcggagaccatcttggctgcagttcttaaaatgggatccagggtttgttttcaggggcccatgaactccttgtagcttgaagctgattatgtgggaatagcctttctagatagcgggtggcgtctgtgtttttgagcacatgtggttacctggagtgggaggtggagcaggaactgggtatataaaggaatggggtgggagggagagttttgattatacgtcttttcatatatttaaaaatgttctgaacctgtgactgtagaatacctatttgggtgggagaaaggatttaatgtctgttttctttgcttactcaagtacatcaggaagcattagaaaggtccagtctcctgcaggcctgggtgcatggatgaggggccatggccatgagccctctgagagggtccacagaactgtgggcgtgtggatacacacaggacgttcttcaggggactggggatctggaatccaaaaaggcctggccttgttttatacatggggatctagaagcccagaggggttaggacccccacagccacacactaagccaggggcagagctgcctgggggcatcactgcttctacactctcccctggtgtgtttactaaaatgagagcctctgctggaggcatcggtatccccagagattgccaggtccagaccttccccagacgtgcatatcagggacttcatggggaggtagcgatggctcagctggaccgtggcccctaagaccctggaccccagggccttgtggcttctacaggcagaggcaagttcctgtgcctgatcctgcccctgatcagggctcagcagggaggcaccccacccacactagaatttactcatagtgtttttctgctccaaagttttttgtatgcctttttcctatgattaaaataacagtaatagctaacacttctcagtcacttactgggtatgcaccaggctccattctgaggtacgtgtgcgtgtgtcagatgtatatacacgctatataaacatatatataatttaatgtgtttaatgcttataaactaccctatgagagtaggcactgttattatccccatttcaaccattgaagttgaccactgaggtcacagtaagtagcagagctgggcttcagatgaagatactgtagtttagaggctgggctcataacctcttctgctgtatggttatcatacctataattaataagtacttgaatcatttaatcacatggctgcatgcagctgagaaacctccattaacacagtacaggttcatttctctctgatataccagtctggatggaggcagactaggattctgcagtcttcagtgacccagactccttgctgtttgttgtgccattgctaggtttttccctttatcctcatagcccaagacagctgctgaagattcagccatcacatccacactccaggcaacaggagagaagaataaatcaagaaggaatatttcttctctttaaggacacttttttttttttttttttgagatggagtcttactctgtcacccagactggagtccagtggcatgatctcggctcactgcgacctccacctcccaggttcaagcgattcttttgcctccgcctaccaagtagctgggattacaggcgcccgccaccacgcccggctaatttttgtatttttagtagagatggggtttcaccatgttggccaggttggtctcgaactcctgacctcaagtgttggcttcccaaagtgctgggattataggtgtaagccaccacgcccagcctcgttttggttttggtatctgttgttgctgctgattctcgctcataatgtcgtttccttttgtgcctggcttatctctgtctgtgtcctagtcattatacttgaaaagttatttgtaggaatttcagggctaggatgagcatattttcctacagagaggattgcctttgcttctgcctgggggcattaccaagtcctaggtttccttgcaccaggttcagggcttgagctgcccttcgtgactccttatcccacgagtggccttgcatacttcgccctgcatacctgttgtgcaactcctgggaatgggtaggccacctggttccttccttctcaggggtggaggcttgcaccttgtggggtcttagtttcctatagggtaggtctctggttacctcatatgttgtatgtgccctgggctagcatttttttttttttttttgagacagggtctcactctgttgcccaggctggagtgcagtggcatgatcgtggttcactgcagcctcgacctcctgggctcaggtgattctcccacctcagcctcctgagtagctgggaatataggcatggtgcgtgctgccatgcctggctaatttttgtattttttgtagaaactgtgtgttgcccaggctggtctcaaactcctgggctcaagcaatccacctacctcagcctcccagcgtgctggggttacaggtgtgagccaccgcgcccagcctaggccagcatttttgtcacccaccaaaacacctagcagatgtcctcggacacatgaagaagcttatagggctcctttacttattctttttttttttttcccctagacctgcaaatccaagatcctttacttctttttttttttttccttgagatggactttttgctcttgttgcccaggctggagtgccatggcacgatctcggttcactgcaacctccttctcctgggttcaagcgattctcctgccccagcttcccgaatagctgggattacaggcatgcaccaccactcctggctaatttttgtatttttagtagagatggggtttcaccatgttggccaggctggtcttgaactcctgacctcaggtgatccacccacctcggcctcccaaagtgctgggattacaggcttgagccaccgcgcccggccgatcctttactactttaggattcccactttcccttcagtttttgcctgaaggtttggtaacctacagtcgtgtccattcttcagagctgtctatttatatatattcatatgtaaacttgataaaaattacatgcatgagaacaaatacgagaatacgtgagcagcatatattctcattctatcaatatgtataattacaaatataaaatatattgatattttcttagtgtattaattttatcaagcttttccaattttttccagtgagagggttggtctgaataattaagcccactgttactaaaattggaactaacgtatcacttactatctgcttctccaaaaattctccaaaagttcagaaatgttgctctttctaagcttctgtgccttcggttcttttccttttcttttttaaaaaatttaattaattaattgattaatttttttgggacaagctctctatctcccaggctggagtgcagtggcgcaatcacgtctcactgcagccttgaccgtcagggctcaagtgactctctcacctcagtcccccaagtagctgggactacaggcatgggccaccatgcccagctaatttttatattttttgtagagacgggatttcatcatgttgcccaggctggtctcaaacttttgagctcaagcaatccgcctgcctcagcttcccaaagtgctgggattacaagcatgagctgctacacctgacccaattatacttttttttttttttttttttttgagatggagtctcactctgttgcaaggctggagggcagtggcgcaatctcggctcactgcaacctacgcctcccgggttcaagtgattctcctgcctcagcctcccaagtagatgggactagaggcacgcaccaccaggcccagttaatttttgtatttttagtagagacagggtttcaccatgttggccacgatgatctcgatttcttgacctcgtgatttgcccacttcagcctcccaaagttacaggcatgagccactgtgcctggcctctatacttcttaagttattttaaaatgtgtaattaaattactattgactagagttgccgtgttttgctaccaaatactagatctcattcattctttttttttttgagatggagtctcgctctgttgcccaggctggagtgcagtggcgcgatcttggctcactgcaacctctgcctcctgggttcacaccattctcctgcctcagcctccggagtagctgggactacaggcgcccgccaccatgcccagctaatttttttgtattttttagtagagacagggtttcaccatgttagccaggatggtctcaatctcctgacctcgtgatccgcccgccttggcctcccaaagtgctgggattacaggcatgagccgccgcgcccgtcctcgttcattctattttttgtagccattaaccatccccggttctgtgcttttgaagcgctaggattccagattctttcttttaaaaattttatgtttattattttttctttatttcttttttcttttaattcatccatctgcacactgaaggggttccagattcttagtctcctctcgggggatcccagggggctggatggcaggtttcccagtctgagtcaagagtcagcccctgcagccctgtggtcaccaggagctcctgcaggatttagagtcaagggtctgcatgcagaccagggcagtgccagctacccccacacactggcaaacggtggcatctgggctccctccccagatgtggtctttagggacatcttatctccttgccagccctgtgactaccttctcagggcctccctgacttggtcactagccccaggtcaggcgccagcatgtgctaagtcagaaggaagtcaggcgggtctatggcggagagccaaggcttggggactcaccaccttgctgcttctctcctcaggatcttcatcatctgggccatcagcagttggttccgccgagggccggcccctcaggaccaggcgggccccggaggagctccacgcgtcgccagccgcaacctgttccccaaagacactttaatggtaactgccgggtggtagggcagacttgggaggtgatggggtgtggaggggtggaatgtggaggagtgatgtcagcagtcgggacagaccaggtccttgctcactggcaggtctaggaaaacaggtccagggttgaggaactctgggcccatccccaacacgtgagacctctgtcacctgggtccatccccagcacataaaacctgtgtcacccaaaagaaaaagcaaattcatttggttaaaataggttaaatcagggtctttggatgttatatttcaaaagtatgttcagcctttcagggttgcagagggagatgtgcaagggagagagtgtgagaggtggggagggcagggagccagcagaggctgacaggaggtgggcccggaaggagaggagacctgcacttccacagtgggcttgggcacaggcagggcagggcttcaggagcctccagagcaaaagcatttagatctgtcagtctaggcttttctgagcaaacatggccattggggcttgagaaaggaggaagttcttgttgggtcacagtgggttttttttttttttttttttgagatggagtctcactctgtcgcccaggctagagtgcagtggcataatcttagctcactgcaacctctgcctcccgggctccagtgatcctcctgcctcagcctcacgactagctgggattacaggcatgtgccaccacgtccagctaattttttgtatttttagtagagatggggttttacctttttggtacgctggtctcgaactcctgacctcaagtggtctacccgccttggcctcccaacgtgctgggatcacaggcatgagccaccgtgcccggtggctcacagtgcttttgtagctctggactgcttcgtccataagcctgcagagctctgaccaggaaggcccagcagccatgagggcaggagatcattcagggagctcctgccccttcctacccctaaattctaattggcaggctggccagtctccaagtgttctttgttcgttgacttcacaggctcagaccaggacaaacatggtggtatgagaaaagagaaaatatgtcctctctgctgctcttcctctctcctctcccctgtcctccataattactgttcccctgagtgtgctgaccgctgccatagctctttagccagcctgcagaggctctgaagagcaggcctgagctctgttcccttcctgtcccaacagaacctgcatgtgtacatctcagagcacgagcactttacagacttcaacgccacgtcggcactcttctgggaacagcacgatcttgtgtatggcgactggactagcggcgagaactcagacggctgctacgagcactttgctgagctcgatatcccacaggtgggggcagctctcggtttctggccccatggctgcttgactggcactgaaggaccttttcctccagtccgctccttgctgagagcatgtggagtttgggctccaggcttggcccttccctgggctcacatggtctgtgaccacaagccagtccctgagatctctgggcttcactttcccctacctgaaaaaggtagataggggtggaattggcctgggaccctcccagctacctctaaggttgtgcagtcctccactttaaactggtgaaagattagtaattgtccttggggatgtttgcctatcaccagtttatcaggcagccccgtttcaaaataatattagttaatgttgattgagctaagtgcagggtactaagctaggctgactcatggaaatttcccggcaaccctgtgaagcaggaactgttattattctcatttaacatgtgaggaaactgagagagaaggaaagtgatttacccaaggccacatcgcatgagagattcagactcaggctctacggctgtggactctcgcagccctaggctcaaatccaacctcctccaggaagccctccctgactcacagagcactcaggcttggttaagcaccctctctgggttctcacacctgctgggcttccccatcccagcccattctggggcctcattgggactcctgtatgggactgtgagccttgtgataataaggctggggctgcctagatcacttccatgtccccagcactgcccaacgtggggctgggtgcagaatcagcaagtattgaacaagtaaaagggacatctctctttggggccttcttcggctgagtccaagacagctgccctcattcctttctccccagcaggccttctcagctttggggtggagggcacatttctgttctatttctgtctgggtagctagaagcagaatgtggacacagtcattctggtttttttttttgttttttgtttttttttgagacagcgtctcgctctgtcacccagtctggagggcagtggcgcaaccttggctcactgcaacttcacctcccaggttcaagcgattctcatgtgccagcctcctgagtagctgggactaaggcacacatgatcacacccagctaatttttttattttttagtagagacaaggtttcactatgttggccaggttggccttgaactcctgacctcaagtgatccacctaccttggtctcccaaagtgctgggattacaggcgtgagacaccgcgtccagccatcattcttttctttttgagatggggtcttgctctgttgcctaggctgaagtgcagtggtgcaattacagctcactgcagcctcaacctcctgggctcaagcaatcttttcacctcagcctcccaagtagctgggacaacaggcatgcaccaccatgcccagctaattttttgtagagatggggtctcaacatgtttcccaggctggtctcaaactcctctgctcaagcgatcctctcacctcagcctctcaaagtgctggaattacaggcatgaaccaccccacctggctggactttctgacctgcactgagaggtgactcccacagagacctcaagcccagcccccaggccttgccacgagatccaaggaaggaccagggcctggcaggcccagcagggggatctgcttccaagggcttggatctaagtcgaagcttcagggtggggtccaagtggacttaaaaggcaggagagctgggcacagtggcatgtgcctgtaggcacagctactcaggaggctgaggtgggagaatggccagagcccaggagtttaagactgtagtgtgccatgatcgcaactgcaaatagccagtgcactccagcctgggcaacacaggaagaccccatctctaaaaaagatagggagagtgaggagaacacaatgtggccaactgaattcgagctctgcacaaggatcagagaggttcagtgctcgcctttgtctccacccagtgcccctggacaacttgcctcccttcttgaagcctcagtttcctcatctggatcaagtgagaatagtcccccttccctgggaggcaaggagacttgatgagataatgaggaagacttgggcagagaggggccagctggaggtagcagggagtagcacccaggagcccacagactgggtttccatctgcgtacttgccacacactatgtgaccccttggcatgagccccgtttgcctcatctgcaaaatggggtggtaacatgacccattgcataaggttgacatgttatatgtgtgttaactcgttagattaggaagctgttgtctgaagtgcccagggcagggtctggcccatagtaggagctccatgtcggtcagctgcttcttcctgttgagtgagcttaacgagagctcgttgactgagctgtgtgccagtgctccaggtagtccctgcagtggtgccctcgggtcagtgctgtgggaacttcgcatcctctaggtggggccctgaggctcagagagaagctgagctcacacggccatggcaggtagagcgggcgtctgagtctgtctgactccagcatttacctctctgccacccagctacatgccccaccctgagtactcagtaaatggccagagagttgagggggaggaaactgctgcagatgggtgccaggcagggctttaacgtttccctcaccccagttgcccagcctgcccacctgaccttccgtcttttgcagagcgtccagcagaacggctccatctacatccacgtttacttcaccaagagtggcttccacccagacccccggcagaaggccctgtaccgccggcttgccacagtccacatgtcccggagtaagtcgctcccctgcagccaggacccactgtccaggaggccagcatcctgggagcccccaggctaatgtggcggacaaatcccaagtccaggagggcaggcaggaagcctgtgctcaaagagggtgggattggcagggcaggctcaagccccacccagcctgaaagagccctgtggacactaagcagggatacccacggaggaagggagacccacggaggctcagggaccagagagaaattggccagaaaaagcagctggagacagggactcttggagaggaggagacgtccttcaccaagggggaagggccagggttgacttttgcacagtaggggcctgatagaagtagacactcaaaaataatttgtgggctgggtgcagtggttcatgcctgtaatcctagcactttgggagacaaggtgggcagattgcttgagcccaggagtttgagaccagcctgggaaacatgacaaaaccctgtctctaccaaaaaagacacaaaaactagctgggcgtgtgcctgtagtcccagctgctcaggaggctgaggtgggaggatcgcttgagcccaggaggtggaggttgcagtgagccagaatcacaccactgcactccagcctgggtgacagaccgagaacctgtctcaaaaagatagatagaggccgggcacagtggctcacgcctgtaatcccaggactttgggaggccgaggcgggtgaatcacaaggtcaagagatagagaccatcctggccaacacggtgaaaccccgtctctactaaaaatacaaaaattagctgggtgtagtagcatgctcctgtagtcccagctacttgggaggctgaggcaggagaatcgcttgaatccaggaggcggaggttgcattgagctgagatcacgccattgcactccagcctggtgacacagcaagactccgtctccgtctcaaaaaaaaaaaaaatagataaaattcaaagaacagtgtgggcaacataatgagacttcgttgctacaaaaattaatagccaggtatggtggtgagcacctgtggttccagctacatgggaggctgaggtgggaggatcgcttgaacctgggaggtcaaggatgcagtgagctgtgattgcactacagctttccagcctgggcgacagagcaagtccacgtctctgaaaaaacaatagtaataaaaaataagactaccacttctactcccatgataactcattaatccattaaaccactaatccatgaatgggttaatcagttcctgaggggagggtcctcatgacccagtcacctcttaaaagcctcatctctcagtactggcacattggggattaagtttcactgggagtggggagtactagagtacatcagtagtcccagctacttgggaggctgaggtgggagaatcagcatgagttttggccaggacaaacattcaaaccatagcattgtccgtcctcttgttttcgagaagttaataattgttgtcatctttctgcttgcctggctctttttttttttttttttgagacagggtctcactatgtcgcccaggctggagtgcagtggactatctcagctcaccacaatttccacctcccaagttcaagcgattctcccaccttagcctccaaaatagctgggactacaggcacacgccactacgcccggctagtttttgtatttttagtagagacggggtttcgccatgttggccaggctggtctcaaactcctgacctcaagtgatcgtctgcctcggcctcccaaagtgctgggattacaggtgtgagctgccacacccagccttgcttggttctctgtgagctttttccctgagtcctctgtctcctgatgggcagccgtagaaatctcttgctgtacctgtttgagcggagctggagaatggcttcctcagaaagccccccattcttctaacgggagttctgtgtactccacctagctttcactttattgaggactattccagacattccctgtggatttggttaagatccatctggctggttttgggtggcgcagcaacagacagaattctatttgtatgagttaggtcttacctacttcttttagtacaaaaatatcctaaaggatggtaatttttttttatcacctatactggatgaaatgaaaagttgactctatgtgggtccctagaaatgacttggaaaggtcttctggagttacttgagcccctttctgagtgagtgtgtctgaagaatgtgctgcgttggtatgtcccacccggctgacgtccatgtggtgagatctttggagaaccaggcagaagtggcttgagggggtgtgacctacagggttggtctcacagatgtttccctgcagggggatacgtcaggggtctgggctaaaatgcccgatgtttcagaggtcgctctgaaggtgacccaggtgggtggctcttcaccctattcttgtaccccgtttgacgatcacctaatcatcccgttgacccaaatcgatgccagtattttctgcagttttgtctttggtgagtgtgatccatgtcactgtgtggtgaggtttattcacagtcagtctggtctgtaaaatagaacctgcagacagtgaacctgaaaagcatactaggatcatccaggcctccctccccagccttggagctgggaccctcaaagcagggacatagaaggacttggagtgagccacccacaaactccagggtgaaggagagtgtgagttcagaaaagcccccttttggctggttgtggtggctcatgcctggaaacccagcactttgggaagccaaggcaagcagatcacttgaggtcaggacttcgagaccagcctggccaacatggtgaaaccctgtctctactaaaaatacaaaacttagctgggcatggtggcacatgcctgtaatcccagttactcgggaagctgaggtgggagaatcttttggaccccggaggcggagattgcagtgagccgagatcgtgccactgtactctagcctgggcgacagagcaagactccatctcaaaaaaaaaaaaaaaaaaagaaaagaaaagccccttttatccccaagaggccaataatcagtattctagagcagctccgtcccatggagataggatgtgagccagagaaggcattaaaatttttccaatagaaaaatactaaagagtaaaaaggtaaagagaggccaggcacggtggctcatgcctgtagtcccagcactttgggaggccaaagtcagaggatcgcttgagcccaggagtttgaggccagccctggcaacatagggagacctcatctctacaaaaaaaaattttattttattttatttattttatttcattttatttatttattattatttttttttgagatgaagtcttgctctgttgcccaggctggagtgcagtggtgcagtctcggctcactgcaagctctgcctcccgggttcacgccattctcctgcctcagcctcctgagtagctgggactacaggcgcccgccaccacgcccggctaatggtttttttgtatttttagtagagaccaggtttcaccgtgttagccaggatggtcttgatctcctgacctcgtgatccacccgccttggcctcccaaagcactgggattacaggcatgagccagcgcgcctggcctattttattttatttttttttgagacagagtttcactcttgttgcccaggctggagtacagtggcatgatcttggctcgccacagcctccacctcccaggttcaagcaattctgcctcagcctcccaagtagctgggattacagtcatgtgtcaccacgcccagctaattttgtatttatagtagagatagggtttctccatgttggtcaggctggtctcgaactcccgacctcaggggacccacctgccttggcctcccaaagtgttgggattacaggcgtgagccaaaaaatttttttaaattagccagatatggtggtgcgcaacctgtagtgtcctccgactcaggaggctcaggtagaaggatcatttgagtccaggaggtcaaggctgcagtgaactgtgatcaggccactgcacttcagcctgagcaacaaagcgagaccctgtctcaaaaagaaatataaataaaataataaaaaggtaaggccagggccgtgatggctcacacctgtaatcccagcactttgggaggccaaggctagaggattgcttgagcctaggagttcgagaccagcctgggcaacatggcaaaaccccccctaataaaaatacaaaaattagccaggcatggtggcacatgcctgtaatcccagctactcgggagcctgaggtaggaggatcacccaagcccaggaggttgaggctgcagtgatcacaccactgcactctagcctggataacaaaaggagaccctgtctcacaaataaataaataaaaaggtaaagaaaaaccatgagattaatatcaataatagtttaattgagctcaacatattctcgtttcaacatatgatcagtataaaaagtgagatattttacatttttgtttccccttgtgtcagttttcagaatctagtgtgtgtgactgggcacggtggctcacatctgtaatcccagcactttgggaggttgaggcaggtggatcacttgaggccaggagtttgagaccagcctggccaacataatgaaaccccagctatactaaaaatacaaaaattaggcgggcatggtggctaacgcttgtaattccgtctactcgggaggctgaggcaggagaatcacttgaacccagaaggcagaggttgcagtgagctgaaatcgtgccactgcactctagtctgggcgacagagcgagactatgtcaaaaaaaaaaaaaagggtctagcgtgtgttttatatcatagcacttcttggtttggaccagccatatttgcagtgcccagtagctgcatgtggccagcaaccctgatactggatggtgcagctctagaagattttcctccaagaaaggggggctttttcctccccacaggagccaggtccatctggtctggatgcctccaagctgcagaatgtgttctttgcctgagccaaagcctctctcccctgtgcctccccctccaccagccagcgctgccctctggggctctcccttccctggacagtctctgtcaggtgtggacacgattggggcatgtccccctggaattttctccaagtcaacccttgagtgttggtttctccccctggacacaggaggaagatccccaatgatttaataatcatagaaatgatgaggattggccaggtggctcaagcctgtagtcccagcaatttgagaggccgaggcaggtggatcacttgaggttagaatttgagaccagcctggccaacatggttaaactccgtctctactaaaaatacaaaaattgctggtcatggtggtggatgcctgtaatcccggctactcgggaggctgaggcaggagaattgcttgaacctaggaggcagaggttacagtgagctgaagtcatgccactgctctctagcctgggcaacagagtgagactccatctcaaaaaaaaaaaaaaaatgaggatgacgtttctgctaataagcagtaggccctgggccaagaagtggtgaggcttttcttccttctttagggaagtgacatcactcaccagcatcccttagcttgtaggattcagagccaagattgcccccagagcccccgctgttggccaggtctctttcccctttccctgtctctccctggccccaggggacaggatagagacttgagggagggcagactgagttttccttcatagcataaggaagagctgaaaagtccccgggctcagtggctcacgcctgtcatcccagcactttgggagactgaggtgggcagatcacgaggccaggagattgagaccagcctgggcaacatggtgacaccctgtctctactaaaaatacaaaattagccgggcgtggtggtacacgcctgtagtcccagctacccaggaggctgaggtgggagaatagctggaacctgggagtcggaggttgcagtgagccaagatcacaccactgcactgcagcttggatgacagagcgagactctgtctcaaaaaaaaaaaaaaaaaaaaaaaaaaaagaaaagaaaaaagaaaaatacttagcttcttttcgggccaggtgcggcagctcacacctgtaatcccagcactttgggaggccaaggtgggcagatcacgagatcaggagattgagacaatcctggctaacacagtgaaaccctgtctttactaaaaatacaaaaaattagcagagcctggtggcacacgcctgtaatcccagctacttgagaggctgaggcaggagaattgcttgaacccaggaggcggaggttgcagtgagccgagattgtgccactgcactccagcctgggtgacagagcgagactctgtctccagaaaaaaaacagaaacgtccccaggccagggcagaggttgggagatggagcgtgggcacgcacaagccccttcctccccggcagcatttgggacaacatggcagggggcctgtggccaactgggcctctgcgagaggaagtgaggccaactcctggctggggattcacagcctcaaagtgtttctcatcttggtttctcatgttggtggcttcaggccttttttggaaccgtctgctgcctctttatagtcatgtattcaactggtcatcaccgagcctgtgcaggcgccccatgtgtattcaaacaggccctgcccctacccgcatttccgcacagagtttgcagactggttgcagggacagacagcaggcaggtaaaccactggctaagtggttttggatagtggtgaaatgttgtgaaggaaacaagctggcaggagaatgactgcataggctcattcagtggggtggccagggaagccctgtggaagaaggacattctgccagggacttgaatgccacggaggagccaggccacgaagattgtgtcagggcatgggttcctgggacacggggcagcacgcctgaaggccccgggttggcatgtttgagaagtggaaggtggtgagggttgagaggtcaccggggctacggtgagtgtctggggttccaaagctgcgggatggccatgatcagtcacttgtttttatttatttgtttgtttgttttctttttctttttgaaacggagtttcgctcttgttgcccaggctggagtgcaacagtgcgatctcagcttcctgtaacctccacctccctagttcaagcgattctcctgcctcagccttccgagtagctgggattacaggcacccgccaccacatccggctgatttttgtatttttattagagacggggggtttcaccatgctggccaggctggtctctaactcctgacctcaggggatctgcccgccccagcctcccaaagtgctgggattacagtgccctactgagctggggtttctgcctggggcatttggtgatggtggcgtccccatgatcatgaggaactgggattcgttgagatttggggaggcagttctggcattccaggtcacattgatctcagcaggtgagtgcaaggtggatgccaggagaccgtgagccgttgctggtgggcaggggtccgggctctggaggctgcaggtgccagcaggtctcacgtcccctcctttcccacctcccaaccacagtgatcaacaaatacaagcgcagacgatttcagaaaaccaagaacctgctgacaggagagacagaagcggacccagaaatgatcaaggtaaatgggcagggttgtcagggcctatagggaccaagccaggccattcacagctcatcccagaccactggggctgtcatctgtcaccaccactgaaccaccatgccggctcggtcatgccacctcccctccctgagcactgggctcctcctctgggaaatggggtcaggaggcagctgtctctcagggagtgaggaggatcccagacaaggttacctgagcctcttgccagcctgggaggggtctacatcacagtcccattgtcacatgaggacacttgctcagtctcagccggaagtggcaggccagggactctcacccacacagccaggccccagagcccaagctcagcctggctccaagcacacacacgagaatatggctttagtaggaactgcaggattcatagttgctgtcactcccagtgggctggggagccgggcagttaatctgtggttaacctgcagtgggcactaagagacttcctctctctgcgggtggtcctgtgttgggggggtggtccctgctcatggagctgaggccaccgtgcaagagtgtgtggagcctgctgtcatgaggctgggcttcgcagcctggcctaggatgccagccctgcctctacctctacctcggttttctacatgtggggtgggaggatcctgtcggtggccggaagggtcctgggtggcggaatctctaagcctagggaggagagccttctgccagcagttgctgtggtggctgatattctgctgccagggttgtcaggggagatggctcatgcctgttttcccagcattttgggaggccgaagcagaaggatcacttgagcccggaagttcaagatcagcccaggcagcatagtgagaccccatctcttccaaaaaagagaaaaaagaaagaaagaaaagaagctgtccatggtggctcacgcctctaatcccagcactttgggaggccgaggtgggaggatcgtgcttgagcccagaattcgagaccagcttgggcagcatagtgagaccccatctcagaaaaaaaagaaagcaaagattaagattttctcgggaaccctggggaggaagtgtacagagagtgatagtccccgagcacttccacctgcctctgaggtccttccccccatgttgcctcagagggctgaggactatgggcctgtggaggtgatctcccattggcaccccaacatcaccatcaacatcgtggacgaccacacgccgtgggtgaagggcagtgtgccccctcccctggatcaatgtaagctccccagccctgccagctgcctgcagagcctttgagagggtgctcggggtccatctccttgtcttctcctggccctgtccccctgagagagctttccagggctccaccctcccaagctcccaccctgtcctatccccttcccatgtcctctccctctcccacaccaccacccctggggaccccaggactgacttctacacgccagcatcggtccgcaatcaagtgccatccagcccacaaactgttttcaaaaaatgtcttatcacttgccagcttttgaaattgaggcagtatcacttaaaagccacaatttctggcttattttataaaactgggttacatggtcacccacagggcagccgtgggctggagctgagccacagctgcccccttcagtggggacctgcctgccctttgcctcagtcccctctgctgaggtcaaggcaccctttagctcctcatggtgtggcctagaaatgtcccctgtcctccagtctctgtagaggggccctgttgggtctctccagacatctgaggcctgcgggtaccctggcctcctgcccgggccaaatggtgcccctgccccacgtgctgcagatgtgaagttcgacgccgtgagcggtgactactatcccatcatctacttcaatgactactggaacctgcagaaggactactaccccatcaacgagagcctggccagcctgccgctccgcgtctccttctgcccactctcgctttggcgctggcagctctatgctgcccagagcaccaagtcgccctggaacttcctgggtgatgagttgtacgagcagtcagatgaggagcaggactcggtgaaggtgagtgcggccggtgtgggcgggacttcccggtgccttcctgggcgcaagaggccaagaggaagtgtgccaggcctgggctgtgggacctcccgcctggtgctcctctgcccacagtttcacaacctcccaggtcccttctccacagtgaaaggaagtgggcacccagccctccagccctagatgactgggggtcctctccccaggctgttctgttggaccctttgggtccagacctgtcccttcctccttctgtcccagaccttgtgtccctggccctggctccaactctgtgtctctgccatctcactgggtcctgaaatgtcagcctgtgtctgtggcgtgaggctcggctttgcctcctgggctgtcgtcactgttgggtctctgctcctggctcccagtgtcccttcacccactccccgcagcactcccttggcctctgcctcttcccctagtgccatctccccgtctcttctgtctttgtgagtcaccctcctctctctccccatctgcccatctctgacccagtctcctcctggctggcccaccttcagcctccctctacaggcggccccaggggcagccctcgggacaaaagctagtgaaggtgctcctgggtggggacaggctgtgctcacatgtgtcccctgcaggtggccctgctggagaccaacccctacctgctggcgctcaccatcatcgtgtctatcgttcacagtgtcttcgagttcctggccttcaagaatggtaggaacaggaccccagggctagtgagaggctgtgcagggtgggggacaggacctgcccccttcctcctcccctccctccccacatgtcctccccctgcctggggtctctcagccccactctccagaggcctagtgagctggggaggggcagtggccccaaaactcccaacccagaaattcccacccaccgggtgtggagctgagggaggggctggcccgctggtggggcagaggccaggccaatactgccaggaagcagggctggggaactccagagccaagagcagggaagccccggagctgctcccgccaccctgcccggcaggctgcctgctgcgggaggccgcttagggctgagtggacggggcctgcccaagtgggaaggaggagcactgtcccccaaaggtccctaggttctaaggctgaccatactgatggccagcgtttgaggagaagcagccacatgccaggcactgtcctgggtaccctccccagtagctccttgagccctgtgggagccagaggctcagggatgtcacttgcccagtcacacggttcctaaggggcagatggttccagccccaactctcatcttctaggccctgcaggccacttcttccttgcccagagcaccccagtctgaaggagtggcctgcggccctgtagctcccgcaggcggcaagaggaatgagtagtagtattcctggtattaagatgctattgccggcctggtggtggctctcgcctgtaatcccagcactttgggaggccaaggtgggaggatcacctaagccccggagtttgagaccagcctgggcaacaaagcgagattcgtttctacacaattttttttaagaattagctgggcatggcagcgtgtgcctatggtctcagctactcgggaggcttgggcctgaaaggtcaaggctgccgtgagccatgatcacaccactgaactccatcctaggcaacagagtgacaccctgttccaaaaaaaaggacgctcttgccattattgagaactaccatctggaagaatgcagtgtcatacgggcacaggagctggtgccgaccccagccagccatctaccagctgtcgctgggagacgggacccttctgcctaggagctggcttggctggggtccagtgagaaatgaggcacaagaaggctgtcctccccagtgtcatgcagcagggggcgcaggcctcacttggcaccagtgctgtgtggcctccctggtctaaggagaggcttgggcccaactgctcccacgagaacccaccagaaccctgtctccagacccattcttctcagttgggacaggggtcattctgatgggcaggggtgggtggggtgaggctatggagtgtgccagagctctgggatgtgggggagctctgggatgtgggggagctctgggatggggtagggtgcacatggaccagaattcacagccctcactccctgagtgcagagctggccctgactctgcaggactgcagacctggctccaccactgtgctacagacgtggtggctcagcctcctgtggctgcggttagatgctcagccgggcggggtcaagagaggggtgtccgtggtgagaccagggctcagagaggagcatgctgacatggatccttggcagcatctaggcggagcactggaaggagctccagactggagcccagggcccttttcagtttcctgagcatggctgtgagccagttccttcccggtgtcagggcaggggcctggaggaggtggtcttgaagtgcatgccacagatcttccttcccagggagggcgagctggcaccatggtgtggcacagaccccgcgtcccttcagattctgccatgccaggctgtttggcctcagggaagcagcttccctgaccagtccttagcacctggcacgtggtgagccctgtccatggcaccagtcaccgtcaccatcagtcaagggactgcaccttggggtgctgggtgctgacgtcctatgggagggctccaggggtgccgcctgtctggtgctctgggggtcacccaatgaatatgagagccttcctgggagagaggggtctcgttcagcacccctcctgaggacccagccccaccccagggtgtgaggatgcaggccaagggggcctgagggagctgcagtagggtctcagcacctcctcagcctcctggttcccccctaccccctgcgcacagatatccagttctggaacagccggcagtccctggagggcctgtccgtgcgctccgtcttcttcggcgttttccagtcattcgtggtcctcctctacatcctggacaacgagaccaacttcgtggtccaggtcagcgtcttcattggggtcctcatcgacctctggaagatcaccaaggtcatggacgtccgggtaaggctggggcgccatgctgtctcgggagctgcaggggttgggagggggtagtgtggcccagctggaccctggagctggcccccgggggattcccagcaagtgcctcactcccaggactgaggggattttctcaccaggggattttttgggtcacacatggggcaggggaactgggaacggtggggaagggcaggggctggttctggcttgtggggtgggagccagcgtagcaactgaccatggcacccacctcatccacagctggaccgagagcacagggtggcaggaatcttcccccgcctatccttcaaggacaagtccacgtatatcgagtcctcgaccaaagtgtatgatgatgtgagtgtcctgcacagtgggcccctgggggtggtctccaggtaccacgtatccctgaggcacccggggccggccatctgtctgccggacccatgctttacagcctgtgccacatcctctgtgtcccccatctgccataactgcttccctgggcgagtccggagtccccagggctacctggaaattccccctgcccggcctgccagaccaggtgtggtgggtgagggcggggagcagggctgccaggcagggctgaggagctggctgacagccccaccctgtggccccacagatggcattccggtacctgtcctggatcctcttcccgctcctgggctgctatgccgtctacagtcttctgtacctggagcacaagggctggtactcctgggtgctcagcatgctctacggcttcctgctgaccttcggtgagcggtccggccgccccaggagagagcaggccccatgctgcgcagggctcacagccccagtgtaggagacagacccatccccagacagggacaacctagggtgggcagagctgggatatagggaggcccgagggcacacatggccccatctggggtcagagaggacttcagggaggacatgaacagtacgcttcagtcctcattctcagggggcctttgtgtcttgggaacaagtaaacaagtagggccaggtgcagtggctcacacctgttatcccaatgctttgggaggctgaggcaggaggatcacttgagcccaggaattcgtgaccagcctgggcaacttggcaagacccgatctctacaaaaaaacacagaaattattggggagtggtggtgcgtgcctgtagtcccagctacctgggaggctgaggtgggaggatcccttgagtccaggaggttgaagctgcagtgagccatgattacgccactgcactccagcctgggtgacagagtgagaccctgtctcaaaaaacaaaagaccgggtgaatcacagccaatagtgagtactgtgaagggcagagtggtgggaggatgcacattaataggggtccgggggcccctctgaggacaggacatttaaacagaggcctcagatatccagggagagagctgtgcggatgtgacagaaggccccaccagtgcagaggccgctggtagagtgtgcccaggtataggaagtggtagagtgtgcccaggtgtaggaagtggtgagggggctggtatggccagtgcagagtgcacaggggagaggtgggagaggccatccctctgctcatgggtgctctcactgcaggcttcatcaccatgacgccccagctcttcatcaactacaagctcaagtctgtggcccaccttccctggcgcatgctcacctacaaggccctcaacacattcatcgacgacctgttcgcctttgtcatcaagatgcccgttatgtaccggatcggctgcctgcgggacggtgaggcccggtgggcaggtgggagctcccaccggaacagggccctgaggcagtctttagggcccaggcctgagggggtgccacggccccagatggggtgctcagtctgagggggctcggccccgcccttgcatcacgccctctccacccaggcccacctggctgtggacgggccagcccgacctcacactgcctcccacccctctccagatgtggttttcttcatctacctctaccaacggtggatctaccgcgtcgaccccacccgagtcaacgagtttggcatgagtggagaagaccccacagctgccgcccccgtggccgaggttcccacagcagcaggggccctcacgcccacacctgcacccaccacgaccaccgccaccagggaggaggcctccacgtccctgcccaccaagcccacccagggggccagctctgccagcgagccccaggaagcccctccaaagccagcagaggacaagaaaaaggattagtcgagactggtcctcacctgctccggctcctggcgaccactacccctgcgtcccggccccctcgcctcccctccctgtcgccctttccctggacagatcaggccggggcggtgggaggcccgcctcaggtcagggcccagcgtgtgatgtaggggccggggcaggccagggtttgtttgtggaggcgctgtctgtccctctgtccctctgtgtttccagccatctcgccctgccagcccagcaccactgggaatcatggtgaagctgatgcagcgttgccgagggggtgggttgggcgggggtggggccgggcccccctacgggatgcccacggccgttcatcatcttgtccctcgtccccctaccacactccccctcctagaccgccgccctttaacacagtctggatttaataaattcatatgggtgtttaacttaaactca

SEQ ID NO: 445 - DNA, 68430 bp, Homo sapiens
cccgcctagcatggtgcggcggccgcgcgcgcggacatgggggagaagctggagctgagactgaagtcgcccgtgggggctgagcccgccgtctacccgtggccgctgccggtctacgtgagtgccgccctccaccgtccctacctcccggcctcccctcctccgccgcccctggggacaccccaaacccccccaagccgcgctcaccggtcccccctgcggaacggagaccctggactccactgtcgctgctccacccccgttgcttcccggccgagggccccgcggctgtttcccgcagggtgggagccccgcgcgcctggggtgggagcgggagccggcgcccccgagccctaccgcggtgccgttgcccccgccgggctgtcccgggcgcggaacggaaggggtaactcgtgccggccgcgttttgactggaagcccgcccgcccgccccgctcgttcccggcgctgtcagtgtgtccgccgccttatttttctttttgagggcatcctttcctgtctcctcttctcttctttttaaaaattgggcgtttgtcacgcttttcctactcgggcacggcgggcccgaccctgcgaaggtgggagttaacgtccccttgagtgggcgggagcggtctgacctttggaaatggggaatttttgtccccgtaattttgagtgggtatgggctgccctggccctgggaaattaggcatctttgacctgttaatcctagttggttggggacaggctttatttatccttggaaattgggacttctccccgatcttgagtgggcaggattgggctcacccccggagttagtaaattttgtcttcttcatcttggtgaccgttggaaaatgacaggccgggtggaatgttacagaggcaccccaccgggtggttccagaaacccgcgtgcggctcccggggtgcgagtcccggcgtggcccctgaggaggcggggcgcgtgcgtccgcgcttgggaccctctggccacgctccgggctgggcagggcgcgttttcggggaaaagtgaagcaggcgctgtcagcgagcgtgtccggggcgcgagttttggggggcgcgtctgcagggcccggccgggcatccccgcgcgccctgggactcccgcgcgcgctgggcttgtgtcagtttttggaaacgtgctcgctgggggcggggtcaggacgcggagagcgctggggagcccgggctggctcactgccccgggtcggtgcgagtggatgggagagggagcgcagcttccagcctggccgcacgtcccgcgcgcggggctggcggggtagggccctggggctctggcttctctggttgggcagctccgggtgtgcgcctgggcggcctgagccgggatcccgccaggagaggtcctaggacaaaaactgaaagcagaggccgcgcttcagcgccccgaccggtttcctccctcgaaagttcaaactccagaacccttccagcctccacttctctctgttgggctctcatcgttttaggtggtagaaggcatatgaccataagagttctaactgtaactgactgaagatcaattgaggtggcttaccaccgtccgaccagccccagtacatggcttcacatttttttttttttttttgagacggagtctcgatctgtcgccaaagctggagtgcagcggcgcgatctcggctcgctgcaagctccgcctcccgggttcacgccattctcctgcctcagcctccccagtagctaggactataggcgcccgccaccacgcccggctaatgttttttgtgtttttagtagagacggggtttcaccgtgttagccaggatggtctcgatctcctgacttcgtgatccacccacctcggcctcccaaagtgctgggattacaggtgtgagccaccgcgcccggcccacatttatatgttatgttatgttatgttatgttgttatttttggagtcggagtttcgctcttgttgcccaggctggagtgcaatggtgcgatctcggctcactgaaacctcagcctcccgggttcaagcgattctcctgcctcggcctccctggtaggtgggattacaggcatgcgccaccacaccctgctaattttgtatttttagtagagacggggtttctccatgttcatcaggctgctcttgaactcctgacctctggtgatccgcctgcctcggcctcccaaagtgctgggattacaggcacgagccacctcgcctggcctcacatttatttatttatatttatttattttttgagaggaagtgttgcttttgttgcccagactggagtgcagtggtgccatctctgctcactgcatcgtctgcctcccgggttcaagcgattctcctgcctcagcctcctgagtagctgggattactggcatgagccaccacgtccggctaattttgtatttttagtagataccaggtttcttcatgttggctaggctggtctcgaactcctaacctcaggtgatccgcctgccttggcttcccaaagtgccgggattacaggggtgagccaccgcacctggcctcacatttattcgtatatcttcctctttcagttcacctagggcgtagttcgctggttgcagggtacagttctatacgttttgacaaactcattgggtggtgccctgaccagtgctgccgtccaggtgcagaacccccagcttccctgcggcgcccccatcctcagcttgcctgggagctcctggctgctccccacctggccttacctgtagttctgccattctcagaaagttggctgaatggaatcaacagcatgttgccctttggtcctggtggctttcaggcggccaaatccgtgttgctgcaggtttcaaaagttaccccatttttttgctgactgtaaatccattggacagttgggccacagattgttgacgtgtttgcctgtgggtcacaggactgtgggctgtttccaatttttggtgattagaataaacccgcactaaacaccactggcgggatttttggtgaaagtcagtgttcgcgtggcgaggttctcaggggtggaccgcacggcctgtgctaagcgtctgtttaacatctgcatcccaacagttgccacttgtcagtgctaagaaacccactggaacccagcgtcggggcctggggtagtggtcttgccagggaccctttgccttttccttggtactgaagtgaacattcacgtgaaggcagccctggtgtccccgcccgcatgcctgctgccctgcctggccagtgctccattgtaaatagtaagggcgagagctggcgggagcgggctttctagtggtgggcgggactgtgccgtgtctttccctccctggccaggccctggcttggcagggtgtgctggtcctggcgccgtctacggcctcttcctgctctggttggcccactgccgggcccagcatcttcattcgcccaagtgccagaggcagccttctgacaacctcgccgtgacatttgtcattttctgtgttcccgttgaggaattttgctttctcacaagaagtgaggggtggttctgattttcttttcttttctttttttttttttttttttgagacagagtcttgctctatcgcccaggctggagtgcagtggcacaatctccactcactgcaagctccgcctcccaggtttcagtgattctcctgcctcagcctccccagtagctgggattacagacctgtgccaccatgcctggcttattttgtatttttagtagagacagggtttcaccatattggccaggctggtctcaaactcctgacctcaggtgatccgtccacctcggcctcccagagtgctgggatgacaggcgtgaaccaccgtgcccagacgcagctgcagcagcacatttattcatgattcattccaacagcagctactgaatactcagtgttgtgggggcacagaggacaacaagccaatattctccccccgccaccgccccagcattcttagtctcaagaaacctgtcaaatgaagacaggccgggcacaggggctcatgcctgtagtccctgcactttgggaagcccaggcgggaggattgcttgagcccaggagtttgagacaagccagggcaacatagggagactccatctctaccaaaaaatttaaaacagtgaagttaagtagattataaatagaagttcagcagagatactgtgctgagtacaaggtcagctgaggtccccagggaggggctgccacttctgccctgggggacctgtgggtggctgcttggaggaggggccatccggaggaggaagcagaaatagccacaactgtccacgctcggaaatgagcagttcggaaggggtttgcccaattggcaaacgcaagggggaggaagggagatttttattcttacatgacctgggagttcctggataaccgcttttctcaagccccgcatggcatttcttatttttttgagagggaatctcgtactgttgcctgggctggagtacaacggtgtgatctcggttcactgcaacatctgcctcctgggttcaagtgattctcctgtctcagcctccccagtaggtgggactacaggcacccgccaccacgcccagctaattttttgtatttttagtagcgacaggttttcactatgttggccaggctggtctcgaactcctgaccttgtcatctacctgcctgggcctcccagagtgctaggattacaggcatgagccaccgtgcctggccctgcgtggtatttctagggcaggatggccctgcccttcttctagtgggaagggcacaagtggcattattggttgtttgctcggaaagaaccttcaaaggccacagaacgggaccttccccctggtgactcacaggctgtgggcgggcaggggcggcctccactggccaagggtccggactctctgactctcattaatgagtgagtacatgttccgcctgacagcctggcctggagcccggctgtgggcggcggtgagtgggcagccagcagtgagtagcagccggggcggggtgagctgtccccaccgtgactcagaaggtattttctgctgctgacctctgagcttgagtgtcctgagtaatcccagctcccccggaggcagattaacctttaggcagctttgtgtgagtaaaggagtcgctttaaataggaaggaataatagaaaaaacccaagtgttccgttttatagcaaatgcacactgctttgttcctgctggcctgaaagaggttgcagggggtactggggcggggaattgtccagaaactctgcagatgatacagggacactccagcctagcctctgaggagagttttttttgagacggactcgctctgtctcccaggctggagtgcagtggcccaatctcggctcactgcagcctccgcctcctgggttcaagtgattctcctgcctcagcctcccgagtagctgggattacaggtgtgagccaccacgcccagctctttttttcctttaaaaatctgcttgttatctgctgctcatcagagtgtatatttggggtaattcgagcctgtgctcccaggttgcagtcctcaaatgtggcccaaataaatgctccacttatattaattttgctccagttcctttcctttagctcgacagtgtgaatctacaattatcttaaaataaaaagtttaattaaaaaaaacacacggttgcccaggcacggtggctcatgcctgtaatcccggcactttgggaggccaaggcgggcagatcacctgcggtcaggagttcgagaccagcttggccaacatgacgaaaccccgtatttaccaaaaatacaaaaattagctgggcgtggtggcggttgcctataatccggagaattgcttgaacccgagagggggaggctgcagtgagctgagatcatgccattacactccagactggtcgacagagtgagactctgtctcaaacaaacagacaaaattagataaaggaaaaaagaatttttgttcaagtaatattggccattgatggctgcaaatcactcttggtgttacagattccaggaacaggaagatagtgtccgagaccaggatgcaggaacagatagatgcctttccacgcttgcccctggtgtggttgggaggcgtgactgaaatccttgctcttgtctctctggacctgatgcattttgcatgcctcactgggcacggactgcttggagctgtttttatcttccagcagtgtgaggtgtaggaaggacccaacacggttcctcctgtgctctccgcagtcaacacagaggagttgcggaaccagatacgggtacccggggattcatcagttctgtgtttcctactgggcagccccgattcaactcacttccagcatgtctacctcgacacaggctcagatcccacggggtaagggctcagtccccaagactcccccactttccatgccagttagaggcctcacgttgtgacctgtgcttctgagtgaccggtcggctgtaaatccaggttcccgtcacccttacctcggcttgattacattgcctcagtggctcacagaactcccgagaaacacttaggtcctttggttaatgataaaggacgatctgtgggatgcccatgaatactgagaaatggatcctcagggcaaggcatgggggaagggcccactccctccaggagtctcccggaacgtgtgtctcccgggacctgtccccctccaggagtctcctggaacctgtccccctccaagagtctcccagaacctgtcctttagagtgttgtttctctcattatttttgggatagggtcttgctttgtcacccaggctggagtgcagtggctcgatatctgctgactgcattctccgcctcccaggctgaaaggattctcttccttcagcctcctgagtagctgggattacaggcatgagccaccacgcctggctaaattttgtattttttggtggggccttgctgtgttgccccaggctagtggtaactttgataagctttgggcctcagcctcaggctgtgtggtggggtctaaggtacagcaggggccccagaggagtcctccaggggaaggactgcgagaatgctgtggcactggcagagccttttacctggaggatccctgcattgagcccttctggtcccgaattgtactgagccctcttcttcctgcctgtaggctgaaagaatgaattcctggccctggaaggttcaaacagcagttctcaggggtggaggtggctctgcccccaggggacacctggtggcgtctagagacctttgcggttgtcaccaccggggtgggggaagcccaaggatgctgctcatcactcacagagcttggggcagccccaccaccgagggcgggccaggagacgccaagagctgtgcctttcatcgcctggggtcccgggcaccgaccgccgccgggtgtcgctccgtgttcgtgtacatgccttctcctgggggtagccctgcttttatttcctgagtgcttcctgggaccatgcatgtccggcaggccctggccaagatccaggcttgctgcgtgcagtccccgcccactgtgtccccctgagggaaggacctgaggtgaagttagcgtaatgggagtgtatttgggcctcgtttgcgggctgcagctctggagacacagattcaagtgcccagaatgtatgcgcggcagttacaagtggggcttcctggagaaaagaaggggcggcttttgcattggaatcacagaagtgattgcccggctccacgtccttcctggtatctcagactccagggacgtgaagataacagatggtcacattgtgcaaatagtgataaccttgtaggtaattcatcagctagtgtggaaaccccaggggaggaaagaaggccctgggagggagtgactgaaactcacttggaggctctctgggcctgtggagttctgcacagcatgcagctcccactcctcggacgcacttttcttttttgttttcttttctttccttttttttttttttgagacggagtctcgctctgtggcccaggctggagtgcagtggcgcgatctctgctcactgcaagctccgccttcagggttcaagtgattcccctgcctcagcctcccgagtagctgggactacaggcgcccgccgccacgcccagctaattttttgtatttttagcagagatggggtttcaccatgttagccaggatggtctcgatctcctgacctcatgatccacccgccttgggctcccaaagtgctgggatcacaggtgtgagccaccgtgcccggccagccacttttctttctttctttttttttttttgaagacagagtctcactctttttactcaggctggagtgcagtggcgccatctcggcttactgaaacctccgcctcctgggttcaagccattctcctgcctcagcctcccgagtagctgggattacagatgtgtgccaccaggcccagctagtttttgtatttttagtggagacggggtttcaccatgttaatcaggctggtctcaaactcctgacctcgtggtctgcctgccctgcctcccaaagtgctgggattacaggcgtgagccactgcgcctggcaatatttttcctcttttttttgaaataacatccttgttgtgacagttcacgtatcataaagttcacctgttttaggctggacgtgagaatggcatgaacccaggaggcggagcttgcagtgagctgagatcgtgccactgcactccagcctgggcaactgcgcgagactccatctcaaaaaaaaaaaaaaagttcacccgttttaagtgtacatttcagtgtgttttagtatattcacagattgtgcagtcgtcaccattgtctaattccagaacgttctaatcaccccaaaaggaaacgctgccgcctcagcagtcagtgctggtctcccctagcgtcctggagcgtttttccctgcatggaggcccacgagtcccgcgctttcctccttccctgtcacgctgtggctttaggaggcccacgagtcccgcgctttcctccttccctgtcacgctgtggctttggcctcaggctagagggtcggtgtctgtcagcctgtgctcagacgagggcgaggagagttctggtcagcgcgtccagcctccctcctgtgttgctttgctgctggaaaaagagggtcctgatgcagaccccaagagaggagagaactcgaggtgagccgcggatcacagtgagagcagccaccaagccgcttccttacacagcgggcctccctgacagagcagggcgtcctcggggagcaggcagagggtgcctgctcttccttagcgcctccgtctgtgagaaacggccagggttgcgagtaaacctggaacgtgcagacactcactggaggccagccgggtggtgccatccgaccacccttcaagcccagcctgctcaccggccctctcagtacagcgggcacgggttctgcgggctgcccggaagacctcccccagacccatagatgctctgtgtccttggtgggcagctcataagtgtgaaccttcccggtaccttgcgagtgcctcactacgcacttcaagacggggtcgctccggttgtgttttatgaaaccagaggcctggtgagctgagcttcctctcacagcttcacagcagcctgtgtgggtggcctcagccctcctgagcccctccagtgtcgagttgctttgactgtttccagggaactcctttggttgttgcgtagcttgggctgtttgtttgtttgtttgagacaaactctgtcacccgggctggagtattggagtttagtggcgtgatcataacagtgcaaccttgaactcctggctcaagcgatccttccacctcagcctcctaaagtgctagcactacaggcgtgcacagctgtgcccagccagctggggctgttgcacatgggctagttattatcaagtcagctgaagccttgtcagccatccttggtctgagctctccctggctctcgggcagcaccgtcttcctcctgtggaggtctgagtccccttttcacactgcccttgatcctacagacagatgctcagccaggaagcaacatgctctgatgtccaggcccagctctgctgtgaagtagctgcatggacttgggccagggcctgtgtggaccttgggttgagggtcaagtctaaaaatgctctgtcaggttgggcacagtggctcacatctgtaatcccaggacttggggaggccgaggcgggcagatcacctgaggttgggagtttgaaaccagcctgaccaacgtggagaaaccccgtctctgttaaaaatacaaaattagctgggtgtggtggcgcacgcctgtaatcccagctacttgggaggctgaggcaggagaatcgcaaaagctaagataaattttgtttttttctttttttagagatggggtcttgctgttcacccaggctggagtgcagtggtgtgatcacagctcactgcagccttgaactcctgggctcaagtgatcctcccacttcagtctcccaaacagctgagactacaggtgtacctgtcatgcccagctagttaaaaaaaaaaaaaagcaaaaactttttttgaagagatgagggtctcaatatgttgtccaggctgatctcaaactcctagcttcaagcagtcctcccgcctcaacctcccagagtgctgggattacaggcataagccattatgtctgatctctttttaagtttttaaatatatgtgtgtgtgtgtgtgtgtgtgtgtgtgtgtgtgtgtatatatatatttttttttttttagatggagtcttgctctgttgcccaggctggagtgcagtggcgccatctcggctcactgcaagccccgcctcccgggttcatgccattctcctgcctcatcctcccaagtagctgggactacaggcgcccaccaccacgcccggttaattttttatatttttagtagagacagggtttcactgtgttagccaggatggtctcgatctcttgacctcatgatcctgcccgccttggcctcccaaagtgcttggggattacaggcgtgagccatggcgcctggccgatattttgtatctttttaagagttgaggtcttgctatgttgcccaggttagagtgcagtgacgatcatgattcactgtggcctcaaactcctgggctccagtgatcctcctgcctcagcctcctaagttgctgggaccccaggcatgggccactgcatctggccaaggagataaattttcataacttatttaaccaagtataactggaatattatcattttatcatgtaattaaaaaattgttctggctggacgcagtggctcacgcctataatcccagcactttgggaggctgaggtgggtggatcatctgaggtcaggagttcaagaccagcctggccaacgtgatgaaaccccatctctactaaaaatacaaaaaattagccaggcgtggtggctgacgcctataatcccagctactcaggaggctgagacgggaaaatcgcttgaacccaggaagtggaggttgcagtgagccgagactgcgccattgaacctgggaggtagaggttgcagtgagccgagaccacaccactgcactccagcctcggcaacgagcaaaactccgtctcaaaaaaagaaaggaactcccacacgagctggaagccagcactgggctcttccgcacagaggctcccacccatagaccaggagtacgaacccaaccgtgctgctctagacatgggccctgggatgatcacccaacctctgtgtcccggctctgcctgtcccctgggctctccaggaacaggtctgtgctggaaacgcctcttggccgaggctgcttttactagacatccactctcagttgggggtcctccaggccctgcacacccacccaccatgagagggaatgtcaccgcttggcctttgggattcagaaaaacctggtgaagtctgcacaaagccctgtcccccagccctcggtccacacagcatcccacaccacaaggcacctctggacaggaggcagtgcgagcaagaggggacaggggcagtaactcggggtgcactgcctggtggggacactgtctccctagctgtgaatgacagggaatgaggcacaaggacgaaacaggcgtggggcagagggcacggctcgcgggagttgcagagcgagttcaccctgctactgcttctgcggggcactcatttttagaagtacacttacgtggcccccaaaataatgtcacgctgccaaggagagcaggcaagggcaggtgacaccgctgtcaatcagagcatttccagccctcacacctgtgagtcatctggctcccaggaacattctctgttccagtaaggcctgcgcctgtgagaagcgcttggctgaatcctaggaagggggacttgggccgacagccccctccaacctgcgcagcctcaggacactcaaaccacagctgcaaacactgccagccagacatgcagctcccgcggccaccactttgagacagcgactccctgtgacaagaaaactctgaaaccaggcgaggcagggccctctgtcagatgatcactggggaagacgctatggacagacaggaacttctgggaccacagcaggctggaattccagcttgaggagggagaggggaaccctgccgtgggccctgacagtgagcaggaggaaaggggtctcacagaagcaggaccccgatatgagggagcaggcccagcaccccttcctcccgcccccagcccctatccagagagcaggctggccctctgggtctcgcttcagatgcgtagaacccagtgcttccggctgcaccctgcaacatcccgcagcagtctgtgggggtccgcaggaagaagactcccccgtgagggggagctctgtggagcggcactgtcctgacggcagccactagccactcggctgtgggcacccgacatgtggctggcgggaaggagctgtgcagagcacagaacatacaggaaacgaccaggtgtgctgcactcgccccacacacgcagtcaaatcacgcaggaacaattttttttttttgggagaaaaagttttgctcttgtcgcccaggctggagtgcaatgccgcgatctcggctcactgtaacctctgcctcccgggttcaagcaagtctcctctctcagcctccctagtagctggaattacaggcacccgccaccacacccagctaatttttgtattattagtactactaacaatttttatattattagtggtaataatttttgtattactagtgatagagctaatatttgtgttattagtattcgccacgttggccaggctggcctcgaattcctgacctcatgatctgcgcccagctcgtgttgaagttctttagccacctttgagcaagggaccctattttcactttgtccggggcctgcaagttctgcctgctccctcgccaaccctcgccagccctgctctccgctctgcccagccccggctcttgcctcctcctatttctttttcctttttttttttgagctggaatctcactctgctgcccagattggagtgcagtggtgcgaccttggctcactgcaagctctgcttcctgggttcaagagattctcctgcctcagccactgagtatcttggattacaggtgtgtgccaccacacctagcaattttttttttttttgagatggattctcactctgtatcccaggctggagtgcagtggtgcagtctcagctcactgcaacctctgcctcctgagttcaagtgaatctcctggctcagcctcctgagtagctgggattacaggcacgcaccaccatgcccagctaattttttttttttttgtatttttcatagagatggggtttcactgtgttagccaggctggtcttgaactcctgacctcgagtgatccacccgcctcggcctcccaaagtgctgggattacaggtgtgaaccaccatgcctggccattttttttttttttttggtatttttttgtagagatggcgtttcaccatgtctttgggaggccaaggcagacagctcacttgaggccaggagtttgagaccagcctggccaacatggtgaaaccttgtctctaccagaaaaaaaaaaaaaacaaaaaatctccaaaacacacttcactttgaaattttttttttttttttttttgagacggagtcttgctcttttgcccaggctggagtgcagtggcgcgatcttggctcactgcaagctccgcttcccgggttcacgccattctcctgcctctgcctcccgagtagctggactacaggcacccgtcactacgcctggctaactttttgtattttttagtagagatggggtttcattgtgttagccaggatggtcttgatctcctgaccttgtgatccacccgcctcagctggcctcccagagtgctgggattacaggtgtgagctaccgcgcccggccacgcccagctaattttttctatttttagtagagacggggtttcaccttgttagccaggatggtctctatctcctgacctcgtgatccacctgcctcagcttcccaaagcgctgggattccaggtgtgagccaccacgccaacccctaaagtggttttagacttagaagaaagttgcaaagcaccgcacagactttctatgtggctttatttcatcacagtaccctgatccgaaccaggaggtggacggagctgtggcctcagtggcatatacgtcccatcccatcattgccatgagcccttgtgtctcctgtctcccctatctaggctgatccctcagtgcataaggaaagctgggggggggtctcctatggtctggcctttggaggagagccagctggggtctctgtgtggcacccctcagtcaggcttggctgcttctctcagggttatactgaggttctgcatcctggcaggagccccacagatggggttgcgtcccgctgggccttgggaggctcgtggcggctgcgtgtctcactgtgatgacgctggccttgtgtttcgtcaggtggtgtccacaggtgccctgctggttgctttttctctgccctgggagaggctcgctgaggctgcacggctgcctgggagaggctcgctgaggctgcacggctgcctgggcggcctctgacgcgccctgtggactgcagcatccaggggatcgcgtctgcaactcttattgctttggcgtttacctattggggatttaaaaaaaaattgttcatttttataaaaaagacatgggctggctgggcacggtggctcaggcctgtaatcccaatactttgggaggctgaggtgggcggatcacctgaggtaaggatttcgagaccagcctgatcaacatggagaaaccctgtctctaccaaaaatacaaagttagccaggcgtggtggctcatgccagtaatcccagctactcgggaggctgaggcaggagaatcccttgaacctgggaggtggaggttgcagtgagccgagattgcaccacttcactccagcctgggcgacaaacaaacaaacaaacagaaaaaagacatgggctctcgctgtttcccaggctggcctcgaactcctggctcaagtgattcgctccctgcacccagcctgttgtgggtttatatcagcacagtagcacgcagacgcgacgaaagtgcacgtgtcctggtggcgtgcacttggtctctgattctcggtgatgggtgtggagtcggagaggcttgggtggccctgctgggtgtgaacctgcctttgacattggccttgtagagggagcgaagggcagggtgctggacggggagggatctgtgttaggccaaggaccttggttttagttgtggcaggttctgggctatggcgaggccgcccacgtgggctagcccagtggtttttttcccatggtacagttggggaaacaggccccgtggaggctctatcacctgcggtcacataccaggcctttgccaacgcaggactcccagccaggctggagctccctggctggagcagcgtcgggagaattcccggtgggcctgcggagcgcggtctgagggacttgggctgtgttgagggatcaactgacctccagggaaaaaatggggagacatgtggagcggagcttggggcggccgtttgctttagggtgggagaggagcaggaccgggggccatagactccatcccaggccgctgcctgctcgctgcctgtagtaggacacagcgtgccagaataggtccccggcaaggtctgtgttcccttcgtggtccagggtctgggagtgtctctggtggtacccgctgggtggtgggcttgggagctgcaccagttgggaaatgaagagatgggaagttgacggcatcgcttgtccgggaagagagcgatgggctcacggggtggaggatggctctgcgtctcaaacttctctctctgtttcaggataaacatcacgatgctgctcatgaaatcatcgagaccatccggtgagtgcacggcctgcagtgtgttgtcttcacagccctgagccacttccgtggacacccgtgccctgcagattctgttgtggggatggctcctgcaggggtggactcctggaggtgttgtgaagcggatcaggggtgactcagggacgggtagagctgcttctcccagctccattcctggccagtgggtgcagaagtcttgagctgctggggtgtccagtgggtcctccaggggcgttgccctgccttcctctgtctccttgtcagtctccctgctgtgggttttgggccgaccttcaccctcacgcgccctcgacggcctcctgtgtctgtgccccatgggtgcagagaggagcattctgggggtgacttggatgggcaggaggcggaggccgtcctgtcctcgtaagctccagcctgggctccaggatctgcagcaacagtgcagggaggccctctgggtgcctctctgctgcccactgggaagctgcccatggtggccggcattctgcgtgtctcaggtgctcagggtcagaaccctcattgtgtggcacctgcacggaggccacatgtgtccatgtggccctggcgtcttgctggtctgttccttagcatactgggctgtgaggacaccgcccgtgcccatgcccagcatctgcccaggcctgcagctgccataagggccatgctgagctcctcttggccgggtggctctgtgccaggcccctagctcctgaggccctgtagttcagtgttggggcccagcggcacctccctggccaggttgtttgaggattaagtgaaatcgtttgtgtaggtcggccagggtgggcctgacccagggtccgtgcttagaatgtgggatctgcttttttttaatgtcatgatccgtggaccaggcagtggagtaggggcccctctgttctttgtaaaagaagtctggtgttatggttggagggagggctctggatcaggcagctggaccccagcccagcccccgcccagcaccagccccagccccagccccagccccagccccagcccagctgcagcatgcttctggcggccagccgcctctctctgcctgggtttctcttgttgcagctgggggccaagactctgctggcgtgggcctctgtgggtgctcctcacagagggccgggcagtctttttaagaatgctcaagctgtgcacggtggctcacgcctataatcccagcgctttggaaggccaaggcagggagatcgcttgaggccaggagttcgagactggcctgggcaccttggggaaaccctgtctctactaaaaaaaaacacaaaaattagccgggtgaggtagcaggtgcctatagtcccagctactttggaggctgaggcaggagaatagcttgaacccagggggcggaggttgcagtgacccaagatggtgccactgcactgcagcctgggtgataagagtgagactccatctcaaaaataaataaataaataaataaataatgctcagctgggcatggtggctcacacctggaatcccagtgctttgagaggctgggagggttgatcacttgaatccaggagctggagattggccgggcaacataatgagaccccaagtctacaaaaaagtaaaaaattagctgggcatggtggtgcacacctgtggtcccagctacttgcggggctgaggtgggaggatcacttgagaccagtggcgctgtgattgtgccaccgccctccagccaggcaacagagtgagaccctgtctcaagaaacaaaacccaaacaagaaagagtgctccagggctgtggcttcccggggctgtgactgtgcaggttctgccagtgctgcccagacgtggtctctctgggttaggatctcggtgcagcaggggtggaagcccctctctgaccaggcgcttgctagtgtgtctggaggtgctcagcagcaggggagctgcacctgctccccatgggaaggggcctgcacagacttctggggtcagaggagaccccaggcccccggatctcaggcagtggcggtgagagtgcctctctggctgcatgctcgccttctgcagggctcggagctgactgtcttgtttgaaccttgtgtgttttctggggagcgcatctggagtctggagcttaagcgttgtagggagcagggtccaggcacaggggcgtgcaccaacacctgggcatccgcgacgtaggcagagacctcgaaactcgaacccccaccacctggagaggctgctttctcccgtgcatccccagcatgtggccagggttctcacggtgtggctgcacagaccttttctgtctcacttcctctagaaacaccgacgacgttcttacacagcaaacaccattcagtccccatacggccagtgtcccaagcacgtcctcccacagtggtgttgtttttttgagtcagcgtctggctctgctgctcaggctggggtgcagtggtgccatctcagctcactgcaacttccacctcccaggttcaagcaattctcctgcctcagcctcccgagtagcagggattacaggtgcctgcaaccacgcccagctaatttttgtatttttagtagaggcgaggttttgccaccttggccaggctggtctcaaactcctggcctcaagtgatccacccgcctcggcctcccgaagtgtggggagggctgttgtttaaagatgattgggctgtcctaggctctcctcgtttggatgtccgttgagaatcagcctttccatttctccagaaaagctagctgggctttttctagaaattggtttgagcctgcagttcagcttggggaaaggggcgtttaaacagtgtcactcccaggtattcctgcttcagtgcttttttttttttttaaggcggagtctcactctgttgcccgggctggagtgtggtggcgcatcctcggctccctgcagcctccgtctccggggttcaagtgattcttcttcctcagcctcccgagtagctgggattagaggcgcccgtcaccatgcccagcaaatttttgtgtttttagtagagacagggtttcaccatgttgatcaggctggtctcgaactcctgacctcgtgatccgcctgcctcggcctcccaaagcactgggattataggcatgagccaccacgcccggcctttggtgcttttttatgtggcattttgacaatcctttgctgctagtatgtgtaaagactgctcccttttgcctatcggccatgcccctgctgagctctggcggtgtccgcgcgtattcctcagcacgctctgtggcgcagaaccacgggactgagtgaagaccgtgcggccgctcctttcaggctccttgctgctttgagtgtttttcttgccgagttgcgctggccggaacctcctggacagtgtgatgagaagtgactgcagatggccttgcttgggttgctctcggggcctcgctcggtgcctggggcttttgatgatctgcattgtgaggtcccctgccggtgttggccaggtgtgcaggcgttgaccatgctggggacgggtgacgagaggcaccaataatcacagagggcggatgccacagcccttctgacaggatgctgtgtctttcagtgtggaagggtcttggagggcacccggacctgaggtcaggtcctggccagctggttggggagtctggggacttggcgtggggtagggggcaatgaagctactctcggagttctgggaagctgcccgctggacttagcaggtcaagaggactggggagcagaggccgaacccccatccctccctgacccctcctgcagagccgcaggccaggtggctgcggaaggtgggcctgctgctgtcacagcggctcagtgactggtcccgtgccctttccaagcggaaggcgtgtccttccatttctggcctcttggagggtaccgtcctgatggcaccgaatgccgtcctgtgggctttccgtactcgcccacacggggctgctcagatctccgtccttgttccttcggtgaattgcagtgactaattttagagtgaagcagcttttcctccccaggaggtgctgtgtgtggttgtgaggtgccgctgcggtttcctcacgtttttaagggatagtggggtgtgttggtcagggatgttggtcagctgttgcctttcttgtcctttctttccagccctttgcgtctctatggttttggtgtcaagatgacgctggctgcataaaactctgagaaagtttctgtaggtttagtgtttgtcttgtcagtgtttgatggaattcaccagtgtgtttttgtattttgtatttttagtagagacggggtttctccatgttggtcaggctggtctccaactcctgacctcgtgatctgcccacctcggcctcccagagtgctgggattacaggtgtgagccaccgcacccggcaccagttggctttagtttctagtcagtcagttgcttttcgagctctgatgtggccagtgggtccctagaccagccctgtagcagataagttcacttaggtccccagagccactggtgtgtggcctcgaagccacgtaatacctgtgtgattcagtaacagcttcgtggtaaacatcgtagccttcgttttgaagtcacgcctcccttctctctccactttgagtggaggggtaaggatgtttgttttctgttggagaggatgcagtgtttaagaacatgcggggtaatactcaagattgtttacacctgtcatcccagcactgtgggaggctgaagtgggcggatcacttcaggtcaggagtttgagaccagccttgccaaaatggcctaacccggtctctactaaaaatacaaaaattagccaggcgtggtggtgggcacctgtagtcccagctacttgggaggctgaggcaggagaatcgcttgaacccaggaggcggagcttgcagtgagccaagatcacgacactgcactccagcctgggcaacagagtgagactccgtctcaaaacaaaaacaaaaacaaaaacaaaacacaaaacaaaacaaaaaaaaccaaacccttcctgatcgtttctgctgctgtgtttcagatgggtctgtgaagaaatcccggatctcaagctcgctatggagaattacgttttaattgactatgacaccaaaaggtaagcagagtcctgtccagccgctccgctccgaggacagactcggctcttggggaggacaggaggacgcatcctataattagctcttcttagatggtgcaagctgatctgaaatttccttttagagttggccgtggccaccataaagttattttggtaggaaatgtttatcaactcttggcaaaggctgtcagaggccggacagaattggaaactccggttgtggaaagtgggattggcatgtgtggagtcagcccgcgctagtgatcgctctttttatagcgggcggctgacggccagaagtccgcgttcctgcctgaggctgctgggagggcctgggcggccttaggctgcttggcagctctgtttagatctcagctgggtttggttagtccctctgtctccagccctgtggctgcgttagcaatttcgccctggcagctcctgggtctcggaggagggtcttgtgggtggagaggggcagggctgtctctggaatgcttgcttggaagtgttttgtttttctttgacaaggaagacattccaggctcatgcctttttcagctcttgagtctgaaatcaacagagtagtcctccatcaagggctgtgctgtcgtgagcttaggtgagcccctctccacagagagtcaagcccagagggccacgcggctgcactttacctggctctccggcctcactggcatgtgggagggactcttgtctggggtcagcggtctcagcctcagtaaacctcgagatcctgtgcccctccctcgagccctgcccattccctggtcagcaccctggtgccccacaggcagacaagcgtgttgctggcagggtcctgcgtgccgacctgctgctgtggatttcacgccacctgcctcgcatgtcggggcctctcgccaccccccctcattgggcgtgatggtgtgctgggcccttccctggtttagtatgaagagtgtgatgcagcgtgcagatcaacagccgcatggcagggtccacagggaggggcctgcagggccctgcacagagctctgtgtccgtggagttggggagcactaaccccaaagctctgcaccctgtgctttcgggttttcacggaggcttctcggagacttgcttgatgattgcctccatctccagtcccctctttctaagcttcttaccgcagcttgggctttacctcacccaggagccccccacaagtcgcttccttacaacagaagacactcctgtcacctagaagttcccagggatcaggagctttgttaggaactagagtcccctcggatgagtgggtgttgtcgggctgagccctttcacattaacctggggcagttatggcacctcacttgtgtgtggccagcttctgccttggctctgagcagcgagcgtgtcagacgctgtgctcacggcgcccctccacgtgggtgtgtggcgtccttcctcttcgcgtgggatgggcttagccaaggctggaaggacatcagggacaggctgggcagggggtcttcgttggagctggcagggccacctgagggaccgagccattagggcttcagaccaaggacagccccagctcctctgagcacctgcatttgcacagcctgccagggaagagtctcttcccaggagcgtgcagaggtgattttgggaaggtctggttgtcagggttgaaggcggcgtgtagaagtggaaacacaggggctgggcaccgtggctcacacctgtaatcccagcactttgggaggccgaggcggatggatcacgaggtcaggagatcgagaccatcctcgctagcacagtgaaaccccgtctctactaaaaatacaaaaaattagccgggcgtggtggcgggtgcctgtagtcccagttagtcaggaggctgaggcaggagaatggtgtgaacccgggaggcggagcttgcagtgagctgagatcgcgccaccgcactccagcctgggtgacagagcgagactccatctcagaaaaaaaaaaaaaaagggaagtgaaaagacaggaagggccagggctgctcctctggagctgcggggaaggcgggaggcagcaggccggctctgtgggttcctccggcccgcatggtgcctgctggccctctgcaccacctgggctccttccacccccgtgtccttcgtcctccggaggatccaggtcctgtgtggccgtgctcccggggctgtcggcaggctcttgttcttggtgtttgctcctcttaagttctcttgctttatcctatgcagctgctggttaaggaaaacatgaacttggcctgtggagcactggttttcctatgaggaaggggaagtgtgaacctcggcacatgcagtgcccaggtgaattcagggtggccagggcagggcaggaagagcatggggctggggctggggtgggagcaggggtgtgattgtttagccacgtctcggagcatctgccaggctcttggggttgccattgggaggaaactgcttgcgtgcacgtggaggtggcggaggacggaggcggaggaaagagtccccagccgccgccccccccccccccacccgcacaggtgcaggccccctcggcgctggggatgtggaagtcggattgttctctgggaggggccgtcctgggcactgcagggtgccgagcagggtccctgcctccatctcttgcttgcctcgccacattcctggggtccccggtgagagccactgtgtgtgacagtgttcactggacaggtacgcctcctcctcctgtctcttgctctgctctggacaccttctgaggtggagggacagacgctgttgtccacattttgccagtgggtccaacagacttggaagatgagcaagttatcccaggtggagactggacagactaggccaggcagaccccgtagcaggcttgcccccaccccggaagcccctctgagcccaggcctggctgggccgcgtggccggtgtttcttgtggctcacgtgccccacagacagtgggcactccctggagcacaggtgccccctgccctctggtgggctctgccccgatgctgttgggttgtgggcacttaggtaatgagggtttgccttgcggccagggcaaggagggcagagttgctgcggggggactgagtctcactgtggaccctgctgtgccgtgtctgacatgacacactgctgacgtgacacactgctgacgtgacacactgctgacatgacacactgctgacgtgtgaatgagttggagctttggaaggacacgctcacagagcagtgtgggtgggggtgaggcatcttcctttctgcagtgctcactcctcctgcacctgcccgggcagaggcctggtggtccctgggagaccccagccgttcacctgcctctggcgatggtggctgtccccagccagggcaaggaagaccctctaaggccggccccagggtttcccacttggggggctggcctcagtccccctcgagccctctttctctcctcacgcctccagcacacgtggacctcggctttgcgcgggagcctgggcaggtccagactgcctcagggctcagtgcttccctgcaccggactctcggccggccacctcgcttgtgtgtcaaacctgaaatctcctgcatcagggcggaaagcgaggcttctgccagaagggtcttggccagctggctggtggctgtccaggcagggaccacaccttggagcctgccttatccacatgctgtcccctcccatgcatgcggctggctcctgcccgcatgaccagggccttcccttgcctttttcagcttcgagagcatgcagaggctctgcgacaagtacaaccgtgccatcgacagcatccaccagctggtaggtggcttgcccctgcccagagggggttagtagtgccaggctcccggacccctccagaccccttatgtcaccgcctcggggcacagagctccccttagagcccctggggattggaatgtgcagcgtggggggacgatgggctgtgggtgagtggtgtgggggctgccgaggctgggctgtgtgctgtggccgtgtgccaaagcagagccgtccgtggtttgtgtgctgaggcagggccctgagggttgtggtgtctgcacacgcctctgcagccctgggttggtgtccgcaggtcccagcagaggcggggtccctgtcctccccgggctgtgtgaatgccggccttcccccttggacctcccccacaccgcctgccttcatcaggctggatgccggcctgggctgcacccttgggcaccccggtcctgctgtgtctcgtgaggctttcctcacagaggacggggcacacagtgagctggggtgtagcagggaggggaacgtgctgcttcccatgttctagaaagcaccgggggcccctggtgcatgggggtaggggagctctttcttgaaggtcttgctgtggagggagccctggtgggggtggcatgggctcacttggccctcctgagtgggactgggctgggctgggctgccccatcagcctgccacccggctctggcttcccctcaacctcatgcatgcagctctgtgggcccctgagagctgagctggcctgggcgagaggggaccacctcagcctgctgcagctggtggggaggaaggcggggtcccacgtagtcgagtcagatgaggtgtggtaggctcagggctttcacggggctcgtggcacctgacgggggtcccttggtgtcagcgccccaccctgctgccttggcccagaggaggggtggtggtcttggtggcctgtgtggttttggtggtcttgccagtggggagagaggcccgtggcaggaggtggagcctcctaggacccctctgagttggggcctgtccctggggatgctgctttactgcttgtaggaaatggggctgggttggaaactgacctgggagcccggcagccaccctgcagggggacgagaggccatgcagccgactccctgcttccgctgggaaaggtcccgggtcttggtggtggaggggctgggccgtgaggtttatgtgacatggccgggccaccctccgtccgcagtggaagggcaccacgcagcccatgaagctgaacacgcggccgtccactggactcctgcgccatatcctgcagcaggtctacaaccactcggtgaccgaccccgagaagctcaacaactacgagcccttctcccccgaggtgtacggggagacctccttcgacctggtggcccagatgattgatgagatcaagatgaccgacgacgacctgtttgtggacttggggagcggtgagtgtcgcccgccatgcccggctcctgtgcacttccaggccacacgctctgtgcctgccccatgcctgcttggagaagagtttatcagggacttgcgacgttggcgtggacagtgcttccttctcccagcgcctctgtcccgctgtggggccgttcctttccccagccctgaccgggctccacccagaggggagaaatcgcaggaacccagtggctcccagaccaggcccatcctcccaggtgcccggagactctgctttcgtcctgcttcccaccagctggggagctagacctgtgcaccctctactgctcgctcccagaagctgccactcgctagcctgggccccagcccgggccccacccacggctgcagcctgccgcagtccttccctgggcacacctgctccctccacagcggctggaaaggtcccccgcggaggaagaccccaggtccctgggctcccggaggccctcgcgccctccctgcatccccagtctccctcggcacccctgcgtctgggccgtgccctgcccctcccaggttggggctcccacctgctggcattctttcagcctctgcctgcactcagactctgcttgtgaggtgtcgtctcctctcaaccacgggcggggctccttgaaacgaggccctaggtgtgtcttcagcagcagcgtggcctggctgaagcacagatgagcggcccgtacacgaacagcctcagtagcctgacgaattcttgataggaccaccccatccaggctgcagggctgacggggccacccaagggtcagacagtgaaggccccttctccacagtgtctaggctgtccctgggctccttggacctcgatggacatgtgaaccttgtgcctgcaggcacgcgagccccacgtctgccccctttccacagtcctggctttgacgtggggaaggggccccaggggcagggaccaagaggactttgcacagactgggtgtggcagctcacgcctgtcatcttagcacttggaaggctgagatgggagggtcacttgaggctaggagttcaagaccaggctggtcagcatagcaagatcccacttctgtttatttatttaaatttattttcaaatttaaaaaatgcaataaaaagaatgtgtatcgtctggacgtggtggctcacgcctgtaatcccagcactttgggaggccaaagcaggcggatctgagctcctgaggtcaggagttcgagaccagcctggccaacatggtgaaactttccctctactaaaagtacaaaaatcagttgggtgtggtggcgcgcgcctgtaatcccagctacttgggaggctgaggcaggggaattgcttgaactttgaaggcggaggttgtggtgagacgagatcgcatcacggcactccggcctgggtgacagagtgagactccgtctcaaaaaaaaaaaaaaaaaaaatggggcatatctggctgggctctttggctcctgcctgtaatcccaatgctttggaaggctgaggtgggaggatcgcttgagcccaagaggttgaggctgcagtgagccaggatcacaccactgcagtccagcctgggtgacagaatcagaccctgtctcaaaaacaaaaaattaaaaaggcttatatgttttagatgatgacggcctagcacttgctggccgggccctggccccccgtccctgtgtgcttctcttcccactggtgtggtggcggcggtctgtgcccattgtggtcgctccatggttcatgcccgttccctggagcacagagctgcctagcaggggaggagaggtggcttgacacccccggtgtgcgccgctgcctccaccctcctgacgctggcgtatctgcagcccctgttccctccttctcccttagagccgggtgttgctgggttgtgtgctgatgctgtgaaaccgcagcggccgggagactgtcctggctgcgggggacccctcactgcctctcccaccctacattgagcctcagtcagatcctgctcatgagccttcctggggtgccataagattttatcagccaggttgctgtgtgtctgtgtgctggtgacgtggggataatttgaggtggacggcagcctttccagacctgcaaagtcttgggcagccctgtctgtctgaacagtgaacatcacatagggccctgagactcaaaatggattctggtttcgggggccaccaagtgatgtccatggatgacgcgttgtgatgaccgtcccctcgtgggggctctgtcaggggcctggtctctgggaaggatcctgagtgaccttggagcatcggatatgtgtggagactgtggcctcccctgtgggtcttcatggccgcattcttgtggcctctgtctccgagcctagcacggcctcccgggtggcatctgagcgctgtgtggtatctgatggatctctctgatcataggtgtgggccaggtcgtgctccaggttgctgctgccaccaactgcaaacatcactatggcgtcgagaaagcagacatcccggccaagtatgcggaggtgagcggatctgagggccagggtgtgttggaggcaggggaccatcagagaaagtgacgccctgggtgcctgcaccccactgctgtgggacttccgagtctgggtggcgttctttccaggcccaagacgtcttggttgcctgcagcgtgtgcctgtgaatagggtgcccgatcgccctcacggcccattacaggccggccctccaggcctgtccaagcgctgcaggggtgtctcggagcctgtttcatggcacgtgccactagtgaggcgagaggtgctcagctctacctcgtggcacagccctccgagaagcggggtgttttgggtggcctgcccaggcaggcgcattgaggccctgttgctctgagagtttgttgttgtttttttttgttttgttttgtttttgagacagagtctcgctcagtcgcccaggctggagtgcagtgactcgatctcggctcactgcaagctccgccacctgggttcacaccattctcctgcctcagcctcccgagtagctgggactacaggcgccccccaacacacccagctaatttttttgtatttttagtagagacggggtttcaccgtgttagccaggatggtcgcaatctcctgacctcatgatccgccctcctcagcctcccaaagtgccgggattacaggcgtgagccaccgcgcctggcttgccctgagagtttgtaacgggcgtttggtttctttccttccagaccatggaccgcgagttcaggaagtggatgaaatggtatggaaaaaagcatgcagaatacacagtgagtgccatcgctccgccccggctcccatcgccggccccacccccgctcccaccctcctgtcagcccctcctttcttgccgatgttggcacatggctgttggcacatggtgtgccccctggagtcccctctggttctcgtagggctgcctgggcgtggcgtctgagccggcagcaggcgcctctgttggtaccgtccctctcgtcctctctgacatggcttctgtccctcggcagcatgcggtgcacagaggtggtgcagggaatgggcttggggctccatggagcggaggcctgtgggacaggctgggttctgggctggctgcggcatccttggggtgtcatccctcactggggacagccttgtttggacgggttcctggtcctcagtgctgtgttcttcatgacaagccagcaacctcggggtgggcagtgttctctcccgccctgttgtgatgcagtctcaggtgctcctcccatggaccctggggatggcgtcgcgtgtggccctccctgtagggtgtgcgctcccctttcagtggctgagtggcagtgggatgggtgtgggggtgggaaggggatgctgtttagggagcaggaaggacagttttcctgacccaggttgggtgattaatgggccatagcttccaggagtagccaccactcctgcatcctcctgggaactccttcccaccccacgctgagtccttagacaccaggctccgccctggtcctttccacacagaggcctgcagagctgggtccttccttgacctgtgtgctcctcctcacagtcccagctgctcaggcgctcacctgtggtggaggctgatggcgccccgggcccatctgctctgtctcccagcgacgtcccagacctccccgcccttatggggtgtgggcttggtgctggtgcagctgctcccgtgatgtggattggagggtggcttggggtctggggactgcaggaaggtggatgcttcctattctagacctggagcccctggagtacagagcccgcagcccctcgagcctcagagcccgcagccccttgagtcctgagaagcttcccttataaggcagaaggagtgctgggtggggcgggcaccaggtcaccaccctgggaggacgatggcacaggggttgccaagctgcccagcagagcggctcaggatggaacatggcaaggccaactcgtgatcccaggtgcctgcgacgacccagttcctgggtggaatccgcaagtttgcagaagcaacagaaacaaagtgttcaggggtcctgttgtcattcgactctcacagttcagagggatgcatgagggacacaggtggcatacagttccagtcccctcccaggtggtgcccacccctcactgtctcctcagcagggtgcgtggaggcgtggctggggctgtgtgcccgcccgtctgcctggagctccctgctgaggtgccctctgtgggcctgtcagccagggccttcctcggatcgccgtgaggcctcgacattcctgtcattgccacgagtgggcgtgcgtcctgcctagcacgcgcccctgtccccagctcagacccctccgcactgtcccacagcacaagtgaaggccggtgtcagggtgcagggccccgatccctggtggccccgaccggggtcaggagcccttgccaactggctctgccttgggcgtcctggctgtggtggtctggcagatgaaccttttggaggatcacttgagcccaggagttcggacacattttttttgtgcatgtgtgaaagaaagtcttgttctgtcgcccaggctggagggcagtggcgcaatcttggctcactgtagcctccgccccctgggttcaagtgattctcctgcctttgcctcctgagtagctggaattaaaggcgcatgccaccacgcccggctaatttttgtatttttagtagggatggagtttcaccatgttggtcaggcgggtctcaaattcctgacctcgtgatccgcctgcctctgcctcccaaagtgctgggatgacaggtgtgagccaccgcgccgggcctccttggggtttcctacgttgacagttgtgtcgcctgcaaacacggagctttgccttttccttagcagtccgtgtgcctttcctctccctttcccgtaccctcgtgctggccggcgctggcatttcccatgccatgtgagtcgtgagggcaagacgggtacccttccctgccctggtcttggcggtcagctgagcccctggccgcggagcacggtgttagcggcgggctcgtgtggatgctctccctcgggtggaggataagcccgtggtcctgagtgtgcagcgtgcgctttttcgttgctgcttctagtgtcagcgcggtgctgtggtttctgttcctcaccccgttgctgtgatgggtttccagtgctgaacgcgtccgccttggtcggcgtgcgattctgtttatccaaggtgggattctgctggctgatgggccgctgaggggttttctgccgtggtgggagccgtggcctgcggtgcttccttgcggccacgcctgtctggtttggtctctgggtggcgctccctcggcttctgttctgctgtctttgaccaggacttgcgcatccagggctgtgggcccggctctccttccctttctcatggtgattgttcccaaatgctgtgcccacagtggaagctgtgtggtgtcctgggttctgggtccacttgcactctggccggaagttcccacatgggttcctggctgtggcaggcgagccacacagatcccagcacagaggatggaagccctcgccatggttcccagcgatggccaggagggcgccatggtgccttcctccgcgcggtctggctgggctgagccttgctcaggagaggggtgctgtcgggtggtggggctgccgcagcactgctcccccttctgcctcatcttgtcagcgtctgggtcagcaccctgcctcctggggcctgggtccatgacacggctgagcagcatggtgtctagtgtggcacaggtgctcctggcatggagctgcgttcgtggtctggattccgtgcaggtttaggtgctcacggtcaggccagtggctcctgagatgtgtctgggagcatgatttgggggaaagcgtggcattcttcgtggctttggcaacacgtgtcagaaagaacctggtggtggggaaagcaggtgtcagtaccagcctctgcctctggcatccgtcctgtttacagccaaccctgctgcggagggtgggtcagagaggcttccacctgactgttccctgccctttctgatggaaacttgcatctgatattggaggaaaccctcggagcaactctctgtggctttgcctgtgctccacttgggaggctccaagtcctcccgcctgagcagtgtcaccagggaggctcctagagacccagacccccgcttcctatggggccggcatttcagactccagagggaagcagggttgcatataaaccacggtgtttgcaggaacagcttcggccccagagcccatcctgtcatggagcgtgggggaccccagggagggttcccagccccaggcctgtgatgcgagcccggatctgcttagtgctgctcaggacttgggatttgagtcatttcctgggtggcttgttcacggggaatgagggatgttcagagggtctgtcaggtgtggagagggaggagacgggtgtggggggtggcccagcacctgcagaggctcaggatggctcgcctgcgcacctcccatcccgtctcctcccctcctgggggcttcccgcggccttggagagcggaggatgtgcagctgctcctggccggggcgggtggccctgccctctggatctgcgtctgggtggacgagtggccctgtcctccgggcccgggggggtgtccctgtctctctggggctgagtgggtgggccaccctgttgcttggggcggcggcttgcttgcgttaccctctctgctcggggactccgtccccatcctgagagacgctgggtggggcgcgaggcctgtggctgttgtgtggaaaggagtgtcgctggtcctccctcggctcttggggtgctggtgtgggcttctgctgtggcccaggtgccctcacccccaactactccagcccccagcatgaatccccttcctgtctctggatgggcctgtcccggacatttcacagaaacaggatcacacactgcgtggccctctgtgtccggcgtctctcactgagcgtggcgtcctcaaggtgcatccgcgatgtggcctgggttggagcctggctcctgttctcattggggtcctgcttccaggtgtgcgcggcctcgctgtgctgtgttgatctttcatctgctgatggacgcttggctgcttccaccttttggctgtgatgagttgtgttggcttttggaggcatttgtgtccgggcttttgtgtggacatgtttttatttctcctgggaatggaggtggtagtgtttttgaaggatttgaaaggcggtgtcttgattgtccagatgctaccgtgttggacagctaggttaataagaggtgttttctcctggacggtgccaggtcttgaggtctggaggtggactggcgtcgggctgcagctggccttgctgtgagtgtggcgtggagctgtggggacagcgctgctgttagcaggccgtcagcggtgctcagggcagacgcccccagggactggcggctcagcttccctgtgtgcgtgtttcttgtggttggtgagggagggacagagctcggcgctaggctttctcagcctggccgagtgtcgctgcctgccgcagagggtgccccccagcgccctgtggcctccctcaggccctgcctggagcccagcatggtggggactgcaggccctgcctcggggcgcccctgctggccgcctctggtcctgagagtggctgcagcccctgattttgagcttacatttctaggagactgcagcgtggcttgcaggtgtgtgttggtgtggccgcagtccccttggctgggcctggcctccccaagcggatgctggagcacgaggacctgtcccggcttctcaggaggtcctgcccgttctctgcgcatccctctcacggacccttctgcctgcagctcccagggctgcagccggtggggcctgggcctcctcctgctccttcactgcaagcggagctgtgttcattccattctttcttcacaggggctgggcgggctgggagtgccagggaggccgggggtccgcgctcacacctgttttccctttcagttggagagaggcgatttcctctcagaagagtggagggagcgaatcgccaacacgaggtatggccagcgtggggcatgcagggcatgtggggtgtgcgctcacaggcgggcggtggccatggcaccggggaccgggagcggcccctcgctcctgtgctggctgtggcaggaaagaggccggtggggacaggaagggcgcctttccctcacgctgggtctccctctgcgggcgcgcagagcagacgtgcccagcagagcccctgtcggccctgcagaccctgctggcagtgagcccgttcctgctgcctgtccccttgactttgggacactgtgggcccctctcgcctggtttcctgggcctcctccccgctcaggcttggtctgggggtcttcctgtctccatccatcccttctggagtggctggcacccacacagcactatgagggctgctcgagggagcggcccctcgtggtcccaaaagccatctctgcactgcctgggcttgcccctccgcgccacctcgcacccaggcctgggagctcagggcactgtccaggtccgtccccaccgccacctgtttgtcctggtggccacgggctctgtatggttgggctgggcccccgtgctttccactgcccagcctgggtgtggccacagcactccagcgtgtgccagggaccctggaggcccaaggcgcttgtgagggcagccggggaggtggggtcagcagccggctgggccctgctcccccagtcccgccatcctccctgctcccctcatcctcccagcactctttgtcctctctgcgcccctcgtcctccccacattcctcgtcctccccgcattcctcatcttccctgtattcctcgtcctccccgcattcttcatcctcccctcattcctcgtcctccccgcattcctcgtcctccccacgcctctcgtcctccccgcattcctcgtcctcccctcattcctcatcttccctgtattcctcttcctccccgcattcttcatcctcccctcattcctcgtcctccccgtattcctcatcctccccgcattcctcgtcctccccgcattcctcgtcctcccctcattcctcgtcgtcccctcattcctcgtcctccccgcattcctcgtcctccccgcattcctcgtcctccccgcattcctcgtcctccctgcattcctcgtcgtcccctcattcctcgtcctccccgcattcctcgtcctccccgcattcctcgtcctccccgcattcctcgtcctcccctcattcctcgtcctccccgcattcctcgtcctcccctcattcctcgtcctccccgcattcctcgtcctccctgcattcctcgtcctcccctcattcctcgtcctccccgcattcctcgtcctccccatgcccgtcatcctccctgtattcctcattctccctgcattcctcgtcctccctgcgcccgtcgtcctccccgctcccctccttctccctgcattcctcatcctccccatgcctctcgtcctccccgcaccctcgctcctgctgtcttccctgtgctcttcttcctcgggtgtgctcgtggcttgtggttgagtgtcccccatgggcagggtttggggaacaagtagaaaatgggggtttcttttcccaaaagtttcctaggttcgctctcctgtgtgaacttccatttgggttggggtgctgtgcccgccggcgggtgttctgccatctggagggaatcgtgctgaccctgtggtgtccccatcccatggggtggtggtgggagcgcagggggacccgcagtggtcaggccgtgattactgtcttataacaaactcttaagaagccgagagatttctggcgtcccgttgacatctgggctcggcccaggctctcacagttcctctccaggagctgccagcctcgctgccttgtcaggcagccccagccctaggctcagcctgctctggctctgggcacagcgtgcaggtcttgaccaggagggactcctcccacaggctgcccactggttgtgggatcttgcactgtctctggcctcagcctgttttccctttcctgggtctgactcacgatggtggtggctttggaggtgtgcatcacggagcttccttccctgaacacccagttacccaggtctttctggctcacaccgctcagccaccttggccacctgagctcagccgacctcacgtctagcctccctaagtgcggtcctgagtggggaacacgggcagcccaaggagcctcgtttgaggatgcctggcctgggaaagcagtgctgggcctgcaggggagcctctggttcccctgtccttgccagagtgtctgaaatgctgccaagggcgcctcacctgggacccgttgtctgcggtctctgcagcagttgagcgggagcctctgcttggcgccccctgttgcagtccagccccgtgctgggcctctgtttttggccacccaccttcttcccttggcctgtgggtacttcacggctgctcttcccaccttgtgtgggctgcttgtgaaccttcccagatcactggactccaagattcacaataagagacttggtcacgaatcctgccccctctgtttttggccccactcagaagaggctgcagttgccttttccctgcacctgaaacccacggcgtgcgctcagctgcgtgggcttggccctggaggtggcgggcgggtgtgggcagggcctagcaccgacagcagcggttgttggctgcgccgggtggctgtgcccgtgagacgagccttcatggcactgaactggagtattgttttgcagtgttatatttgtgaataattttgcctttggtcctgaggtggatcaccagctgaaggagcggtttgcaaacatgaaggaaggtaaggcgccctcctcgccggtctgtgctggtgtgacatgattgaggaagggtggccaggaggtccccgcagggtgtcctgcagaaggcagctcagacttggggtcttcagtccccttggagccaggtggtcttcctttatgcttttttttctttttttattgagacagttttcctctgtcacccaggctggagtgtagtggcacaatctctgctcactgcaacctccgcctcccgggttcaagcgattcttctgcgtcagtctcccgagtagctgggactacgggtctgtgccaccatgctcagctaatttttgtttttattttattttatttattttttgagacggagtctcactgtgtcccccaggctgtagtgcagtggcgcgatctcagcttaccgcaacctctgcctcccgggttcaagcaattctgcctcagcctcccaagtagctgggattacaggcacatgccaccatgcctggctaatttttgtacttttagtagagacaggatttcaccatgttggccaggctggtctcgaactcccgatgtcagggtgatctgcccgcctcggcccccgcaaagttttgagattacaggcgtgagccattgtgcccagccctggaatcttcttgagttgagcctacagcttgcttatggccagctgaccacccaggggcaagagtcccctttattcttgacctaagcacatggaacttggtgtccatactgagcaggagtggggctctcagctgttttgttttctccctccggagaaaggtcaccaggcccatgcagggcccttcacgctgttttctgaaccccaagccctggcgtagtttcaggagcggagaactcagcccatgacatcgattccagtcctgcagtcgagggtggtacccagaccacactctgtggactgcccattccctaaacatggagactgagcctgccattgtctcccagcccctgccagccctccagcaggacatagggcaggtttggggtcttccttgaggggattgtgctgcctgccttcctaggctctccaccaagccctgcagcaagcaccacctcatctgtatcctggcggacgtggcttccagagccactgctgggctcgaagacaggcgctctgggggtaccccctcttcctcccaactgctccccacctgtcctctctagggaggcctccagaggctaggggagaactgcggtgggctcctcaggcctcccaaacaaaacccagagggtctgcagctgccttcagcaccaacgccccacaacctgggggtttggagggtgcttgtgtgcctgtgtctgtgtgtgcgtgtctgtgtctctgtgcatgcctgtgtctctgtgtgtgcccgtgtgcctgtgtgtctgttagcgtgtctctgtgtgcgtgcctgtgcgtgcctgtgtctgcatgtctgtgcctgtgtgcatgcctgtgtgtgtgcgtgcccgtgtgcctccgtgtctatgtatgtgtctgcttgtttgtctgtgtgtgtgcatgcatgcctgtgtctctctgcgtctgtgtgccttgggagtttgtttgcatatctgtgtgtgtgtgtgcgtgtggcagtggtgtttctgacttatcttagaaccacgtgaggacaccatgcttccccgcccagtcgcccccacaccccagcagcactacgggcctccctgcaccctgcagctgcatgcaggaaggcagcagtggcttcaggcagctcctgtcaccccctccatggtcctcgtacccgctgccctagaacgcctcttctggctgtttctcgccagctttctctgcacgatcagacgtggtggctgagtcagggtactgcagtggcgtcttctgtccggcccctccctgttttgaacatgtccagtgaagggcaggtggccagtagtgctgattctaggggccttgatggtcccagacatgcccatgagcatttgttagcctggctctgcaaccattagacgtggccctgctcatgtttgaggtcctctggtagggatactggcctaacctgtgtgcccagcctggccctggaaccgcccttcctgctcctcctgaggggagtggtgtgtagaatgccaggcctgggctggtgtggcgtccaggggaggagagctgggatggcggagtgtgcatgtgtttaaatggatccactttgacttttaatttttttttttttggagacggagtctcactctgtcgcccaggctggagtgcagtggcgcagtttctggtcactgcaagctccgcctcccaggttcacgccattctcccgcctcagcctcccgagtagctgggactacaggcgcccgccaccacacctggctaatttttttgtatttttagtagagacagggtttcactgtgttagccaggatggtctcgatctcctgacctcgtgatctccctgcctcggcctcccaaagtgctgggttacaggcatgagccaccgcacctggcccacattttgacttttatgattaccttctttatatgtgtaaaaacagaaggctctgtttctctcggtcctgcgaagttcggctcctgacaccaagttcttcctgcagcacacacaagatgccccatagtggctggtgatagtgagactgacgcttagcagcagccttgcaggtgcctggctgacttttttgtatttttagtagagacggggtttcactgtgttggtcagactgaggctgaaggtgtccatccggtctgtttgtctttgcatttatcactgacagtcagttagaatcccagggttcagaggtatttgaaataattcttttcgcatgactgtttccagtttgcatctacagttagattttgttcctgcttgtgtacggcttgggggtttgctcttcctgcctctcaaaccttagttttttgttttgtttttttttgagacagggtcttcatccttggcccaggctggagtgcactggtgtgatcatagctccctgcagccttgacctcctgggctcaagtgatcctcctgccccagcctcccgagtagctgggatcacaggcatgcaccatcatgcccagctaattttttattttaattttttgtagagatggggtctccctgtgtcccaggctgggctggaacttctggcagtctgcccgccttggcctcccataatgctgggtttacaggcgtgagcctgtgcgcctggcagcgtagtgggttttttttttcttttgaggcagagtctctctctatcgcccaggctggagtgcagtggcgcgatctcgactcacttgcagcttccacctcccaggttcaagtgattctcctgcctcagcctcccgagtagctgggattacagatgtgcgccaccacacctggctagtttttgtatttttttagtagagacacggttttaccctgttagccaggctggcctcgggtgatccacctgcctcagcctcccaaagtgctgggattacaggcatgagccactgcaccgcgccgagaatgttttttaaagaagcattatttgtaggaggttgggcgtggtggctcacttgaggccaggagttccagacaagcctggccagcagggtgaaacccgctctctactaaaaatccaaaaattagccaggtgtggtggtgtgcgcctgtaatcacagctactcgcaaggctgaggcaggagaaccgcttgaaccagggaggtggaggttgcagtgagccgggagactctgtctcaaaaaaaaaaaaaaaaaaaaaaagttatttgtagaataggcttcaacttggaaggtgtttcctagtgttgcttgtaggcaggtggacaggacccggagcccagtgtgtgtgtgttccgtgtcattgttccttctctgtcaccttgagtggtgtctgctcttctgtttcctctctcctgtgtggcagtaagcagtgtctgtgtttcaggtggcagaatcgtgtcctcgaaaccctttgcacctctgaacttcagaataaacagtagaaacttgagtggtaagaaactctcatgttgttaatgatgaacacgggtaattttaaccatctgacacgcagtattcctaggtccctcttccttgaccctgtggacactggggctggatccttctgtggggtggggctgtcctgggcagtgcagggtgctgagcagcgtccctggtgtccacccactccatgccaggagcacccctggtcgcgacaaccacacacgtccccatagagcactgtgtgccatgggggtagaatcactcctcggggagaccccggcttcgaggggaggcgtgaaggatttacaggacttttgtggacagagacaggcccacggtgggaaggagccggcccctcccatgccccctgcctgccttactgtgctgcgtgctctgtcagctcccagccttgcggggcagcacggcctcctctgaggggcttccctgaggagcgcccacccgggaggtgcctgtgttgctggatgctggccgttcttgcagccgtgatctaagtcgcttccagatcttctccccctccttttccattccactcagctgggtttgtggctgtttttctgaggttggaggggcccaggccaggtggtgttgaatggtgcacctccctgggccggcctctgtgggccactgtggcctgacgcagtgtgggagaagagggaagacgcgcagctcaggcttctgtccccacgcctgccctggggtgggtgaggtctgcatggaggggctgtgggcaggcgcaggccccggcctcacctgtggctcctgcagacatcggcaccatcatgcgcgtggtggagctctcgcccctgaagggctcggtgtcgtggacggggaagccagtctcctactacctgcacactatcgaccgcaccatagtgagtatctcgctgcgcctcagccgcagggccgtcctggtcttccaccccgcccacgtcacactgctctctcctttctcatgtggcctctgagaccctcccctcagagccctcaacgccccccggcccctgagctcaggcccagctcctcaaggcccctcagtactgcttgcaccgcaggacccaccagggtcctcccaggcactgggcgtgtcctgggtgagggctgagtgctgtctcccctagtctacgctcagctcctggggtggggcggggccatcagagtgatgtgtgaccataagggtcccggccgccatatccagaggcccctgtggataggagtcccacgtccctgttcccagcttcctccatgtgagagggtcctgagcggggagacaccagggtccatgggtggggtctgggatgcttcttccctccctgtgttccccagggtcctctgacacagccctgggccagtgtgcggcctgcctgcctcccacggtgcttcccccccgggcacgagtatcccgagcctcctggcatgtgggcagcgccagccctccagggctgggaggcttcccctggtctctttcccgtcctttggttgggcactctgttcctgttgttggggtagcggtggttttccttacggtggtgctggtgtgtctgcaccctcactgtccagtgctcggagcctccactagagcctgcctggggagcgctggtgccgtctggggaccgacagccccaggcagatgcaccccgccctcccactgctcccccgagggccctgggacgagaggcatggtgagctgaggctgaggctctgggggcttggcctaccgtgcggcccccacctccacgcagtgctgctgcttcagctgccctggcactgacgccctcggcgcagcctctcgccttctcctctgaggcgggcgcggttcttctgtgcagaaagccctccctcttccagaagcagagacacatcccagggccctgtgtctgttctgaaggcttaaaccagccccgcccacccgtcgcgtgctggtgaattgagggtgacgcctggccacagctgggttagtcacatccgcgtttgccactggggggctctagctgcatgcctgctgtccccagataccagaacagcctccccagccactgtccaggttgctgttgttacctgggtgtccagacaaatccgaacagagattgggactcccttctaatcagggttctctttcttctttttagcttgaaaactatttttctagtctgaaaaacccaaaactcagggtaagtttgtgtgttttttctcttgggttaataacacgcatgcactgatgtggggaaatgcaaagccgtgcgcagccgggttcaggagccacgactggagcacagccctgccgcccctcggggcccggccctgtgccctttcccgcctccttcctgctcctccccactgtcactcctggtcctctccctaccctttcctccctgtcctccccctcttcctctcctctcccagcccttttctctcaccattcaatctctctctctctcccccaccctccctctccgtttctctctctctcccaccctctctctgtctctttgcctgtcttcatgctttgccttgtctttgatggtttggcctgggacatccttccccttgttaatacttatttttggggaggtggcttggcttagttttggtggtggggtgagttgcactgaagggctgggtgggtgaaaagcttgtgcgtcactgctggctgccccctcttgaggcctggggggccacacatgtgcgcttgtcccaccctcggtgcagagtgcagctcctgggcccccgcgccctgcacgcgctgcaccgtcggaggcagggctgtcccctcctctcccaccttaaagcagcggtgggaaagcctggcttggggagccacagtggccgccctgcccgctggcgcttctgcagcctcagacctgcctgcttatttgccaccaaagctgagaggatgtttgtccgggcgtcctttccttttggagggggtcagacaagaccagcatgcggagaaccccgtacaggaagggctctgtcactgcctggatttgtagccagggctgggctccaacccggcctcagagcctggtacccctcgggggccctctgtccttcccaccatgcttagggggatgtgggtcttccctggagagcagggaacggcccgaggtggccggcgcaccctgtgttccccttcccgtgggtcgcgccctccactaactcacatcagagaacttgtgcatggcgtcccatgtgtgggcctcggtgcctttcgaagagaggagagagggcaggggaggctgtgggctgtggcttctaggtcctgctgcctgaggggcttctcgtctcctgtcttggatgtggttctttttctctgtggctcacagtctggcttcttactgacaggcatctgtgattgtgggagtggctgtgaatgccgttatccgtgcccacgggtcacgtcctggcctgcggggccccaagcagcccactgctgtctctgggcctcagtttcctgatttgtgccacagaggacttgcagtggacagagttgggcccgtggcccccttgagtctgagctccgcgtgcctctcggtgcaggagggccgtgggcagcgctggggcttcctgtggctcaacctgctctccttccaggaggaacaggaggcagcccggcgccgccagcagcgcgagagcaagagcaacgcggccacgcccactaagggcccagagggcaaggtggccggccccgccgacgcccccatggtaaggccccagcctggctcctgctgctggagggcacccgccccctgcccgggagaccccatgggtgggaggctctgtgcccatccctgttcttcccttgtgtcctccaggactctggtgctgaggaagagaaggcgggagcagccaccgtgaagaagccgtctccctccaaagcccgcaagaagaagctaaacaagaaggggaggaagatggctggccgcaagcgcgggcgccccaagaagatgaacactgcgaaccccgagcggaagcccaagaagaaccaaactgcactggatgccctgcacgctcagaccgtgtctcagacggcggcctcctcaccccagggtgagccgcccccacgccacggcccccgctctccccgagtgcggatgcctggggtcccctctgctgggacgctgccctcctgagccccgtgtgttcagggtgtccctggagcctccctgttgtggctgtgccttcagggtggccccatcctaaggggttgctgggcacctgccccatgctgacgcctctgcccaccgctctcccgacccgccctgtgctgacgcctgccctccgctctcccagatgcctacagatcccctcacagcccgttctaccagctacctccgagcgtgcagcggcactcccccaacccgctgctggtggcgcccaccccgcccgcgctgcagaagcttctaggtgagcccgtgtgaggcgtccggcgaagggttctgggcttggggtcatcccaggaggaccgtgggttgtgacgctgacctcgcagcagcccccgtgacctccatgctggaccccactgaagtttacccagggttggggtctgcctgctgcaggggtcagtagaggctcagatgcagcctgtgggttgtctgaggtcttacccaggagatgctgggtgacacttgggacgtctgcagttgtcataacttagggatgttgctggcatggggtgggtgcaggccagggatgctgctcagggccttgcagtgcccaggatggccccacgcggtgaacacttggctgcgcaggggtcagagggcctgagtgctctgcgagcttggggcgtgtggcatgggccccgccaggctctgctgagctcctgcctcatgagtgcctgacacctgccgaggcctgggactcgttctcaagggctgctcccacctcttccctctcagtctcagctgctctcttctcacctgtgttccgcctctcttcccagagtccttcaagatccagtacctgcagttcctggcatacacaaagaccccccagtacaaggccagcctgcaggagctgctgggccaggagaaggtgggtcctggcccccttggcattccgccttcccgcacagaggcagttcgttcctgttcctgggcatctgtcccctgtggcagaggccctggagcgcaggcctgagtgggctccctcctctgctcacctgctgcgagaaacaaacctacccgtttaaacccaaagaatggactgagagacccggaaaacagcgaaaatgagacttttaatcatggttttgcaagacctggtgtctgataggcacacccagcacagtttgaacaagcaaccttccccctagtgcacaggtccctcccccggttcctcaaaggctgagtactgtgaggtcacagtcttcccagttgtcgcctattggttcggcaggggctggagtgcagtggtgtgatctcggctcactgcaaactccgcctcccgggttcacgccattctcctgcctcagcctcccaagtagctgggactacaggcacccaccaccacatccggctaattttttgtatttttagtagagacggggtctcactgtgttggccaggatggtcttgatctcctaatctcgtgatcctcccgcctcggactcccaaagtgctgggattacaggcatgagccaccacgcccggttgtaggtgttttctttagggttgtcctgctgcattttgtgcattgcaatcccagtcagctcagggactgttcaagtatttgacttatgatctaagtagctgggcaggctgattaagaacagacaaagccagctcttttgcaggctggtaaaccttcatcttaggctaaacttctttggttcgggtgagggcaactaagccgggggaagcgggggcaggggaggctgacaagcaggcatcagcgatccaagcaggggcctagtacatgctgtctcttctgtagtttgctgacctaagccaattcaaggcagtttgtcctggaaatggaccactgtatacatgatttccttcacctgaggtcccggctgtggggccccgccctgggagtctccgaggacctgctttagtggggagctagggccgggctatggggtggaagttctggcggcccagagataactccaaaagccattggagccacaaggtcggctgtccctgagccctggtttgcattttggactttggctttgcttttaaaaaaaagcttacagcgtgctttgagcatatatgcacatgcattgctcactgtgtagctgacagcatgcctgggccggggccctgttctctgctggtgtctgaaggttgtcctgtgtcagtggctcctggggtcttcccttggaggtgggcctccggacactgagtgtttgctgttacgctgcagaaggcttccttgcagatccatgtgaaaagtccatcccctggtattgccttgggataaactccttggcattggccggcctctgcgtggctgggggcgctgccctggctgagtccaggtggggtggcaggtgcagtccctccagctggcgagagttctttgcagtgaacctgatgcagagctggtcccctcccgccgtggcctgagtatttcttgacatctcagcccggtgtgggtcccctcaggcatgtctgtccttgagcgtgtcttcaggaagcatgagaggcagggcgtgggccctccctgtgggccctcagtcacctgccctggcccttagtcacctgccctgtttgtcctacaggagaagaacgcccagctcctgggtgcggctcagcagctcctcagccactgccaggcccagaaggaggagatcaggaggctgtttcagcaaaaattggatgaggtagtggaccccagagggcaggtggcaggtggcagctggggcgcaggctggggtggtccatgtccgtcggtatggcttcctgtggcttcctgtctatgcctctgtccagctgtgtcccaggggctgggctgcaggggtggtcatgcctgggggcttacttcaccttggaggccaccagcatgacctctcccccgccccatgtccccagctgggtgtgaaggcgctgacctacaacgacctgattcaagcgcagaaggagatctccgcccataaccagcagctgcgggagcagtcggagcagctggagcaggacaaccgcgcgctccgcggccagagcttgcagctggtgggtgccgcggcgcaaggacagggacgtggaaccagaggggccctgcctgggcgggtgtgtcctctgtgcgggtgggaggctctggaaggcccgcctctgttgtggggtttgttcccagacgaattgcgccacctgtgaaagcttgtcgagcgcgtcacagcaggcaggcctgggcccctcggctggatggtttctcagcggccctgggtgtcatggagccacactctggcaggctcgaggtgtggggtcatgcgagcatcccaccatcgtggtgtgggtgctggagctgcctcatctgtccgtggggggccccagtctccgcgtgttccgcatcctcagcctgctattccagaaacggggtctgtgccctaagcacacatgctgttggctgaggcaggcccagggaaccctgccctgagagtgtggggtgtgctgggcaggcagccagccagtcgcaactgtcccatccctatcccctcagctcaaggctcgctgcgaggagctgcagctggactgggccacgctgtcgctggagaagctgttgaaggagaagcaggccctgaagagccagatctcggagaagcagaggcactgcctggagctgcaggtgggctgcgcgcgaggctgcactccgtggtgtccgagcctctcccatcagcctccctgtgacgtcgttgagcctagggtggttgcggttgcagcagcctaggaagaaggtggaggaggacagttgggtggaggcttatggaaccttctgtcttgggccgcaggctgcccgtgtggatgactctgcctcactctagccctcagctctcgggggcatctcgggattgcttggctgaatgcgcagcgctaacctaggatttcctgatttcctggctgcctccttgcaaatcatttctgtaacagtcataggggagaatttgctcattagaaaaacagctggatcggtgcaggggcttatgcctgtaatcccagcaccttgggaggctgaggcgggcagatcacctgaggctaggagttggagaacagcctggccaacacagtgggactctgtctctagcaaaaatacaaaaattagccgggtgtggtggtgtgtgcctatagtcccagctcccagggaggctgaggcaggagttctggctcccaggatggcatccccaagggccatattgaggcaaaaagggccgtgtttgagcccgggaggtggaggctgcagcaagctgagattgcaccactgcactccagcctgggtgacagagccaggccccatctgaaaaataaaatagcttgtactttctgacaccgagaaacgcattcgtggaggccgagtagaggaagtgtggaggagggtgtgcagcgggaaggtgctctcctccctgctcccaggcagaggcaggtgctggtgggcggtgcccacagctgccgtgcagcctagaaagcagcaggtcacgggctttgttcccagagccccatcccgtcgacactgtgcccgcctgctcaccttacgtgtccccagcgtggtttcactgttgatggacctggtgccctgtcgctggacctctgctgccttttcaaatgactgcaccaaaccgttgctgcaaggctgtccccggaggcgggctctcacgggcggctgacggacgtcgggaagcaccactcacgtgctcccgagctgctccctcacgtgtgtggcccaggcgagcctcaccagcgtacattagagaaacggaggtcgccgacctctttaccacagccgggccctgtgggtctgcctggagtagagccctcgggaagagcatatttgggttctgaccatttttgtcatcatcttttctgtgtaataaaaaaacaatgtgtttgttaaaagaaaggaaagcaggtaaacagaacagataaactaaaaggaaaaagcccctctcagactcagcgcccggggaagctgccacgctcgagtggcgtgtccctccacaggttttacacttagtgaaactggatgttttacacttagagtctattttgagagacgagagctctttgtatcttcctgttgctctttttgaagaaggtgcttccatgtcagcaaaaaccatcctcggccctccacatgactttatttgacgcccccagcttcccgaccccgcctctatgtggtcggcagctttggtttttccatcccacacaagcagcgggggtcctggccacccctccgggtgtccatctgtggcagtcttggttccctggagtggtcccccggtggggcgggcctgacaccatctctcctcctgcagatcagcattgtggagctagagaagagccagcggcagcaggagctcctgcagctcaagtcctgtgtgccgcctgacgacgccctgtccctgcacctgcgtgggaagggcgccctgggccgcgagctggagcctgacgccagccggctgcacctggagctggactgcaccaagttctcgctgcctcacttgagcagcatgagcccggagctctccatgaacggccaggctgctggctatgagctctgcggtgtgctgagccggccttcgtcgaagcagaacacgccccagtacctggcctcacccctggaccaggaggtggtgccctgtacccctagccacgtcggccggccgcgcctggagaagctgtctggcctagccgcacccgactacactaggctgtccccggccaagattgtgctgaggcggcacctgagccaggaccacacggtgcccggcaggccggctgccagtgagctgcattcgaggtgagtgccctggtggggctgggggtctgcagctggtacctgccgactctgcctggtgtgctcaggctgtcgggttctcagcaggagtgtgtttgttgaggagactgaggtggggaggtgctgggccaggccgctgcctctgagtgccagcccacggccctcgagagtgactgcagcttctcattccagagctgagcacaccaaggagaacggccttccctaccagagccccagcgtgcctggcagcatgaagctgagccctcaggacccgcggcccctgtcccctggggccttgcagcttgctggagagaagagcagtgagaaggtgcgggccgcgacccctgccccgggctcagggaggtgctcagcagaggcggcctgagcgagttgctagcaggagggcttgtcctagttgaccttggggcacggtgaggtactggggctgacctggagtaggatgttgtggcagagttgggggcaaccagtaaggacaggtcacaggtgacgttgggcaggtgccatggaggacatggggtttgtcagggtgtccctgatgcctcttagttctcagtgacggacggcaagtgctggtagagacacagagcccagtttgggaggccgctgcccatgaggacttccccgggggcactggcctgtgtgcacagggatggagagggaaggacggtgacgttgcatggacttggcagtgatggatgtgggccctgggaggcttggtggccccacgggtgactgcccaccgagccgggcgggcaggctggaggggacagatgggcattgctttcagacaccaggagcgtgccgtccctctggagtgtcccaaagccggtgtccaggagggcctgactgcgtggggaaggttgcagggccttggcagcgtgggggccgccttgagagagctgtagcaggcccccgtcctgtggctgtggtccctgtgtcctggaggggtttgttgacccacgactgggggtcgggccttcgtctgcagggcctgagagagcgcgcctacggcagcagcggggagctcatcaccagcctgcccatcagcatcccgctcagcaccgtgcagcccaacaagctcccggtcagcattcccctggccagcgtggtgctgcccagccgcgccgagagggcggtgagtggctcccaggtggctgtccccaagggccacgttgaggcaaaacagtctggggtgctcgagacctggctcactttgcgaagtctcacgctgtaaaatgtcgagcgtgaggcaatgcagtcaaggtgggctgtccaaagccggggcgtgtccggtgacctgggccgttgttttcgccagtctttttcttttgggtgaaaggtacgtgtgcaagtggagagggcctcacaccttctgggttgaggaggagctcagaggcccaccctggctcccagcctcactcctcacgaggccacattggctgccgtggcccctgtcctcacagctgcctctgggttctcccacccagcgctgtgcatgcagagaatctcgtcttgtgtagcatgggcgggattttctgggcattgaactattttttaaaaattgtgcgcttcaagtatatgcttcagtggtttttagcatttattttttattttttatttttatttttcagacggagtctcactctgtcgcccaggctggagtgcagtggtgcgatctcggctcactgcaagctccacctcccgggttcacgccattctcctgcctcagcctcccgagtagctgggactacaggcgcccgccaccacgcctggctaattttttgtatttttagtagagatggggtttcaccgtgttagccaggatggtcttgatctcctgacctagtgatccgcccgcctgggcctcccaaagtgctgggattacaggcgtgagccacgacgtctggcctctttctttttttttatttttcgagatggagactcattctgtcccccaggctggagtgcaattgtgtgatctcggctcactgcaatctctgcctcccaggttcatgccattctcctgcctcagcctcccgagtagctgggattacaggtgcccaccaccacgcccggttaatccccgcccccaccagctgagacggagtcttgctctgttgcccaggctggagggcagtggcacgatcttgtgatctttactcactgcagcctccgcctgctgggttcaagcagttctcctgcctcagcctcccgagtagctgggattacaggcatgcaccactatgcccagctgatttttgtatttttagtagagacagggtttcaccatcttggccgagctggtctcaaactcctgacctcaggtgatctgcccacctcagcctccgaaattgatgggatgacaggcatgagccaccgcacccggccaatttttgtatttttaatagaggtggaggttttgccctgttggccagggtggtctcgaactcctggcctcagtcgacccacccgcctcggcctcccacagtgctgggattccaagtgtcagcccccgtgcccggccggttttttgtacttttatacacctctgtctaattcaggacattttcttcacccgggaaaaagcgttgcccgcctcagcagtcactccctagtcgtcccccagcccccgggcccccgaacacgctcatgtctgggcctgtcccttctcttggcacgtgagggcattccctgtgtggatggagtgtgccatcttcatccgtgcccagttgatggaccccggcttgattccctgttttggcgattgtgaatcgttctgctgtgagcgctggggtccaggtttctgtgtggatgtaggtttgctctttggcccatgtgggagtggagctactgggttctgcggtcactctactgacctttgttggacttggagtgtggtgtggggaagtgcagtgggtggtggccggcaggtgtgttctcgcaagcgccctcctcaccccacccgactgctggcatttgtgctgcttggagaacacagccgcttcccggtgagggcgggctgtgggttgcttgggttgtgcccagtaccccctccccacagctggaccccgggacccccgcctcctgacctccctgcctcaggcccgctgcccattcacacgcaggcaccgcgcactctcgctgcgccactcgcctggggccccgctcaagttcccccgctgccctcttcccacgcggtactggacggtgaccccggcggcctcccccagccagctgcaggcctcaacactcactgtttccagctgggttctgggtctcctggggcacctgctgcccctgacacacagggttttctctctgcagaggagcacccccagtcccgtgctgcagccccgtgacccctcgtccacacttgaaaagcagattggtgctaatgcccacggtgctgggagcagaagccttgccctggcccccgcaggtaacgcccctcctgtgccctaccctcaggactctgctgctgctgctgctcttcaggcaggagggctgggttgctgggagtggaacagggcttcctggggtgatcatgggggctgctgccccaaaccgccacgcctcattactgacaccctttcctgcatcccacgagctgggatgcggatcgggctcagctgcagccatctcggcctcatacctgggtctcccgacactgacacctcctgcttgggtgtattaattcagcccgtgaggtcggccccagtgctctcgggggctcctgtactcacagctgggaggcccctgactcaggatcggctccacacacagcagtgcccaatggcacacgaccgtgggcctccgtgctggtagcggcatggtttctggttccttgagaaggtgccgcctgagcagtctctgctgttagcccagtttctgcagagagccagagaggatgccactttggcttttgttgacactgcaggcctgtctgttgtggaagccgcagagacagcatgtcagcgggcatggctgtgtgccagcaaaactgtacttaaaacagcagaggacatgagacccccaggctggtttgctggccccaggttgagatgcggtatgatgcggcagctacttttttaggagtaaaaagtaaaatgtggccgggcgtggtggctcatgcctgtaatcccagcaccttgggatgccgaggtgggcggatcacctgaggacaggagtttgagaccagcctggccaacatggtgaaaccaccgtctgtactaaaaatacaaaaattagccggatgtggtggcagacgcctgtaatcccagccactcgagaggctgaggcaggagaatcgtttgatcctgggaggtggaggttgcagtgagctgagatcgcaccactgcactcccgcctgggcaaaaagagtaaaactccatctcaaaaacaaaacaacaacaaaacaagtaaaatgtacatggccgctattgagacaggaggggctctagggaggctgggcaggcttcacggttggccacgtgagggccctggagaggccaccgaagcccgggcagttctgccctcgcagggctgggttgtgcccttggggtgaggtctgctctgcgagaggcagtgacagtttcaggagattttcaactgggtggcaaacagccaactccagaagcgccttgctgcgcccctgcactgaggcctcattggcagaagcagggaggccgccctttgtccccgggtggtcatggaagtgcaccactcatcgtgggctgggaagcatggctgcggccttcaaggcggccatagcttggagtatccaagctgagttgtcttctgagaacaggagggagggaggccacgcagccatgggctttcctcatggtgtctctgagatcacggggccagagggcaacttactcagaggaagcctagctcagcggggagcccgcaccaggaggcttcttgggaggcagcgtctcagccgggacctgcagggcacaggcagcccagatgggcgggaggaggcacagggtcagccctgagccttgagcttgcccacagagccttctggttccaccccagaggggccgttttcagactcccaaccccttccccacttccccgcctctcctggagcccacagagctcctagggggtggtgctcccacagcaaggctttctctttggccatcctgtgtcccctgagacccccatgtccttcccggcaggcttctcctacgctggctcggtggccatcagcggggccttggcgggcagcccggcctctctcacacctggagccgagccggccaccttggatgagtcctccagctctgggagcctttttgccaccgtggggtcccgcagctccacgccacagcaccccctgctgctggcacagccccggaactcgcttcctgcctctcccgcccaccagctctcctccagtccccggcttggtggggccgcccagggcccgttgcccgaggccagcaagggagacctgccctccgattccggcttctcagatcctgagagtgaagccaagaggaggattgtgttcaccatcaccactggtgcgggcagtgccaagcagtcgccctccagcaagcacagccccctgaccgccagcgcccgtggggactgtgtgccgagccacgggcaggacagtcgcaggcgcggccggcggaagcgagcatctgcggggacgcccagcttgagcgcaggcgtgtcccccaagcgccgagccctgccgtccgtcgctggccttttcacacagccttcggggtctcccctcaacctcaactccatggtaaggatggggaccggcagggctggggagcgcggcctgtgaaagaaagaccagagggagaccgggcgcggtggctcacgcctgtaatcccagcattttgggaggccgaggcgggtggatcacaagatcaggacatcaagaccatcctggctaacacggtgaaaccccgtctctaccaaaaatacaaaagattagccgggcgtggtggcgggtgcctgggaggctgaggcaggagaatgatgtgaacccgggaggcggggcttgcagtgaactgagatcggccactgcctgggccacagagcgagactccctctcggggggacaaaaaaaaacacaaaaaaaaacaggtggaggcagggggccatgactgagcccggccatcctccaccacgtgcggcctggcagcctgggaagaggcggccgacagctgtctctggggttcggagtgcgatgcgctgcctgcaagcttcttcattctcggctgtggggccttagtggtggtgggcacatcaggagggggcatggggggctctgggattgcggggtggtgtgtgaggaccaggaagaaccaggacaggggctgtactggccgctgggcagggcatcagtttcctcaggagaccctggggtgcagacaggagcctcctggggcgggggggctctcctgccttggggtcccgggtctgtggtatgtgcatccattgtgtctgtctgccctcaggtcagtaacatcaaccagcccctggagattacagccatctcgtccccggagacctccctgaagagctcccctgtgccctaccaggaccacgaccagccccccgtgctcaagaaggagcggcctctgagccagaccaatggggcacactactccccactcacctcagacgaggagccaggctctgaggacgagcccagcagtgctcggcgagtccaggggcccggaggggggcggggcctggcagcaggggcaggaggtgcctgctcactgtgtgtgtgtgggtgggtgggtggggaggaccggcaggctcttagggggtgccctggatgggaggaaggcgtctgttttgtgaggggcctccccacaggtcctgggccccgttccgggcagggccggcctcccgggccattcggggtgggacacgagcagggccatcggttagaagaggcaagctgaggaggagctgagcgcagcaggagagaagcttcagcagtgaggcgttggaggtctcatccacacgtcttgccgagtgtattacagtagctttattagataaaattcacatatcgtattctccatttaaagtgtgcaattcagaggtctttggtatatccacattaccactgcctaaatccagaaccttccatcatgtcctgagaaaatctcatcatccccttgaaacactcactccccttctcctcccaagagcccctggcaccccccgcccccatcctactttctgtctctgaatctgagggctctagggacctcctaggagcggagtcacacaggatgtggccttttgtgtctggcatctctcactgagcgtgacgtcctcaaggtgcatcctcggtccctgtcgtggctgggtggtgctccaccatccatccgccctccgtgctaggcttgcttaccctgggcggttgtgagcagcactgctgtggccatgggtgtgcgtgtttgtgtttgggagcaagtttcccgtttcctggtgcctgggcggaggtgctgggtggcccggccccctgggctctccagcagccacaccattccaccctgccaccatgggtgcacgagggtctgaggtcctcagtccccacatcctcaacacactgaatttcttgttttgattctagccatccgagtcgtcgtgaagtgatataacatggtagggttttttgcttttttttttttttttttcctgagacacagagttttggtctgtggcccaggctggagtgcggtggcgcgatctcggctcactgaccctccgcctcctgggttcaagtgattctcctgcctcagcctcctgagtagttgtgtctacaggcacacgctaccaccgtgcctcgttcgtttttttgttttatagagatcgggttttgccatgttgcccaggctggtctcaaactcctggcctcaagccttctgcctcccagtgcctcccagcgtgcgccatcacagccggccctaagtgtgcttttggtggtgttctgtgttagttcgttctgctccttgcccacgtgtgcgtgcacgtgttacacgagaaacattgtagcacctggatgctctgttttgcattgggattgctcagcttagtggtttccaggatctttaggaatttgtgtgtccctggtgtgttcttgggacattggatcaaagcgaccccatgcagtgtgtggttgggcatgtcttcacgtgctggcctgcaatgctgtggcattgtttgccacctgaggcaccgaggtctgagaggggccgggagagggaggtaggaagagagctctgtctgggattctcacacttctgtgtgctgggaaattgcttctcccattcagctgctgtgcctgatctcttggctgcttgtcccagcagaggccctggagtccctgccaggacagtacccttgtggcacaacaggggtggatcccagggcccagccacccagtccaggcctggcccagggtggctgcacgggtcccctgtctgggccgagtgcttctcgttcaccacctccggagctccctgggctgttggctgtcagcatttgtgtcattcttagtatgcagctgggtttcaagcattaatgacctttttttcttaacagaattgagagaaaaattgcaacaatctccttagaaagcaaatctcccccgaaaaccttggaaaatggtgagtaacaagtgttttgcggcgtggccaggcctgtccgtgtggccgtggtgcccagtcagtgctgctgacccacctgctggcccgctgcatcgtgtcccgcatggtgctggcccgctgcgtcgtgtcctgcgtggtgctggcctgctgcgtcgtgtcctgcgtgggcgccgacactgggggcgctgggcttccagaactgcctctgggaggccctcactgcagcccagggcctccgcgcacacgccatgctctcacagtgggtggctgacctgcggggatcgtcaccttgggtcccctgtttgctttgcaccctggccttccccccgagtggtgcctgcgtcctcagtgaggaccctgacctgctctggggcagccccaccttccctcccgcaggctgctgacctcagcattttccccagagctcatcccgcatggcctctgagacccgcttcagctgcctctgtcctgtcttccgccctcctgtcccatccagtcccgtcccctgccatctcatcctgtgctgtagtcctcctgtcccatcccatcttgtcccctcccgtccccttccctcctgtcctctcccatcctgtcccgcttggcatcttgagtgtctgtgaccagccctgcctgcagagttgcccgggccgtggcagcagccccggttagcctcatgggtagcccgggcaggtgctctgggctcacggcttctgcctttcctctttgccaggtggtggcttggcgggaaggaagcccgcgcccgccggcgagccagtcaatagcagcaagtggaagtccaccttctcgcccatctccgacatcggcctggccaagtcggcggacagcccgctgcaggccagctccgccctcagccagaactccctgttcacgttccggcccgccctggaggagccctctgccgatgccaagctggccgctcaccccaggaaaggctttcccggctccctgtcgggggctgacggactcagcccgggcaccaaccctgccaacggctgcaccttcggcgggggcctggccgcggacctgagtttacacagcttcagtgatggtgcttctcttccccacaagggccccgaggcggccggcctgagctccccgctgagcttcccctcgcagcgcggcaaggagggctcggacgccaaccctttcctgagcaagaggcagctggacggcctggctgggctgaagggcgagggcagccgcggcaaggaggcaggggagggcggcctaccgctgtgcgggcccacggacaagaccccactgctgagcggcaaggccgccaaggcccgggaccgcgaggtcgacctcaagaatggccacaacctcttcatctctgcggcggccgtgcctcccggaagcctcctcagcggccccggcctggccccggcggcgtcctccgcaggcggcgcggcgtcctccgcccagacgcaccggtccttcctgggccccttcccgccgggaccgcagttcgcgctcggccccatgtccctgcaggccaacctcggctccgtggccggctcctccgtgctgcagtcgctgttcagctctgtgccggccgccgcaggcctggtgcacgtgtcgtccgctgccaccagactgaccaactcgcacgccatgggcagcttttccggggtggcaggcggcacagttggaggtaggcagggcggccgtccgtccgccccccgccccggcccccgccggaggccccttcctttgcaggttcccttccgcactctcttgcagcaggagctgagctgcaggtcccctggtgccggccggcccccgccatccgtgcacggtggcgaactccagtcctgtggggagagggctcacgctgagtccgtgtgtcttgggttctctggttgtaaccgcgtccctcttgttttcagaaggccaccgtgcgcagggccaccagagcattactttctcccgtggaggtcacctgctaggtgtggccgcccgggctctggcaaggctctgggagctggtgttgggtaagagcgagtccccgcagtgcctgcccagacagggcggagaggagccgccggggggagcggcctggccctggggctgctgcggggcggggggccggagggcggagggcgggccaccacgagcctggccgagccgctgcttgtgcttggtgcccgcacacgcctggcggcgccgtttcgcttccctttttgtgagcctgcggctgctgctctgcgcttgcctggatgctgccgcttgttgaagctgcgtttttctctcctatttgcaggtgtctttaaccacgcggtgccctccgcctctgctcatccgtttggagcccgtgtcggccgcggggctgcatgtggcagcgccacactgggcccgagcccgctgcaggcggcggccagcgcctcggcctcttcctttcaggccccggcctcggttgagacccggccgccccctccgcctccgcctccgcctcccccgctgcccccgcctgcgcacctgggccggtcccccgcggggccgcccgtcctccacgccccccctccacctaacgccgccttgcctcctcccccaacgctgctggcctctaaccctgagcccgcgcttctgcagagcctcgcgtccctcccgcctaaccaagctttcttgccccccacctctgctgcctctctgccgcctgctaacgcctctttgtctatcaagctcacctccctcccgcacaagggcgcccgcccctccttcacggtgcaccaccagcccctgccccggctggccctggcccaggccgcgcccgggatcccacaggccagcgccacggggccgtccgcggtgtgggtgtccctcggcatgccgcctccctatgccgcgcacctttcgggggttaagccgcgataaagaccttgcttagctagcagtgcgtattgtgtaaggtaaggccagagccctgcgcggtggctcactccagacactgaactgtccttcctttggcagagaagacggccacagggctcggcagaagttccgggggtcctgaggagggaagagggagagagccagggagaccagggagatggtcgcgagaggagggactacaggacgggcaccagccatggagtggcctgagtgtgttgggttccagctgcccgcagctgggttcctgcggtgacgccgcaggactgaggccagccctgggggcagctgtgccagcccctgtgggcgaggctcacggggtgccaggccagggggctgggagctctagctcctagagcagtctccagggctccatccgcaccaggcccaggtcactcatgacgggtggcgtggcttggtgctgttccccaggcgcccagcatgtagcaggcacggtgccggctgcagaggtcctggagagccagggtggctggctggatgcctctggtcggggctgtctggccagtagcctcggatgccctcatagggagccagtgaagccccaagtgccctgcctgcctgggggctgatgggttcccggcggggtcgagaggcaagctctgtgccctgcgtgttgaggcccccttgctggacacggctgatggccacactgccctgtggtcatggcccacagccgaggggctttcagctgctcagatgtcagcaccaagctgggcaggttagtgtagacggtgcccacctttgagaccagaaggaagttggaagcaggagtgattttgatgatgtgaggccttcagggaatgtcctgttcactcctcccccaagaggctgtggagactgtggccgctgacccctgagggcagttggccacccgtgccctccagggacatggcgtgcctggcggcgtagtgcaaaggtgccctctgcttgcccctggccttctgcctcaggggcccctgggacacaggccttcctgggcgagtccaaagcccaccgggcaaggagaggaggactgggagccaggagccaaggcggaggctgtggccagggctggtcagcctggcgggtcaatgcgggcacctgcgggctggacaagctatgctgggtctcttaggagatgagctgcaggtagggtggctttagctggactcggctgtgtgtctcctttggaggaaggctggagcttggccggcgtgtccaggtgtcaggctccctggtctgtcacggggcacgcccgtcgtctgttgtggttagaggagctggcactatgcctgtcatggtgctggccccaggtggcgtgtgtgctcgtgggaggcctcggtccccagcctgggtgagtgttgggctcccccaggcgcgatggtaacctcaggccgctcttcccgctgtgcccttctgcaggtaactaggatttctacctcaaccgcgagacctatgcaaggacggtgtggaccaactcgcgcccgcggcatggtgcccgccggcctgccgggctcccacccctggacggcagaggcaaggacggacgggagctccactgtgaatcggcggcacgcgccgcaggaggctgggactggtccagtttgtactgtcgatagttttagataaagtatttatcattttttaaaaagtataaacaattctgacttattttattccatctaagtggtaaaaggcaacttattgagaaatataaatatctatatatgagagctctatataaagacacgtgtctgcagggcgggcccgccagcggattcgccacagcctgccccggtgctatctcgtccccaggcccgcgcctgcctccacccgcttggtgctgactagacgctgacaacgccgaaccccgttctcggaaacgccgcccggccggctcccccgacgcgctgctcccgtaccaaaggcaggcccgtcgccaccacattcctcggaggcctccccgcggcctgagccccttcctgagcgccctggcgcctgccctgagctcttcacctttaccccggcactgtgaacccccagactgttcaccctccggggcgtgggttgcgcccttgcatgtgaaggggcctgcgcggtgacgcagctggccatgtgctgcgcgatggtgctgtgaggacggcgcgggcacgttgaacaagtgcatttacttttgtatttctcggctgtccatggctcgcagcatgccctgcgatgcggggcaggcctgtcgtgggtcccttggtgtttctgtacaggagagagtcacactaatgagtggcagtattttatagagatgtgatgagaatttataaatttcatagatttgacagcttttatttttagatggtataatgcacagtgaagaggaaagaaaagcgaggggaaaaaaccttatttattcaaacagtgcacaaaatggccccagcgtcagccccgaccctagacccctcagttgcagctcccagcagcccagacagagctgccggcgcccctgcctgccccacatcccttcctgtcagggccacgcctggcacccatcccttggagcctgtgctggttctcccagctgctgtgggtgtgctggggccagggtgcactgctgaaacctggcctctctggccctaggccccagggtgacgtcggccccccactctgcagccttggcgggtgcctgggactgggtgtggaaggagaggagctgaggccggggtgtagcaggcaggcagggccactccagtgcttctggagccctgagcagtcagggcctgggttgtctgagcagtggtggctctgtgccctccctggaggatgggatctgggagtctgagctccccgcatctggccctgggctgtgtggcacttgctgagcccaccttctcaagtgcttgctcctgtgagatggcatcggggagccccttccccaaggtgccacagatccaccctccagggagctgccagccctgtgttctggttcccaagggcaggatggacacacgtcacatccctaccacgtggcctccaaagggagccacggaggaaaggcttctgtggttgctaggtgggggagtcctgtgtgggagggcctgaagacccctgcttgtgcctggtgaggggggtgctgcctcccccagcccccaacaacctctcagacccccaccctccaacatagctgagttctgaagatggtgctccggacctgtcctcttaagtggtgcccagtgccctccccaccccacgttggtgctctcagctagaaggtgctgtgcctctgcctgagccccaagccccgagcctggccttcaggacaggcagcctgctctgtgtcgccacgggccggatacgccacagggttgatggcagagacggccgagtccctggtctagaacaagacacattctttaaacactgtattacttctgcctccctctaggtgacagtggcagtccgggtgccatcacgggtcctgcagatggccatgcagggctcctgcccacgcaggccaccgtatgttcaggacacgcactgggtctcagagccactggcccaggcagaagtctccttgagcccactgggtcatatgcgtgtcaccacacgtgaactagtgtggtggctgcctgcggacaccctcctgttctgagccctgggcctgtgttcttctcagacactcccagactgaggggtggtgtgtggcgggtggcagggtggctgtggagactggggatctggagcctggtgctggcacctggcctgagtttccgtgggcagctggcggggacctgtgctgctgctgctgactgtgggtgggcgggcggcgcctgggagtggctcttgctcaggaattgataggaaccctaaaaactaggataccccctcctcggcccatgaggcacgcacagtgacttatttaagacttcccccttaatttatctgcccccaggatgcgtcagtctgttcagtggtcagcaggccccccaccccccgccgactgccctcgccatcgtggtcagacccccctcccaacacaacacgctgctggtctgtgtcagcctttgtaacgtgggaggctctgccgtgtcttccgggtgaactgtatttggattgcgcgcattgtcacggtccgcccctgggctgcaggcgccccttcctctgggcacccctgcattctgcatccccacctctagacgctgtaataaacagactgttttcactcgga

SEQ ID NO: 446 - DNA, 7059 bp, Homo sapiens
aagcaggcgccgcttcgaggcccgcggaaaacgcgcgccgagacccgctcctgcagtattagttcttgcagctggtggtggcggctgaggcggcatggatctcagcgagctggagagagacaatacaggccgctgtcgcctgagttcgcctgtgcccgcggtgtgccgcaaggagccttgcgtcctgggcgtcgatgaggcgggcaggggccccgtgctgggtgcgcccctagggccagggaggggaggggcgtggtacggaggatgcgggaaacgggagtcgggattgcactgcaccaagggaggggatgtggtcgtggtgatggcacctaaagaagcagtgatgatagaacagggatgaatggcaactttcacgggctcagtgattggaccccggctgccagaaaactgacaccccttctccccaggccccatggtctacgccatctgttattgtcccctgcctcgcctggcagatctggaggcgctgaaagtggcaggtgagcccgaggtgtgcgtctggggaagggattcctgggtatgtgcaggggcaggtgagaactgaaaggggagggcaggaactgggagaaccagctgttccccttctcttccaaacctcctcccagactcaaagaccctattggagagcgagcgggaaaggctgtttgcgaaaatggaggacacggactttgtcggctgggcgctggatgtgctgtctccaaacctcatctctaccagcatgcttgggcggtgaggggtccccgggaggggcagccagcatgggctgaccaagctttgttcctagaatgagattaactgggctctgttccccaccacagggtcaaatacaacctgaactccctgtcacatgatacagccactgggcttatacagtatgcattggaccagggcgtgaacgtcacccaggtgagttaactgtaagttgtccccatttggtcatctcaggataaaatggggacaaaacaggagttcgagactgcagtgagccatgatcatgccacagcactccatcctgggtgacaaaggaagccccccaactcaaaaatggaggcagggcgcagtggctcacgcctataatcgcagcactttgggaagccgcggcgggtagatcaccggaggtcaagagttcgagaccagcctgaccaacatggtgaaaccccgtctctactaaaaatacaaaaattagctggacgtggtggcaggcgcctgtaatcctagctactcaggaggctgagacaggagaatcgcttgaacccaggaggcagaagttgcagtgagccaagattgtgccattgcactccaacccgggcaacagagcaagaccctgtctcaaaaaaataaaaaataaaaaataaactaaaaatgggagaccaggcgcagtggctcacggctgtaatcccagcgtttcaggaggctgaggcaggcagatcacctgaggtcaggagttgaagaccatcctggccaacatggtgaaacctcatctctactgaaaatacaaaaaattagcccagcatggtggcgggtgcctgtaatcccacctattggtgaggccgaggcagaagaattgctcgaacccgggaggcggaggttgcagtgaggtgagatcgcgccattgcactccagcctgggggacagagcgaaaaataaaaataaaaataaaataaaaaataaatgtgggcaaaaatgtgcagtgtgcagattcagcatcagatacgtctggagtgcctcgggcatattcattgctactgttgatttcgtgctcctgtttctgccctaaatgtgtgccacactgacgaccacagtgtagcccctagtcccgtctccatctaatctctccctcatcctaaaggctcagtctccagaacaaatcctacattgtctacctgtcacctctgtcctagcccaggacaccccccactccctggacacctgctgagtgtcgtctctcgtccctcaccctcctatcccctccaatctgttccccaagcagcaacagaaggtagtctttttgaaatgcacatctcgacatttagttttccgatcacagtggaaattaaatcaggaaaattcacagtcgagtggggcagaattacattaaattaccagagaaaaacataaatcagcattgcctcgaatgctctcaatgaaagaatggaccgttctgagagaataacaaggcaaaataaccttgacgtaggaattgtatgctgggtatggtggctcacgcctgtaatcccagcactttgggaagctgaggtgagcaaattggttgaggctaggagttccagaccagcctgggcaacatagcgagactccatctccacaaaaagaagaagaaagaaaggaattatagcaaggtagaccctgctgaggagggacctgaggaccaggcccaaatgcagagctggcgatacagtaactggtgtagacagacaagggccctacccgtaggcgttcagggcctagcctgggcagaaagatggtcagctggaggttgggcgcagtagctcacgcctgtaatcccagcactttgggaggccgaggcgggcggatcatcaggtcaggagttcgagaccagcctgaccaacatggtgaaaccccatctctactaaaaataaaaaataaaaaaataaaacatgaaagatggtcagctggtaaacaaaaaataaaggttgtttctgaaaacagtagtgctgtggagataccactttctcccagcagctcttggaccctctcttcggtgctgcagccaaaggcccccatgcatgggcccagcatcatgaacctggtcccagctcagggcctttgtactggctgttctcacacctagagccctcttccccagatctctgcacagttcacttcctcacctccttcaagcctttattcaccactacacctagctaactttttattttttgtagaaacagggtctccatatgttgcccaggttggtctcaaccacctgccctcaagcgatcctcccacttcggcttcctaaagtgttgggattacaggcttgtgctaacgcactctaccaatttttttctagtgttttctgccacctcagttcctagaacagtatgtggcatgcagtaggtgctaaataagttagagtaaaagcagcgtgatagagaaagcctcttcaggaggtgagttttttctttattttattgtatttattttatgtttttataaagatggggtctcactgtgttgccaagcctggcctcaaactcccaggatcaagcgatcctcccgcctcagcctcccaaagtgctgggatcacaggcctgaacaactttgcctggtctaggaggagatgttcgagttgaaatccctgattgatccatcctggggacgtgctggagaagaggattctgggtagcaggaagaacgtgccagggctgtgaggctagagcattggtacagttgtttgttcaattaatatgtgtctgttgctgtggcaggtattcgtggacaccgtagggatgccagagacataccaggcgcggctgcagcaaagttttcccgggattgaggtgacggtcaaggccaaagcagatgccctctacccggtggttagtgctgccagcatctgtgccaaggtcagtaccctactagccatggctggcttccaccatcccactatataggggccaggcatggccaccaaagggaaggagggagattccaggtgcctgttttgcccacaggtggcccgggaccaggccgtgaagaaatggcagttcgtggagaaactgcaggacttggatactgattatggctcaggctaccccaatggtgagcagacacgtgaccatggtactaatgttgaaatggccagggctgagcacacttctgaggttttctttttttcctttctgtcatttatcattttattttgcttattttttgtttttatttgttatttttgtttattttttgagacggagtttcgctctttttgcccaggctggagtgtaatggtgcgatctcggctcaccgcaacctccacctcctggcttcaagcgattctcctgcctcagcctcgcgagtagctgggattacaggcatgtgccaccacacccagctaattttgtgtttttagtagagactagttttctccatgttggtcaggctggtcttgaactcctgacctcaggtgatctgcctggctcagcctcccaaagtgctgggattacaggcatgagccaccgtgcccagcctattttttgtttttatagagatggggtcttgtcatgttgcccaggctggtctcaaattcctggagtcaagcagtcctcccaccttggtctttcaaagtgctgggattacagccatgagccaccacccctggccctttttttcttctttttttaaagagatggggtctccctatgttgcccagcctggtcttgaattcctgggcttaagtgatcctcctgccttggactcccaaatagctaggattacaggtgtgaactactgtgcctggctggaggttttctaaattgctctggtcaccctactccacagtgaaagaggccaagtgttagacagtggtgccatttgtttatggccacacagccagtgagtgatagagctgaattccaggccataggattgctgctgtcttccccgcttcccactttgctgtctttctggagccccagtgatggactgagacccaaggtgggcatttgtccctttgttaaggggaaggggaccaggcgtggtggctcatgcctgtaatcccagcactttgggaagctgaggtaggagaaccgcttgagtcctcgagttcaagaccagcctgggcaacatagcgagacccccatctctataaaaaatttaaaaaattagccggttatagtggtgcccacctgtagtcccagctactctggaggaggaggctaaggtgggtgggttgcttgagcccaggagttggaggctgcagtgagctatgattatgccactgcactccagccttggtgacaagatgagatcttgtgtcaaaaaaaaaaataatgttagccaggcgtggtggctcacacctgtaatcccaggactttgggaggctgaggcaggtggatcctttgaggtcaggagttctagaccagcctgaccaacgtggtgaaaccccatctctactaaaaatacaaaattagctggacgtggtggcacacgcccgtaatcccagcaactcgggaggctgaggcaggagaattacttaaacctgggaggtggaggttgcagtgagccgagatcgcataattgcactccagcctgggaaatgagcaaaattccatctcaaaataataataataataataataataatatttaatgacaggctgggccaggtggctcatgcccgtaatcctagcattttaagagacagaggcaggtagatcatgtgaactcaggaattcacaaccagcctgggcaatatgacaagaccccatctctacaaaaaatacaaaaattaggtgtggtggtgcgcacctgtagtcccagctacttgggaggctgaggtgagaggatggcttgagcctgggaggcagaggttgcattgagctgtgataatgtcactgcactccagcctgggtaatagagcgagaccctatctcaaaaaaataaaaaggctgggtgtggtgtttacacctgtaatcccagcactttgggaggctgaggtgggtggatcacctgaggtcaggagtttgagaccagcctgcctgtccaatatggtgaaaccccgtctctactaaaaatacaaaaattagccaggtatggtggtgggtggctgtagtcccagctacttgggaggctgaggcaggagaatcgcttgaacctgggaggcggaggttgcagtgagccgagatcgcaccattgcactacagcctgggtgacagagcaagactccatttcaaaaaataagtaaataaaataaaaatgtttaatgacttgttcttggaggtcaaggagatgtctcagaggcagtctccctgcactgcccttttagcagctcttggccaggtaaaggtcctgtggcaagaaggtgcttcagaccataggaggtgccccaggtactcaggaggaagccttagaagagcggcaaggaggccgggcgtggtggctcatgcctgtaatcccagcactttgggaggccgaggggggtagatcacgaggtcaagcaattgagaccatcctggccaacatggtgaaacctcgtcactactaaaaacacaaaatttagctgggcatggtggcatgcgcctgtagtcccagctacttgggaggctgaggcaggagaatcgcttgaatccgggaggtggaggttgcagtgagctgagatcgcgccactgcactccagcctggctacagagtgggactccatctcaaagaaaaaaaaaagagtggcagggagcttgaatgttatggtgcaacttggactgtcaccattgcccaccctaccccagatcccaagacaaaagcgtggttgaaggagcacgtggagcctgtgttcggcttcccccagtttgtccggttcagctggcgcacggcccagaccatcctggagaaagaggcggaagatgttatatggtgggtgtcatggatgtcctgggggtgctatagggaaggaaggagggaggccagcgttcagccctgcctgagagggttgctccctgtgtaagtggtcactgtcatcacctctctcccacagggaggactcagcatccgagaatcaggagggactcaggaagatcacatcctacttcctcaatgaagggtcccaagcccgtccccgttcttcccaccgatatttcctggaacgcggcctggagtcagcaaccagcctctagcagctgcctctacgcgctctacctgcttccccaacccagacattaaaattgtttaaggagaaccacacgtaggggatgtacttttgggacagaagcaaggtgggagtgtgctctgcagccgggtccagctacttccttttggaaccttaaatagaatgggtgttggttgatt

SEQ ID NO: 447 - DNA, 2765 bp, Homo sapiens
gcccagcccctggcagcacccacgatgcgggacctgcctctcaccagcctggccctagtgctgtctgccctgggggctctgctggggactgaggccctcagagcagaggagccagctgtgggcaccagtggcctcatcttccgagaagacttggactggcctccaggcagcccacaagagcctctgtgcctggtggcactgggcggggacagcaatggcagcagctcccccctgcgggtggtgggggctctaagcgcctatgagcaggccttcctgggggccgtgcagagggcccgctggggcccccgagacctggccaccttcggggtctgcaacaccggtgacaggcaggctgccttgccctctctacggcggctgggggcctggctgcgggaccctggggggcagcgcctggtggtcctacacctggaggaaggtatgtggggcccagccccaagcttggcaccgccgtcttccttcaggtgggccgggtcctcctagggaagatcaggggctggcagagcccccaccctgggcagggaggctgtggtcttgttcctaggactgggttgcgggtccgtggcctggaaggtgggcaccacactctgtcctgtccccgaagcccagctcttagacttgcccctgcctcggtgccagggagagagctgctgccttctccccacccctgaagacgacgcagggctcggggccagtggaacccttcttcccacagccccagcctgttctcagggccgctggcctaagatactccctgcggggaaggggcttcatcgggcaccccaacccagagaccccagggcggcagccccacccacagcctcagacgcagcccctgcctgcccctgccgtcaccgctccctggctgcaggaaggcagctaagaggggcacccttgtcccccgcttgaggtcccctgcacagtggccagagcggcagggacagatcccaaagattcccggggggtgtggccttcaatggctcaggcgtcccctgctgtcccggctgcagtgacctgggagccaacaccctcgctgaggttccaggagcccccgcctggaggagctggccccccagagctggcgctgctggtgctgtaccctgggcctggccctgaggtcactgtgacgagggctgggctgccgggtgcccaggtaccagggagttgcatggggcagtgcccgggccgtggcggggggcatggatttgttgcagggtctgcagtactgagaacagcgtagaaccagtggcgatgggaggaaggggaccggtagagcggggctgggtaagcctccatccagccgggctgagccctggtctccgcagagcctctgcccctcccgagacacccgctacctggtgttagcggtggaccgccctgcgggggcctggcgcggctccgggctggccttgaccctgcagccccgcggagagggtaggtccgcgtggagagggacggggagccgggtcgactgcccccgggcccccagcccctgagccagccgcgtgcccacccaccgcagactcccggctgagtaccgcccggctgcaggcactgctgttcggcgacgaccaccgctgcttcacacggatgaccccggccctgctcctgctgccgcggtccgagcccgcgccgctgcctgcgcacggccagctggacaccgtgcccttcccgccgcccaggtgcgcgcaggcaccgggacacggggcaggagcgggcgggggcggcgtggcctcgtggccgctctcaactcctccaattgcgggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggc

SEQ ID NO: 448 - DNA, 17448 bp, Homo sapiens
cgctgcgcgctgcgggatgcatctcccggaaaagcgaggcgaggggcgggccacgccggtgcgggaaccctcaggattggccagaaggaggccggcgctgtgactccgtccattcccgccgttgacatccaagtcggagacgctggggattggtttccagcggacacgctaagaagcttggagatagtttcgccctcctcacacgctgcggagagggagctccgctgattggtccgaggagtctgggcgcgcgccgatcggcgctccaggactggctgagggggtgcgcgcgccgccagggagcgttggcggtgattggccagagggcggaggccggctatttgaaggcggcgcgcggactaggtgcgcacttcagttctcggagagaagaggcgggagtggacctggtcagccctaccccactgaccccaccggacccaggcgcggcctccgccacagccacagcccctgcccctgctgcggcgcggcgaggcgaggcgatggccaaggtgtcggtgctgaacgtggcggtcctggagaacccgagccctttccacagccccttccggttcgagatcagcttcgagtgcagtgaagccctggcggacggtgaggctgggcctgtgcggggacccccacccccgggccgaccccggcctcccctcagagaaccgctcccatggccaacttgatctcccccatgaaacccctcgtcccccttccgccaaccccgatctcccccagcccgccagtcaaccggatctcccggtggagaccccccgccaccagccaacacggacctccccgtgacctcctcccccactgcccgccttgacctcccgggtggagaccccccgccagctaactcggacctcccagtggcctcttcccccactgcccgccccgacctccccatagagattaaccccctccaagccccatttcccgcgtggggaacctcatccatcttttttctctggagctcttcctaggtacccgttttcatggggagaccttctcggcctccatttcttaacccacggagatcttcagccaccgtggtttccctgtggcaagacccccgcttcaaccacccacccatttttgcccacttattccctctttcctgtagtgagatactcacacctcccattttccctctggagacccccaatatccagccccttcccattttccccgggggaaatcccagccatctcctattttccctatggagacctctcacccaagctcctctctccttgccgtgaagaccctcccctccagtaacctttttttcctgtgaaaacccctcaaccccttttcaggacctctctcaaccccatcttcccatttgtgtcccaccagtcccctccccaacctgccaatatttcaataaccccacgcccaccagttgctgccgcttttctgccccaatgcacataccctggaacctggtttctctccttcgttggggcccaacccccctatgcttgagctctccctgggaaaggatgctaccgtctttgaggggaactttgtctccccagctccccttccccacctttctctgtgggcttggataaacacactgagatccgaggggtggcatagccaggcaggcattagctagttctccaggtttgcccacccgtttccagctgagttactgcagcaatttttctgtcactttttctttcttcttcttcctcttcttttttttttttttttttttgagacagtctcactctgttgcccaggctggagtgcaatggcacgatctcggctcactgcaacctccacctcccgagttcaagcgattcttctgcctcagcctcccgagtagctgggactacaggcgcctgtcaccacgcccagctaattttagtatttttagtggaggcagcgtttcaccatgttagccaggttggtctcgaactcctgacctcaagtgatccacccgccttggcctcccaaagtgctgggattacaggcgtgagccaccgtgccccgtcttcttcttttttttttttaatatagctggataatcagtgccaagctcccgttgcttttgatggtctgacctagtctggggggtgggtggattgggctgagctgtgacgggctccagcttcaaacagtcggctggagcttggaggtcacagcctcctgtacatcttttccaaggtgcttccgtagatgtacttattaatctgtgtgacttaaaggtgggcatggctctcatctcacagatgagaagacaggagccacaaaacgcaaaagacctttcaagtcaaggcctgtacaaatccaaaatctaaggtcacctagggagccttggcaccactaacaggcaagtcctgctttcaggaagaagtactccattaggccatttttctacttggtggttgaaagagaaaaggcagcagccgaggaggtggtgatctgggggcctgtgaagccaggatatgctaactagtgcctctcgggggcaggtaggtgttttgccctcaaagctggtcgcctggactagcttggagctgatagagtgagatgtggatgtgctttgggtaggccagtgggtctgtctctccccggtctctctcgctcctttttaaattaaggagtctacttgtggctaactatagaatatgccgagttaaatcctttctggaacaaggcagcgggtaaataaataaataaagtgtagaatgacgctgtggaataagatttaatttaaaagccaggaggagatggaaggaagtaataggttgagggattcccagctccccgacggcaggagatcaggtttcaatcagcctgtttgtgttccttgcatttaaaaatggttgtggccgagcgcggtggctcacgcctgtaatcccagcactttgggaggccgaggcgggcggatcacgaggtcaggagatcgagaccatcctggctaacacggtgaaaccccgtctctactaaaaaacacaaaaaattagccgggcgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaatggttgtgcggtcattatctggtacttctactcctaggaagcccctgccctgtgactttactaacttatttatagaattagagccggaagggctaaattcaacctgctggtcctttttttgtttttttggagatgaagtcttgctcttgtcccccaggctggagtgcaatggcgcgatcttggctcactgcaacctccacctcccagattcaagcgattctcctgcctcagcctcccgagcagctgggattacaggtgcctgctatgacgcctggctaatttttgtatttttagtagagacggggtttcaccatcttggccaggctggtcttgaactcctgacctcaggtgatccgcccgcctcagcctcccaaagtgctgggattacaggcgtgagccactgcgtccagcctctgctgatcattttttaatagaaatggagtgacttcaccagagtcacacagccagtttgtagaagtattggcactgaagttttgaatctaaattctttatctttgctccaatccagggaaagaaaggaaggattccctgtttcaggggtggagcatagataggaatgaccacagaatttattgcctaatcaggacactcaaaatgcagtgaagggaagtgctattattattatttatttatttatttatttatttatttatttttgagatggagtctcgctgtgtcacccaggctggagtgcagtggcgtgatcatggctcattgcaagctccgcctcccgggttcacgccattctcctgcctcaatctcccaagtagctgggactacaggcgcccgaaaccatgcccagctaactttttggatttttagtagagacggggtttcactgtgttacccaggatggtctcgatttcctgaccttgtgatccgcccgcctcggcctgggattacaggcgtgagccaccgtgcccgtcgtatgattatgatgatgatgatgattattattagaaatggaatctcactatgtcacccaggctacagtgcagtggtgcaatctcagctcactgcaatctccacctctcgagttcaagcgattctccggcctcagtatcccaagtagttgggattacaagcttgagccaccatgcccggctaatttttgtgtctttagtagagacgaggtttcaccatgttggccaggctggtctcaaacctgatcgcaagtgatatgcccacttcagcctcccaaagtgctgggattacactttgaatcctaagcgcctggccagagaatgctattgttaattgtacctggatgataaagcttttcctttgagtaactcaagtgagaaatcctggctcttccagtcctagggctctctgtgactgatctgccagcttgctttctgcctccttctggactcctctccatgaaaaagggagaatctgcctcactctcagcagcgtcaactgaaaatctgacaaaacccccaacccagctgtgtgaggtggctcatgcctgtaattccagcactttgggaggctaaggaaggaggatctcttgagcccaggaatttgggccagcctgggtaacatagcaaaaccttgtctctacagaaacatcaaaaaattaacgggacttggtggcacgtgtctgtggtcccagctactcaggaggctgaagtgggaggattgcatgagcccaggaggtcagggctgcagtgagccatgattgcaccactgcactccaacctgggtgagagagcaagacccccatctcaaaaaaaaaaaaaaaaaaaaccaccctaacccctaagccccagttgggtgacccctatttctcaggggccccaagccccctttgcacttttatcttccacatctggaaatagattcttccacatttagctgagaaattcaacagacactggttgaataagtcatagaagccagatgttctgacccagaaataacgaagttgttatggcagcagagctcatctttgattatgaacaaaggcaaaaagcaaacaaacaaaggaggcctggcatggtggctcacgcctgtaatcccagcactttgggagaccaaggcgggcagattacctgaggtcagaagttcgagaccagcctggccaacatggtgaaaccccgtctctactaaaaatacaaaaaattagccgggtgtggtggcgggcgcctgtagtcccagctactcgggaggctgaggcaggagaatggcgtgaacccaggaggcagagcttgcagcgagccgagattgcaccactgcaccccaacctgggcaacaaagcaagactccatctcaaaaaaaaaaaaaaagaaaaagccaggtgtggtggctcacacctgtaatcccagcactttgggaggccgaggcggatggatcacaaggtcaggagttcgagaccagcctaaccgacgtggtgaaaccccggctctactaaatacaaaaattagccaggcatggtggcacgcagctataatcccagctactcaggaggctgaggcagaagaatcgctagaacccgggaggcagaggttgcagtgagctgagattgtgccactgcactccaacctgggtgacagagcgagactctgtttcaaaaaaaaaaaaagaaaaaaaaaatggccaggcacagtggcttacccctgtaatcccagcattttgggagaccaaggcaggtggatcatctgaggtcaggagtttgagaccagcctggccaatgtggtgaaaccctgtctctactaaaaatacaaaagttagccaggcttggtggcaggtgcctgtagtcccagctatttgggaggctgaggcaggagaagcgcttgaacccgggagatggaaattgcagtgagcccagattgcgccattgcactccagcctgggcgacagagcaagactgtctcaaaaaaacaacaacaaaaaagcaggaagcagactttttagctagttcagctatactaattgtgtacatgtctttagtcttatcatttatatatatatatatatatatatacacacaaacacacagtggaggtatgtcttgcacagggactagcttgtgaagttagcgcagagagataacatgggacacagttgagttgccttgacattgctcagaaggttaggtacacacgtcatgtgtacagctgtgtcctgtactcatagctatgagttcctgctgtattggtgatttgtgtcccatgtataattctaaagaaagattatatttagagatgaaatcatacacgtatgtctctacttataacactgcagccagatttttttttttttttttaaagagatagggtgtcactatgttgcccagactggacttgaactcctgggcttaagcagtcctcccacctcagcttcctaagtagctggaaccacaggtgcacatcaccatgcctgggcacttcagcaaatttaagatgattctcgactgggcatagtggctcatgcctgtaatcccagcactttgggaggccaaggcaggcggatcacaaggtcaggagatcgagaccatcttggctaacacagtgaaaccccgtctctactaaaaatagaaaaaaaaattagccgggcgtggtggggggtgcctgtagtcccagctgattaggaggctgaggcacaagaatggcatgaacccgggaggcggagcttgcagtgagccgagatcgtgccactgcactctagtctgggcaacagagtgagactccatgtcaaaataaaataaaataaattagaattacaggtgcacaccaccacgcccagctaattttttatatttttagtagagatggagtctcactctgtcacccaggctggagtgcagaggcacgatctcagttcactgcaacctcagcctcccgagtagctgagactacaggggcatgccaccacgcctggctaattttttgtattttttgtatcaccatgttgcccaggctgatctcgaacttctgagctcaagcaatccacccgcctcagcctcccaaagtgctaggattacagccatgatccaatgatccacctcacctggccctatacctataactctttttttcttcctttctttccttctttcttcttttttttttttttttttttttttttttttttgacggaggctggctctgttgcccaggctggagtgcagtggcaaaatctcggctcactgcaatctctgctgcctcccaggttcaagcagttcttatgcctcagactcctgagtagctggaattacaggtgcacaccatcatgcccagctaaatttttatatttttagtagagatggggtttcaccatgttgcccaggttggtctcgaactcgtgagctcaggcaatctgcctgcctcggcctcccaaagtgctaggattacaggtgtgagctgccgtgcccaaccagcttctgtaactcttgagtcagtatttctctacagccgttagttaattctccagtttctttccagccctggttgaaagagccatttcagcccctgtgcctgacagtcaacacagtacattttttctttttcttttttttcctttgagatagggtctctgtcgtccaggctggaatgcagtggctcgatcatggctcactgcagccctgaactcctaggctcaagcgatcctccaaccttagcctcccgcatagctgggaccaccggcacgcgccaccacacccaattaattttgttgatttttaatagagtcgagtctgcctatgttgcaggggcccatttatttcggtgagtttccacatgctctttgtttaggttttgccgattagtattgacctcagctggacaacatcaggtgctcgtgggtacactttagtcttttttgtctaccttcccaggacatgaattaaatgcacccgtacaggattctaccggctatgagaggaaagggctcaaggatatacaccaaaatgatacaactgctttagaaaggagagagcagggctggctggcttttctgtcttcccccaaaacttgattccagttgtgtcactacttgtaacaaaaataaatcaacaggctggacatgatggctcagacaaattccagcactttgggaggccaaggcgggaggattgcttgagaccaggctgggcaaccaagcaagacctcatctctaaaaacaatttaaaaattccctgggcgtgtggcacaagcctgtggtcccagctacttgggaggctaaggcaagagaatcacttgagcgcaggaatttgtggctgtagtgagctatgattatgccactgcactgcagcctgggtgacggaccgagaccccatctccagtgaaaaaagtcaacttcctccctgcaaatagtaagaggctagttcgaccaaacacctgtgagttcaatggtcacccgtatcctacagacctgctatagggttcctgagtgaaaccacaaagggacaggcagccagtgcatcaaagaagggcatggggctcaggtgacaagcctctgtagtcatgacctggcagcagcatgcttccaaagttggatgctcttgtgggacactggaccaaggaacagggcagcttctgagagagtttgcttcctgtgaaaatcacagcttgtgaaacttcccccagctgctagagctgaagggttgtgtaatttctaaagagccaaaaataagtttcaagcctcttgccaagcctccctgtaccagcatgaccttgcccctgatacacttggacctcctgcaagaggccatgttgaccggaatttcctgtgattgacagccagaggttccataagcactttcctttcatctcaatggagcatattcaggggagggggccctcctgctggatggggtgcaagagttagggtttgaggctgggcacggtggctcacacctgtaatcccagcactttgggaggcggaggcggatggatgacctgaggtcaggagttcgagaccaacctggccaacatggtgaaaccccatctctactaaaaatacaaaacattagccggctgtggtggcgggcgcctataatcccagctactcaggaggctgaggcaggagaatcacttgaacccgggaggcagaggttgcagtgagccgagatctcaccattgcactctagcctggacaacaagagtgaaactgtcaaaaaaaaaaagtgtttggaggatcaccccgggatgccacatttgttgactgagttgcccaaatgtctctaagtaggcatgacttggtgccagatctggaagaccagggtggctggctccctgagcaacctcaccttccccctcctgcaggctggctctcctgccggattggaatctgccaccctgccccagttgtcgagggatccacttcgttgagtggcaccggtccctgtgtgtgaaagaggatgctgcttcctatcccagcacccagtgggcagggccctgaaatgacccaactccctgccgttcccttctcagcacgtctgtgtcacgtggctcttaattcagcctctgccatacagttcacgctcaggccttgagaggcccaggtttccccagaggtatagtcaaggtcacctgtcatagctaggcttacaagacagaattccctaatggaggtagagctttgtgcccacctcagcattcaagactgcagtgcctggcactaagtgtctgacagatggaataatagtcttttaacatattaaggatctgtctaaaattaccacaaggctgggcacagcagcccacacctgtgatcccaacatggtgggagtccgaggcaggaggatcgcttgagcccaggaggttgaggctacagtgagccatgaacatcccgctgcacaccagcctaggcaacagagggagactgtctcaaaaaataagtaaataaaaataaaatagaagatgtggccgggcgcagtggctcacacctgtaatcccaccagtttggaaggctgaggcgggcagatcacttgaagtcaggagttggataccagcttggccaacatggtgaaaccccatctctactaaaaatacaaaaacaggccaggtacagtggctcacacctgtcatcccagcactttgggaggccaaggcgggtggatcacctgaggtcaggagttctaaaccagcctgatcaacatggtgaaaccctgtctctactaaaaataaaaaaattagccagccatgatggcaggtgcctgtaattccagctactcagtaggctgagacaggagaatcgcttgaacctgggaggcagagattgcagtgagccaagatcacaccattgtactccaacctgggtgacaagagtgaaactccatctcaaaaaagaaaaaaaaaattagctaggcgtggcagcgggcacctataatcccagccactcgggaggctgaggtatgagaatcactggaacctgggaggcggaagttgcagtgagctgagatcgcatcactgtattctaacctgtgtgacagaacgagactccatctcaaaaaaaaaaaaaaatacaagagcctatccctgccttcttgctgttgagctatttcaattagttaaccctcctatatctttgcagacctggagtggaagatcatttatgttggctcggctgagagtgaggaatttgatcagatcctagactcggtgctggtgggccctgtgccagcagggagacacatgtttgtctttcaggtaagaaagatgaggccttaggccttagcccttgattcctagaaacatcctcttttacctgaaatcccacagagtgcttcaggaatcaaaagttcaagttcagctgggcacgggctcacgcctatagacccagctactccagggactgaggtgagaggattgcttgagcccgggagtctgaggctgcagtgagccactgcactccagcctaggcaacacagtgagaccctgtctctaaaaaagaaaaaaacaagtattaaaaacatagaggccgggcacagttgctcacacctgtaatcccagcactttgggaggccgaggtgggaggattgcttgaggccaggagtttgagaccagctggggcaatatagtgagaccgcatctctacaaaaaatgtaaaaatcagcagagcatggtggtgtgcgcctgtagtctcagatacttgggaggctgaaatgggaggatcacttgagcctgggagatggaagctacaatgagccaagaccacaccactgcactccagcctgggcaacagtaagacccagtctcaatcaatcaattaaaacaatttaaaagttcaggttcaaatcctagttctactgtcaggaactatctgacctctcagaggccgtcaggccctcccttcccccacctctgtgtcaaagctgccactgatttacaggcaattcccattatttacaagagttacgttctataaagttgccgcgaacactgaattagtgaatactgaaccattgccccaggggaaatacagggttagattcttggaagtcacattttcgtcagctggttaatacgtaaacttgtatgtgtgtttatgttgaaaagacaccaggacggctatgatggctcaaacctgtaatcccagcactttgggaggctgaggtgggtggatcgcctgaggtcaggagttcaagaccagcctggccaatgtgatgaaaccccgtctctactaaaaatacaaaaatcagccaggtgtggtggcgcatgcctgtaatcccagctactcgggaggctgcggcgggagaatcgcttgaacctgggagatggagattgcagtgagctgagatcgcaccagtgcactctagcctgggtgatacagcgatactctgtctcagaaaaaaaggaaagataccttatttaatatatacagtggttcatttatgttgaattcacagccaacagcactataactctcctgaatgaaacttctctaatacgcatattttccataaagcctttcttgtatcctacactgcacttcagcactaccgttgggtgccatcatagacagcaaactcaccaacaaaaagcacaaaacatggaaaaaagcactaagtaggctgaggaaaggacgctcattcacagtgagagctgagaccagaagacagagtgttgccttgtttgacctcaggtgggaacaggcgtggtaggtaactctaggtgggaacaggcatggtaggtaactccagtttttccctgctctgtgcatgtctgcaagtgactgtgaaagcaagcaggtgttcatcttggggttacaaataaacttagcaggtaggtgaacttgcacatatggaacccatgaataatgaggatggactgtaactcctaaatggctctcatgcagcaccccacctgggttgtcaaatgtagattctggccgggtgtggtggcttccagcactttgggaggcagaggcgggaggactgcttaaggccaggagttccagactagcctgggccacatagcgagacccccatctctacaaaaaatagaaaaattagccgggtgtggtggcttgcacctgtcgtcccagctacttgggaggctgaagcaggaggcttgcttgagcctgagagtttgaggctacagcgagctatgattgcacctctgcactgcattctgggtgacagcgagacctgtctctacaaaaaaaacattaaccaggcatagtgatgcaggcctgtagtgccagctactagggaggctgaagcagaagactcacttgaggccaggtgccatggctcacacctgtaatctcaacactttgggaggctggggcaggcagatcacttggggtcaggagttaaagactagcctggccaacatggtgaaaccctgtctctactaaaaaatacaaaaattagctggatgtggtggtgcacatttgttatcctagctactcgggaggctgaggcacgagaattatttgaatccagggggcggaagttacagtgagctgagattgcgccactgcactcgagcctgggcaacagagtgagaccctgtctctaaaaaaaaaaaaaaaaaaaaataggctcgcttgagcccaggagttccaggagtttacagtgatctgtgattgcaccactgcactccagtctggatgacagagggaaaagctatctctttaaaaaaagaaggccggtgcagtggctcacgcctgtaatcccagcactttggaaggccaaggtgggcggatcacaaggtcaggagattgagaccatcttggctaacatggtgaagccccatctctactaaaaaatacaagaaattagccaggcctggtggcgggcacctgtagtctcagctactcaggaggctgaggcaggagaatggcgtgaacctgggaggcggagcttgcagtgagccgagatcacgccactgcactccagcctgggtgacagtgagactccatctcaaaaaaaaaaaaaaaaaaaaagaagaaagaaaaaacaaatggagattctgagttctccaggtgatttttcaggatcctctgctcggatacactcccttacctccatcactgctgttaccgccctaatccaagctaccacatcctatctaaccccttcagccaccactactaaatccactgacaggccctatctactcaacagtcaggactggcctcctgggtgtgcaacccaggcagctgcacaggaccccacacttggtgcgatactctgctgtcaccgtctgaaacctaatagcttttctggaggggcgtggtgttttcattttgcattggttttattttgcaccaattacgtggctggtcttgtttgcagtagtacaccctgaatctgttctttactgcctggtctaagccaagtccactgcctctccaggatgactggtgtaagccttctgctccactacagtctcctgtcacggctccacactttgccagaggcttcttttcagatcacaagagtgatgtggcacttaacctcctgcttactctcttgccctttcccaatcccttagctggcccccgggtggcctgataccacctgcctcacctgttcagcttcatgccactgtcccccggctcaccacactcctccagagtaccacgcacctctccctgccacagtcaacgttttgtagtcatttgtgggattgattctgtgtttccatcagttgacaactcctggctgggcacagtgactcacacctgtaatcccagccctttgggaggctgaggtgagaggatcgcttgagcccaggagtttgagaccagcctgggcaacatggagaaaccctgtctctacaaaaaataattggctagacatgttggcacacaccgttgtcccagctatttgggaggctgaagcaggaggattgcttgagcccaggagttcaaggatgcagtgagccatgatggcgccattgcactccagcctgggtaacagagggaggccagaccctgtgtaaaaaaaaaaaaagtccaggcgcaatggctcacacctgtaatcccaacactttgggaggccgaggtgggcagatcacctgaagtcaggagtttaagaccagcctggccaacatggtgaaatcccgtctgtactaaaaatacaaaaaaaaggctgggcgcagtggctcacacctgtaatcccaacactttaggagtccaagacgggtggatcacctgaggtcaggagttcgagaccagcctggccaacatggcgaaaccccatctctactaaaaatacaaaaattagccgggcatggtggtgggcacctgtaatcccagctactcgggaggctgaggcaggagaatcgcttgaacccgtgaggcggaggttgcagtgagccgagatcgcaccattgcacttcagcctgggcaacagagcaaaactccattaaaaaaaaataccaaaaaaaaaaaaaagttagccgggtgtggtggtgtgtgcctgtagtcccagctgcctgggatgctgaggcagaattgtttgaacccgagaggcagaagtaaaaaaaagaaaactgagggcagagagcatactttttgctcagtaaatacatgatgcttgggaatctttgtactaatgacatcgaggcatggctgtggcactgctaaggcctaggatgtgtctcccctaggccgacgcccccaacccatccctcatcccagagactgatgccgtgggtgtgactgtggtcctcatcacctgcacctaccatggacaggagttcatccgagtgggctactacgtcaacaacgagtacctcaaccctgagctgcgtgagaacccgcccatgaagccagatttctcccaggtggggcctgtttccacttcctgcttcccacaaggccgttctttatacttggggggagttcagccattcaaattgagagtcaaggtcacttcttaaggttttcaagtaatattcagttcttacagtactgtgttagaagaggagaaaaagacctttgtctctcaaaggcatgtcttagagaattaagattaggccagcctgggcaacatagtgagaccctgtccctaacccccgcaaaaaaaaaaaaaaaaaaaaatgagccagacatgggtggtgtgctctactctggaggctgaggtgggaggatcgcttgagcccaggagtttgaggctgcagtgagctcagatcgtgccactgcattccagcctgaccaacagagtgagactgtcccttaaaaaaaaaaagtcctgggccaggcacagtggctcacgcgttgtaatcccagcactttgggaggccgaggctgtaggatcacctgaggtcaggagtttgagaccagcctggccaacatggtgaaagcccgtctctactaaaaatacgaaaatgagccaggtatggtgccttgcacctgtagtcccagctacacaggaggctgaggcaagagaatcgcttgaacccggaaggcagaggttgcagtgagacgagatcacagcattgcactccagcctgggcaacaaaagcaaaactccgtctcaaaaaataaataaataaataaataaataaggtcctggccacaggtgttttctggagttccatatgtaggttgctcttgctgggcttgagatgggtgattgggggtgtcctggctctatgggaccaaggagagggcgtacctacaagggttgacgttcctcttcctgccccagctccagcggaacatcttggcctcgaacccccgggtgacccgcttccatatcaactgggacaacaacatggacaggctggaggccatagagacccaggacccctccctgggctgcggcctcccactcaactgcactcctatcaagggcttggggctccctggctgcatccctggcctcctccctgagaactccatggactgcatctaactgcaggaacccagagtgtcccagcacgccgggaggggcaaccaggcctcccagcgagtcctgcagggcccatctagaggactttgggggccatcagctgcaatccaggtctgtcaaactcagcccctaggaaagaacaggccttgggtctcccctagtcctggccagaaggatgatctcgcttttcctctacaggcctataagaagcaggtacttcagttctaaattctgacttgtgttcttttcgtcttcataaattctaactaaggccactgtgccactgtgcacccttgagtaccattgatccaaagctttcccacagacctccctggcccacctagaggctttcttggtcagtgcctgtcaaggctccagtcctgctgagccaaaggctttgtcattcctttctcttcctgtacatctgagcagacccactccagctttctggtgtcacaggcgggaatgttagttagtaggtagacttagatcccatttctgtcctgctcccaggaagattcttaggtcctcttcaatccagcagcccctcccagaggtgtgatcagcaggatgctgaggaaccatgttgcctttcctgtcaatcacagccaccttcctgttatctcctaaatggatctggcttttcctggaggctgccatggttggaagatggtatcagagggcctgcctgggcagtctgtctccgggccagggtcagggaccctctgcctctggcagccttaacctgtcctctgctaggaccagggtgatttcaagccagggaagcaactgggaccctgaaaactgtccctccccagcccgctccccctctctgtgccctggtccccttgctgccatgtggatgctgttgtgattgctgtttgtatattatcaaaatgtttttatattaaaaatgtttggtctgaaaattaaaagcacttcatttagaatga

SEQ ID NO: 449 - DNA, 6798 bp, Homo sapiens
gtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcaggacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggtgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtggcccgaggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagggtgcatttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagacgaaaaaggcgccactggtggctcaggaagctcccagacagagtgcatgcctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgctttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtggtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagcctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtaagtggcagctggggagaggcggggcgaggtatctgagagggggcgtgacctgggtcttggggcggccggccccgcctgcctccctctcggtcccggtagactagacggaagtgggacagagtagaagtcaaaggtgccttagcgggtggggctgttgatcgcactttgaggggtgggagatggaggtggcagggggactgaattcaaggggagggaccctccggggctgtcactgctgcaggaaaggactttaaaacttgggctggattctgcgtggtggaaacttgacccaattcacaatccactgtggggaagattggggagggaccaaagtcattggatgttggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacggagcgggcggcggcgctggcggggcggcaggcgcggagggcggacccgaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctacccatcccctcaataaagtttttataaaggaa

SEQ ID NO: 450 - DNA, 2710 bp, Homo sapiens
acgtcgactccgctgggtggggccggcgtcgggcggggccggcggggtcttcagggtaccgggctggttacagcagctctacccctcacgacgcagacatggcagcgcagaaggaccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggtctcctctaatgggaccctggagtctgggcccctagtcccctccctgcctgctgtacaggaatctggggtcccgggagggagtccaggcacccttagtccccttcttttgcgggggtctggggctccatcccggtccaccactgacccggccccaccccccgcaggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtgtgagtgcctcccgggccccgcacccgcactagccccgaccggctggacccctcctctcgccgctcaggccccgcccttcaccgcccggtccctcctctcaccgcccagggccctcttctcaccgcccaggccccgcccccaaggattggctctgctagactaccttgtcaccaaagggccaggtcccctaccccaccatcaccctggccaggatgcagtgtgactaaatgtcacctggccctccctggtctccaggatgtagcttgccgcccgccggtggagaaggccagggccgtcgggctggcccagccccagctgtctaaccgctgcctccctgcactcctcctccagggtgacgtcccctatgttgctggtggctctggctgtctttttcggcgcctgttacattctctatctgcgcaccttggagtccaagcttgtgctctttggtgagaaaccccctgcccagatgaatccttggtccctcaaatcttggtcttttggaatgcagacagacctcagaccccaaatccaagtccttcaaaacccaagtccgcccaagcctagatgtacactagatcccccaaacctgatcccttaaaatctcagacacaaccgatccttccatcgagtctcagccccctcaaattgctattcctcaaacccaggatccacctggctgctgtgccttaaacctactccttttcaaaccacatgactcctcccctctctctcctccccttgccgctctctgcggccaacatcagctgcaggtgcccacactggacaccaggtggccaccttacactggcctagatctgttcccgtttcttttcctgctttctggggtgtgaccagaaagaacttggaacttagagagggaagccgaggagtatgtttcatgtggttcccagactagtagtaccaaggaccactgggaaaacaaaatgccaggggaaattccccccaggggaaaatcaaggtttggagtggggtcagggagttgggattggacagttaggtagacctgaaggccaggctcttcaggggcctgcaagttatgtgcttgatgggctggggtggagggagtgcctgaagcacaggcacgacttggcttcagctgatcaccgtcaccagagcatgtagaccccatccctgagacttctatgagaagcctgaagttggtatttttatgtgaaatcgttcactttgccagccacaaatcacatccttgcaaaacagctcaaaaaacacatccacaggtcagatttggcccttgggccaccagtttgagaccctggtctgcgcgagggttgcagcaggagagccctagtctagggagcaggaagccgggatcccaggaacttcctggaggatgtggggcagagggcagagggtggggctgaggcaggcgaggacggtgtgctgtgttctggagggcagtggggacagcaggggaacagggtgaccccaggacctggagggccttggcatgaggagtttggattcgatcccgagaacctggagcttgtacggattgttggggggcagcaggggttactctgggagagggcatggagagtcggaacagcaccccaatgccatctgcccccaggccgagaggtgagcccagcgcatcagtatgctctggctggaggcatctccttccccttcttctggctggctggtgcgggctcggccgtcttctgggtgctgggtgagtacagggtctgagcagctggggtggatggtgggagccaggtgcaggagtgtggccctgagctgccggctttcctgcaggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaata

SEQ ID NO: 451 - DNA, 22627 bp, Homo sapiens
attcctggcccatgggaagattgcgtttcacctgctcctgaaggccgaaggtggctctagcgcatcctttgtcgcgccgtgacctgcaggtactgacagatccgtagggaggacaccgtgacttcccggacgctgggaaatggtgagtgtgcggggccagtgtccgaggggaggtttctggttggaaccgtctgtggccgaggccggggacctccttgcagtcaactccggggtttgcagacccgggggccaccgcgggcgcagttcggccctcggtcctctctgtgggagctggacccgcagccgggagccccagcgtcctgtcccgtccccgcggggcgacctcggcccccggtcctggagccctctatgggcagctctgcgcccgcagccccgcgtctccccggattgttcggtgacagcgggagggtcctggggagatcccatctcggtctgtggggtttgtgcgtttaagaaaccacttggttggaaaccttacgatgaatccacgggtgcgtttcctcacttgtgagaaccgaagcctggctaggtccttgctgccggggtcaggttcctgtggctgttcaaacgcccctgccctcatcaccagggactgaccccctctagtgctcccagcactcaagtctgggggtgtttttgaccttctgaatgtgggctttcttttcgaactgcggggaaggggactccttatcttaactgatcagaaagtttgtgtttcttccctttggactccttgatcaaatattaattctagccacccttaattccagtttcccttcgctctgggtaattttgttcccttgcgtgaatgtgtgcgatttttagtttctttggtttctggatggaattaattgtgagcttgttcaggttcttttaaattttcttgtttgtgtgtgtttatctgtgtggtttctacccaagagatttcgcctatgttggagtgccatgatgatgcaaaatctctgtatgtcatttgttccgtatataagtggtaagcatttttttttgtgtgtgacggagtctcgctctgtcgcccgggatggagtgcagtggcgcgatctccagctcactgcaagctccgcctcccaggttcaagccattctgcctcagccttcccagtagctgggactacaggcgcccgccaccacgcccagctaatttttttgtatttttagtagagacggggtttcaccgtgttagccaggatggtctcgatctcctgaccttgtgatctgcccgccttggcctcccaaagtgctgggattacaggcgtgagccaccgcgcccggctaagtggtaagctttgaggtgtttgtgagagtgatgtttatgacacacaccactttgatacattctgattgtaagtgtatgttgtgattttttctttcctcgtgtggttgtaataggtcagtgtgtttttctctgagcaattaaccagtggaaggttcctaagtctagagtcattgtgggtagttttgttgttgttttttttcttttttttgagatggaatctcactctgtcgcccaggctggagtgcaacggcatgatcacagctcactgcaacctctgcctccctggttcaagcagttctcctgcttcagcctcctgcatagctgggattacaggcacccaccaccacacccggctaattcttttattttttagcagagatggggtttcaccatgttggccaggctggtcttgaactcctgacctcaggtggtctgcctgcctcaacctcccaaagtgctgggattacaggcatgagccaccgcgcctggctgattgtgggtattcttttgatgctgatatgtcagtttgggtaccatatctagtttgggtaccctatcctgaaaggtgtagtatatagtttttcagaattggaatactaattatttttgtataaaataatcaataaataatggtttttctaaggtggttatttgtagattatatcttttatctgtctgtgtacttgggtcaaaagctagttgtgagtctcctcatcttaattcaagtaggcttaatatacgtgaccttgaatcttcacatcctgatggtttggatgtatccagttgaactacagctgctttatgccagtgttttgtaaataattttcctgattgtattgggtttctttttttatattttctttcttcttttgagatggagtttcactcttgttgcccaggctggagtgcaatggggtgatctcggctcaccgcaacctccgccttccaggttcaagcgattctccttcctcagcctccctagtagctgggattacaggcatgcgccaccacgcccagctaattttgtatttttagtagagacagggtttctccatgttaatcaagctggtctcgaactcccaacctcaggtgatccgcccgcctcagcttcccaaagtgctgggattacaggcatgagccactgcgcccggcctgtattggatttcttatgttattccaagtctgagttagtataagtacttcgcttagtacattgggtttgcagtcagtctttcaccgtcaagtttattaatgtaaatagattggtttttaagatgcctaccttgtaattgatactgtaattaaacaccttttgatattctgtgaggtcatttatatgagtcatcattgattgtatttcattgtctgtgagatagaggagagtatgaaagtggtagttgacatgtgggagttaagtttgtgtttaaaatcaaaccctgcccttaaataaaactgcgggctgggcacggtgggtcacgcctgtaatcccagcactttgggaggccgaggcgggcggatcacctgaggtaaggagttcaagaccaccctgaccaacatagtgaaatccatctctactaaaaatacaaaaaaaaattagccgagcctggtggcacacacctgtaatctcagctactcaggaggttgaggcaggagaattagaattgcttgaacccaggaggcagaggttgcagtgagctaatgccactgcactccagccttgagactctgtctcaaaaaaaactaactaaataaataaaggtagtttgcatatattgtagccaagcttgccacgaatgtgaatttagtatgtgttgaattatgtcacattctgaatggtgctgtgtctgttcattcagtttgatttgtaaagcttatcggtctaggtatatgtagccattttagtaaattatattgaaaaatgggtgagggtaaggtttttcacctgtaggatgatgaaatacagctctaatatatgttaaggtggaagcatattaatgttggtcatcccttaaaatatgtgtctcattgggtgattctgtacatttttttttataagtttctcagttgtggtgtttaattggtacccttgaaaacaagtatatttaggacaactctgtctacataatcttctgttgttttagcatgtgtttcagaagtcgtgtgtgtaggcccaggtgtggtggctcatgcctgtaatcccagcactttgagaaaccgagatgagtgaatcacctgagtcaggagttcgagaccagcctggccaacgtggtgaaactttgtctctcctgaaaatacaaaaaattagctggatgtgggggctggcgcctataattccagctactcgggaggctgaggcaggagaattgcttgaacccaggaggctgaggttgcagcgagctgagattgcgccattgcactccagcctggatgacagaggaagactgcctcaaaaaaaaaaaaaaaagttgtgtgtgtaaagtgatgaggatcagttaagattattgggtgggccaggcacaatggctcacacctgtaatcccagcactttgggaggccaaggtgggtggatcacgaggttaggagttccagaccagcctggccaacatggtaaaacactgtctctactaaaaaatacaaaaattagctgggtgtggtggtgggtgcctttaatcccagctacttgggaggctgaggcaggagaatcgcttgaacctgggaggcggaggttgcggcgagctgagatcacgccactgtactccagcctgggcaacagagcaagactccgtcttgtcggggggaaaagattactgggtgtaatctttgtttccaatctaattctactatgaggatttttttagttctgtcaaagaattgtggttctgtcaaataagtttgacttttggcataattataacaaggttggaaggcaaaatttctcaaaagtggaaagttagagaatcattatagtatgtcttatcctcttctattatatatcacagtccaatgggtatcccagtggcattggtattttttcccgtggaggtctgaaagttgggtatatgtaatatgaatgattggtgtgatagctgtgtctggtgttgtaccatcttttagatctgctttgtaatcataatctttacttccttcgagttcagattggtaccagaattcacatcaagtatcaacaaatgactcataggagtatatatcatatttaagcttgtcatgttagttcttccagtatatgtttttttttttttttttttttgagacggagtttcgcactttcgcacagtctggagtgcagtggctcgatcttggctcactgcaacctctgccttccagtttcaagtgattctcctgcctcagcctcctgagtagctgggattacaggtgcctgccaccatgcctggctactttttgtatttttattagagtcgggatttcaccatgttggccaggctggtcttgaactcctgaccttgtgatccacccaccacggcctctcaaagtgctgggattacaggcatgagcctctgcacctggccccagtatatggtttgactgtggtactgggattggtgtttggtctgacagattgcttttatctaatgatctgttttgttttgttgttgtgtttttttgtttgttttgttttgttttgtttgagacaagagtctcactgtgttgcccaggctggagtgcaatggtgcgatcttggctcactgcaacctccacatcccaggttcaagcgattctcctgcctcagcctcccgagtggctgggattataggcatgagccaccatgccagctaatttttgtatttttagtagagacggagtttcaccatgatggccaggctgggtaatgatctgtttggattggcatgtctgtttctggtagcatttttctattattatgtgtgctgtccattggtttgagatgttattgaatgcttgattatagctacatacattggttgagtcgcatttatgtggtcttctaaggggtgtttgggaatacatgccaagcgtctataaagatgcattgattggatgtgtgtgtagaaactctttaggcattcatttcaaatggtctgagactacatattattagtcccttgatttttctggcagttgttcaaaaaagaatatattttcatcaagtacatgtggagtgtgttctggtaatcgtgtgattttaggtatgagttggcattgttggatatctatgtattcgaggctcaggaatttttacggtggctttagtaggagtggtaggaacagaagtagtagtagtagtagttgttgtatctgttatatcccttttatattctaaaatattttaggctgcgtgcattgcctcacacctataatcccagcacttcggaaggtcaaggcgggaggatgacttgagaccagcaacatagggagaccccatcactacaaaaaaagaaaaaaattaactattttagtctatttgtgtcaatcctatgttttatattaattattggatatgtaatatgtatctgattaaacataacactgtaacaactaagatataacagtactcggccttgaggctccaagatggccaaataggaacagctccagtctacagctccctgcatgagcaatgcagaagatgggtgatttctgcatttccaactgaggtaccaggttcatctcactggggcttggcagacagtgggtgcagcccatggagcagggcggggcattgcctcacttgggaagtgcaaggggtcggggaattccctttcctagtcaagggaagccgtgaaagatggtatctggaaaatcgggacacttccaccctaatactgcacttttccaacagtcttagcaaatgacacaccaggagattatatcccatgcctggctcggagggtcccacacccacggagcctctttcactgctagcacagcagtctgagatcaaactgcaagtcggcagcaaggctggggaaggggcgtccgtcattgctgaggcttgagtaggtaaacaaagcggctgggaagctcgaactgggtggagctcaccacagctcaaggaggcctgcctgcctctgtagactccacctctgggggcagggcatagctgaacaaaaggcagcagaaacttctgcagacttaaatgtccctgtctgacagctttgaagagagtagtggttctcccagcatggattttgagatctgagaacggacagactgcctcctcaaatgggtccctgacccctgagtagcctaactgggagacacctcccaataggggccaactgacacctcatacagccgggtgcccctctgagacgaagcttcaagaggaaggatcaggcagcaacatttgccgttctgcaatatttgctgttctgcagcctccgctggtgatatccaggcaaatggtctggagtggacctccagcaaactccaaccaacctgcagctgagggtcctgactgttaggaggaaaactaacaaacagaaaggacatccacaccaaaaccccatttgtacgtcaccatcatcaaagaccagaggtagataaaaccacaaagatgggaagaaaccagagcagaaaagctgaaaattctaaaaatcagagcacctcttctcctccaaaggaatgcagctctttgccagcaatggaacaaagctggacggagagaattactttgatgagttgagagaagaaggcttcagatgactggtaataacaaacttctctgagctaaaggaggatgttcagacccatcgcaaagaagctaaaaaccttgaaaaaagattagacgaatggctaactagaataaacagtgtggagaagaccttaaatgacctgatggagctgaaaaccgtggcacgagaactacttgatgcatgcacaagcttcagtagctgatttcatcaagtgggagaaagggtatcagtgattgaagatcaaatgaatgaaatgaagtgagaagagaactttagagaaaaaaagagtaaaaagaaattaacaaagcctccaagaaatttgggactatgtgaaaatacaaatctacatctgattggtatacctgaaagtgacggggagaatggaaccaagttggaaaacactcttcaggatattatccaggagaacttccccaacctagcaaggcaggccaacattcaaattcaggaaatacagagaatgccacaaagatactcctcgagaagagcaactccaagatacataattgtcagattcaccaaagttgaaatgaagggaaaaatgttaagggcagccagagagaaaggtcttgttccccacagagggaagcccatcagactaacagcaaatctctcggcagaaactacaagccagaagagagtgggggccaatattcaacattcttaaagaaaagaattttcaacccagaatttcatatccagccaaactaagcttcataagtgaaggagaaataaaatcctttacagacaaacaaatgctgagagattttgtcaccaccaggcctgccctaaaagagctcctgagggaagcactaaacatggaagggaacaactggtaccagccactgcaaaaacatgccaaattgtaaagaccgttgatgctaggaagaaactgcatcaactaacaagcaaaataactagctaacatcataatgacaggatcaaattcacacataatattaaccttaaatgtaagtggggtaaatgctccaattaaaagacacagactggcaaattggataaagagtcaacacccatcagtgtgctgtattcaggagacccatctcacgtgcagagacacacataggctcaagataaagggacaaaggaagatctaccaaccaaatggaaaacaaacaaaagtaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagcccttagagacctacaaagagacttagactcccacacaataataatgggagactttaacaccccactgtcaacattagacagatcaacaagacagaaagttaacaagatatctaggaattgaactcagctctgcaccaagcagacctaatagacatctacagaactctccaccccaaatcaacagaatgtacattcttctcagcatcacatcgcacttattccaaaattgaccacatagttggaagtaaagcactcctcagcaaatgtaaaagaacagaaattataacaaactgtctctcagaccacagtgcaatcaaactagaactcaggattaagaaactaactcaaaaccactcaactgcatcgaaactgaacaacctgctcctgaatgactattgggtgcataacgaaatgaaggcagaaataaacatgttctttgaaaccagtgagaacaaagacaaaacataccagaatctctgggacacatttaaagcagcgtgtagagggaaatttatagcacgaaatgcccacaagagaaagcaggaaagatctaaaattgacaccctaacatcacaattaaaagaactagagaagcaagagcaaacacattcaaaagctagcagaaagcaagaaataactaagatcagagcagaactgaaggagatagagacacaaaaaactcttcaaaaaatcaatgaatccaggagctggtttttcaaaaagatcaacaaaattgatagactgctagcaagactaataaagaataaaagagagaagaatcaaatagatgcaataaaaaatgataaaggggatatcaccactgatcccacagaaatacaaactaccatcagagaatagtataaacacctctacgcaaataaactagaaaatctagaagaaatggataaattcctggacatacaccctcccaagactaaaccaggaagaagttgaatccctgaatagaccaataacaggctctgaaattgaagcaacagttagtagcgtaccaaccaaaaaaagcccaggaccagatggattcacagccagattctaccagaggtacaaagagtagctggtaccattccttctgaaactattccaattaatagaaaaagagggaatcctccctaactcattttatgaggccagcatcatcctgataccaaagcctggcagaaacacaacaaaaaaaagagaattttagaccaatatccctgacgaatattgaatcaaaaatcctaaataaaatactggcaaactgaatccagcagcacatcaaaaagcttatccaccatgatcaagttggcttcatccctgggatgcaaggctggttcaacatacacaaatcaataaatgtaatccatcatataaacagaaccaaagacaaaaaccacatgattatctcaatagatgcagaaaaggccttcaacaaaattcaacagcccttccttcatgctaaaaactcccaataaactaggtattgattggatgtatctcaaaataataagagctatctatgacaaacccacagccaatatcatactgaatgggcataaactggaagcattccctttgaaaactggcacaagacagggatgccctctctcaccactcctattcaatatagtgttggaagttctggccagggcaatcaggcaggagaaagaaataaagggtattcaattaggaaaagaggaagtcaaattgtccctgtttgcagattttatgtttagaaaacccatcgtctcagcccaaaatctccttaagctgataagcaacttcagcaaagtctcaggatacaaaatcaatgtgcaaaaatcacaagcattcctatataccaatatcaggcaaaagagagccaaatcatgagtgaactcccattcacaattgctacaaagagaataaaatacctaggaatccaacttacaagggatgtgaaggacctcttcaaggagaactattcaaggagaactacaaaccactgctcaatgaaataaaaggggacacaaacaaatggaagaacattccatgctcatggataggaagaatcaatatagtgaaaatggccatactgccgaaggtaatttatagattcaatgccatccccatcaagctaccaatgactttcttcacagaattggaaaaaactactttaaagttcatatggaaccaaaaaagagcccatatagcaaagacaatcctaagccaaaagaacaaagctggaggcatcacgctacctgacttcaaactatactacaaggctacagcaaccaaaacagcatggtactggtaccaaaacagagatacagaccagtggaacagaacggagcactcagaaataataccacacatctacgaccctgatctttgacaaacctgacaaaaacaagaaatggggaaaggattccctgtttaataaatggtgttgggaaaactggctagccatatgtagaataaggtgagacataggagatcttagaaaggctaaaggtgatcttggagaaactaagtctccatgctgggagtgcactgttgctgtcagtctgcaaattattaatcagatactgtgcttggcaagcagatggtgtaatttgtcatttgtctgcagtggtgtgtatgcttgtgttaccctggtttatgtggttggaatttaagtaataacaagacagtaaagtcactctgatgactagcagaggtgaatgagaaaggcggtaagaccaactgagaagctacacaaatttgtagccaggttgttcttttttttttttttttttgagactgagtcttgctctgtcacccaggctggagtgcaatggcgcaatgttggctcactgcatactctgcctcctgggttcaagcaattctcctgcctctacctccctagtaggtgggattacaggtggctgccaccatacctggctaatttttgtattttttagtagagacagggtttcaccatgttgatcaggctggtcttgaactcctgacctcaggtgatccacccacctcggcctcccaaagtgctaggattacaggcatgagccaccacaccaagcccaggttgttgttcttaagcaagtaaacgagttattccagtgatggctacaggtgatgttgaagttaaaaatacgaggtgagtggcaagtaaaactggattgaagtataccttcaattattcttatggaaatattgatgcaatcagtgacttgaagaaaacagtgtagtgccactgttgtaaaaggtgtaacaaatctaggtctagtgagaatttggagaaaagttggagattttgcataattctaagtctcctcttttacctgtagtcaataagtattttcatatccatgggccaagatgtcctgctgggagatagagttggcatttagtcaaatgctccccttgtaaggtataatctttgtatcattgtcttccttatcctttgtgactattaaggttggttgattaaagtaagagtaggaagggccgggggtggtggctcatgcctgtaatcctagcactttgggaggccaaggcgggcagatcatgaggtcaggagttcaagaccagcctgactaacatggtgaaaccccgtctctactaaaaatacaaaaattagccgggcatggtggtgcgtgcctatagtcctagctacttgagagactgaggcaggaggatcacttgaacccgggaggtggaggttgcagtgagccaagatcgcgccactgcgctccaacctgagtgacagagcaagactctgtctcaaaaaaatcaataaataaataaagtaagagtaggaggttgttcttatgaatgctttctcttttatttaaattaaaacatgccgggttaagagcttcttgggatgtgctcactttgtctagggttttcaattctctttttagtagcctggttaatttctatatacatcttgctgctgtgggattatagggtaggtggaaattccattgtgtatctcattgatctgatgtcacttgtgtagtccttgatgtaaaatgagttccctgattatttttaattttaggggcttccaattattttaggagctcttagaaaattgagctgcccaatttcctggcagggcatggtggctcatgcctgtaatcccagcactttgggaggccgaggcggacagatcacttgaggtcaggaccttgagaccagcctggccaacatggcgaaaccccgtctctactaaaaatacaaaaaaattagccaggcatggtggcaggcgcctgttatttaagttactcggaaagctgaggcaggagaattacttgaacccaggaagcagaggttgcagtgacccgaggttgtgtcattgcactccagcctgggcaacaagagcgagactccatctcaaaaaaaaaaaaaaaagatatgttttatgttccagaatgtgggctaccttggtgaatgttccatgtgaacttgagaagaatgtatatcctgctattgctggtctaagtgttttgattttccgttcagtccagttgtttgatggtactgttcagttcaacaatgtccttcctcattttctgcctgctggatctgctattgctgatagacaggtattgaagtctccagctatacttcatggctccatgcagttctccctgccgttccatcagttttgcctcattattttgccactctgtttttatgcacatacacactaaggattgccttgtcttcttggtgaattgatcactttgttattacataatgcccctgtgtcactgagatttccaggatgtgaagtcagctttgtctgaaatgaacatagctgtgttacttttctttttcttagtgttagcatggcatatctttcttcattcctttatttttaatgtatctataactgtatatttaaaatgtgtttcttttcaacaccgtatatttgatccattattgacagtatctgtccaccatttgttgtatttagaccattgatgtttaacatgttattgatttagttgtattaatgtctccctttttctttttatgtttttctatttgttgttgttcttcctttcccatcttctattctttttctaccttatctgctttcattaagcattttacttgatgccatttttctccccacttagcacatcaattatagttttttgttgttttttaagttttactcattgcctttgagtttgtagtacatgcttacaagtaacccaagtcctcttgtaaagaacactgtactacctcactggttgtgcaagtacctcatgaaaaagtattcccaattcctcctttcctgtcctttgtaacattgctaccatacgtatcatttatccataagctggacttaccaaatatattgttcctgttagtgttttggacaaactcatctgtcagattacaaaaaagagattgtattttacttgtatttattttttctctaatacccttctttatcgtttttcttttttgtagggaattttttaacagttctttcaaggcaggtacgctagtgacagattatcttttcttatctcataaagctttcatttctcttccattttgagggatattcttgctctatacagaattctatgtggttgggggttttgtcttataatgttttaaacatttcactccagtctcttcttgctttcactttctgtaaagagtcttgggctggtcctggtggctcacgtctgtaatcccagccctttgggaggtcgaggtgggcagatcacttggggccaggagtttgacacccacctggccaacatggcaaaaccccatctctactgaaaatacaaaaaattagctggacatggtggtgcgtacctgtaatctcagctactcggaggctgaggcaggagaattgcttgaacccaggaagtggaggttgcagtgggccaggatcgtcccactgcactccagcctgggcaacagagtgtgacaatgtctcaaaaaaaagagtctgacttaattcttttatgtttttataacaaagatgttgtttgttccccctgtaacttctttcaaagtttttctttgtcttttaattttctccttgaatatgatacacccaggtgtggatttgggggtatttatgttgcttggcattcctggatatttcctttcatgtataacattaattttgggaaattatcagtcattattgcttcagttatttcttctgtttctttcttgtctttagttagtactattatgtgtatgttccactttttgtaattttctgacagtttttggatcttctgatgtcttgtttctccttttcagtttgacgggttatactgacagttcttcaagatcactcatcatctcttcagacatttccactgtattgatgaacctgtaaggctgttcttcatttctgttgcagtgtattttatgtccttcgttaccttttgattctttgttagaatttctatatatatgcttaaattgtctattttttctttcatattgttcaacatttccatgagaacccttagtatattaatcatatttggtttaaatttctgatctgacaattccaacatctcttctatacctaatctggttctggtgcttgacctctgtcttctaattctgttcttaaaacctttttgtatttcgtataatttttgttgaaaactcgacaagatgtactgggaaaaagaaactgaggtaaataggccttgagtgtgaggttttaggtttatcctactgggttttgtctctgtttactgttttcagtagccgtagatgtcagaggttaaaatttcctttgatgtccttgcttttctctctcctgtcatctttgggcttctctagacacttgttaaataaagtctgaaacatgcagaaagaaacagtgcaatattctttcattgcagtcacctgtttttaaacagaaaccctaatgacaatagtggtaaggtgtaggtggaagggaaacatgttatagtcctatgatttgatctcagtcttttagtgagcctgtgcccgagctgtgatgttttgtgatatgataagaaagatacttagtctttgtgtgtgattcctagcacagagctcctaaatcccttgaatttcacaagtgagaagggtgaaaggatcctccttgtttgcaaagcagcactcttaggagatcctagatgactttaggattaggattggtgaccagaaagacctgcccttgaactttcagccctagcccccagcctcacaagagaaaagaggagctggagattgaattaatcattagtgtgtaatgatttaatcaatcatatctgtgtgttgggaccttcataaatattggggttctgagaacttccatgttggtgaacatattgaggtgctgtgaggatggcacacccagggaatgcatggaaacatcccacctgctctgcataccgaccaatgggcctcttccacttggctgttcctgagttgtatgttttgtaattaaaccggtgatgctaagtatatcactctcctgacttctgagggaggccctagtgaattactgaactataaagggtggtgtgggaactccagatttgtagttggcgtgtagaagcatgggtggcctgggcaccctaccgtgtggcttgcatctgacatgggggcagtcttgtgggactgagtccttaacctgtggagtctgactaattctgggtacttagaattgaattaaattttagggcacagtcgatgtcagagatttggagaatggcgttggaaaagacaccttgtattggtgttgggaagacaaaaaacggttcaccttcacacatgcttctgtgtccctgcccccaggtcacataggctttggtaaaatcatagtaggttgggcttttgttgaaatggaattttttgagaacaggtcttcttaagaagaacattatgttctgggaatattacaaaactgttacttttcctattcatctctcaaattttagagagaaaactttgccttatgaccctcaattctttaatggatccaagaagggtaattgatttgatgtttattttttacttgcacggctgggattgacaatttctacgttccttacttgtgagaccagaaattggaagtctctgacttcatttttttgtgatgtttgatggatgatagctttaaaatctcattattgccaggcatggggactcacacctataatcccagcactttgggaggcggaggcaggcagatcgcttgagcccaggagttcaagcccagcctggccaacatggcaaaaccctgtctctactaaaaacacaaaaattagacgggtgtggtggtgcacatctgtaatcccagctattcaggaggctgaggcacaagaatcgcttgaacctgggaggcgaaggttgcagtgagccgagatcacgctacagcactccaacctgggcaacagcgaaactcggtctcaaaacaaatgaaataaaataaataaaataaaatctcattcctccttttctactatgtaccctacatccagatgtggtaggaagaaagcctgggtcaccctcatttggtgctggtgagacattcaatccacattagcccctgcttgtatgcttgaactcccacactagcccactccctaacctcagtgaaaacccctagccagcctacccgagtcttcccaaagtctcaagtaaacgcgtaataaaccctctcctggtatacaaattttgtagaggtgtaagttgccatacgttcctcctcaggcctgagctctaacttcctagtaatctcctagatccatgaaatgtgagagagagaaaaaggaagaactgagcctgtgataaatattacacaaacaagttgaaattaatacttctgcaaagaaatattttcattcagccagctggatttgagtacttatagtggaacaggaattaaaagaaattttaaaaatgtataagcaaaaactcagttgtatgtaagaaaaaccagttccccctgaggaagagaaagatctgaagtcctttaaaaattgactgcctatttttctgtagctagtgagccttatctctccctttcccaggcattgtgaagactgtttctctagctgtgcagctgcaaggtcactaaacagataatctcaagtcgtaaaacatgttgtcgttccttgaaaagtaagaagtaatgtaatgcgtgttttaattgaataactgtctttgtttctcgcttctgtaatacacttccccctgcacaaatctcctccccaccccacgaaatggttaaaaggtagcttgactctgtttggggctcagttctttggatgttaatccaactgggtgggtgcacctaaataattaaataattcctcctcaacccctcaatctctctgattccttaattactccactgcagtagtggcctggagtccttcaggacatggccagcagctccttgtgacaatttagctttccacaggcctcctggcctctcgtttgttgatgggaataaaagaaaagcctacagttcttgaaggtgtatttatttattaaaaccttatccagattgattccatgcgtaatgaaatgctgagtgatatggtacgtaataaggtaggaaatgagtttttctcacaagggattaatggtcttaaaatttgtttcatttgtatagcatttctcttacttttccagtgtgagcttgagtccacctttagagaacaataaggtttcacatgatcacagtaaaaatttagaagtaattgaccaggcacagtggctcacgcctgtaatcctagcactttgggaggccgaggcgggcaaattgcctgagctcaggagttcgagaccagcctggccaacatggtgaaaccccgtctctactaaaaatacaaaaaattagataggtatggtacacacctgtagtcccagctacttaggaggctggggcacgagaatcatttgagctccagaggcagaggttgcagtgagccaagatcgcaccactgaactccagcctgggcaataaagcaagactctgtctcaaaaaaaaaaaaaaaagaaaaagaaaaaggaaaaagaaaaaaatagaagtaatttctgtgtgttcatgacagcatgaattttatgaggaagtcagtgtggacagtcgtagttctgacagctgagtcatacaccaaatgtttggagaacacagaattgtatgggaacttcttacaaatcaagtatagatccccagtactgccagtcttacccatcctctgtaaacatatgtggaatgtttcaggactcagtctcctttgaggatgtggccgtgaacttcaccctggaggagtgggctttgctggattcttcacagaaaaagctctatgaagatgtgatgcaggagaccttcaaaaacctggtttgtctaggtaaggatatcaacatttctttcctcagttaaatatagaacacagaacaagtgtttcttgctcaacagctgtgttccaagatttgaaatgtggaaagggaatctttcagtgattgaatcagacagtcacagctaatcatgaaactagactgtaacaattttctataatttctaataatttttaatggtctttctgggtatgcattttaggaaaaaagtgggaagaccaggacattgaagatgaccacagaaaccaggggaaaaatcgaaggtgagttgcatccacagaaaaatagtggcccgtgggggaatttcaaaagaaagcaagcaaaacaattaagcacagcttcaaatttatttattcctagaaaactttcactgaaaatgttttcttaaaaacatcatagatgttcaggatgtgaaaaataaatcacttcgaaatagcatttagaaaccccttttataaatattattattttggccaggcacaatagttcatgtaggtaatcccagcagtttgggaggctgaggtaggaggatcacttgaggcctggaattcaagaccagcctgggtaatatagcaagacctcatctggggaaaaaaaaaaaaaaaggcctggcacagtggctcatgcctgtaatcctagcactttgggaggccaaggcaggcagatcatctgaggtcaggagttcaagaccagcctggccaacatggcaaaaccccatctctactaaaaatacaaaaattagccagctgtggtggtgtgctcctataatcccagctacccaggaggctgaggcaggaaaattgctggaacccaggaggcagaagctgcagtgagcctagatcgtgccactgtactccagcctgggcaacagagcaagactccatcttggaaaaaaaaaaaaaattagccaggcatggtggcactctctagtcccacctgctcaggaggctgagatgggaggattggttgagcccaggaattcaaggcttcagtgagctgtgatcatgccactgtactccagcctgggtgagagaatgagactccatctcttatttaaacaacaacaacaaaaaaattgactgttttgatcataactatggttgagtcttcttccagagcattgaatatattaactttaaaacaattcagacagggcagatatcctatactttttctgaaaatggttaaaatgtaattctcatacctactaataaatacaaaataattaaaaagccactaataatgtgctattcattttttacagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatcttat

SEQ ID NO: 452 - DNA, 30336 bp, Homo sapiens
aagtttcacatcatgagcctaatgtaaggcgtgtccgggccgtcccgaaggtatctggggaaataggtttgtgaggacaaagaccagggccaggcccagggcggagcctccgcggccccgacgcagggactcggcctaggcggaggacggggcggagcgcggccggcaccatcgagccgggaagatggcaccgcccacggagctgctggccaggccggagcgaggcagcgcgcccggctcccgcgccatggggcggctggtggctgtgggcttgctggggatcgcgctggcgctcctgggcgagaggcttctggcactcaggtaggtgggactcccgcgcgcccctcctcggcggtccccaggctcggggtggccgcgtggtgcggggagggcgcaggctgggggagggattcctgcgggacctggccctgcggccgggggtggagaatttttgaatgctgtccctcccccagctagttgaacccccatcaccccgactctccgcttctagtgaaaaaactagcaaagtttggagtgaatcgcgacactttcttgaaagtttataagcccttgctgctaacaaagttctcttctgcttaggctgacaagagaatgctttgcaattacccaagggccaaactagtggtttaaattgaaaacaaaatgactactcatgcattgaaaccttaactatgaagatttatttcaggtcattggtgctgtttctccttgttgcccaaaccagacccgtctttaataaagttgttctccacccatttctgcatagtttgagaaactcttcagctgtagatcaaagacacttgaaatattcagctactgttcttacttcctatttattcaccagggaagcctgaagccagaatgccagacagcgcagacactattccatctcgcattttagttttaatgaaaatctctggtaggtagacatcatcgtttataaattaccaactcaacgtttgttttttgtttattttattttttgtagagatggggtcttgctgtattgcccaggctgttccctaactcttgcactcaagcaatcctccagcctaggcctccccacagtgctgggattacaggtgtgagctgttctgccctgcctcaaccaaaattttataggcctcatgcaaaagagttccagaaagactgagcacctgctatgtgtaatgttctctcttaggcttctatagtagagtacgacccttatggagtttgatacaggggaagagagaattaaaatacagtaaatgtataaattaggatgttctaaggacagacacaaatgaaccgcataggcttaaagaggaaagattccatcccctgagggtggagttctagagggaggaagagacattcgacctgaccttgaagggtgggtgcaacacatatgagcatgaaggggcccatgccaaatgtatagtgcagcaggagcaaaggggctaaggtgggaagttggaagactagcaaatgggccaatttgaagggagcataaagtcaggagatgagaatagtagggtggtgggaaggataggttttgaggccattaaatataagttgaaaaatggggccccactttcataggcccaatagtgcttcaaaagggaaatattggtgggttttgcttttcaacaagaacttaatataactagttgtgttttatagagataagcctggaaggggggattggaggagagcaatggttctctgtacattagaatctcctggagggctggtgtctgagtggcaccaccaaagattctgattcagctgttctggatcagaatctacagctcacacctgtaatcccagcactgttggaggcctaagccagaagattgcttgagcccaggagttagtgacaggcctgggcaacatagcaagatcccacctctacaaaatgaataaataaataaataaataaataaaaaacaaaatttgagttggtaatttataaactatggtgtctacctaccagagatttttcgttataattaaaatgtgatatggaataatgtattgtttggcaagctggcttcagggttcccaggtaaatagataaataaggaagtgcataatgtaagaacagtggctgacagtagcagtggcattttttatttttaaaaacattcctgataattctaatgagcagtcaaggtcgagaactactagaatagagagcagacatggggtaactggttaaggtattgcagtaggtcagagaggataacagggacccaaactctggaaccccagggatgagggagaagtcaaaggtgctaccagagtttgtgccacagctccactgtcccatggttgtagtttcatctactgataaagcagtgcaaagaggaagcgtgtggtggctgagatgggagtgagatttgaggaaagaacgcttatgggtaggaaatggacatgttgaccttaattttcatgttaggtaatgcccattgtgctctacagaacattcatgagttggatgactttgtatatgatctgtcctgctctccatttcaaaggcaagaccaccaaaattcacaagcttattatgttgtcactaatgtgtaagccaccagtttttctgcaagttggaagttttctcaacagtcaaatattcccccttctcactaatcttaaggttttaaagttatagctgcaaatctaaaaaaaaaagaaaaagtaaataaaacttattgacagaatgcctgatagtttatttacaggtttttgtttgtttgttttttgtttttctttgttttttattttgacacaaggtcttgctctgccgcccaagccagagtacagtggtacatcaaagctcactgcaatctcaaacacctaggcacaagcagtcctccctcctcagcctcctgagtagctgggactacagatgcatgctaccatgcccagctagtatttttatttcttgcagagacagggtctcactttgttgcccaggctaatctcaaactcccagcctcaagtgatgctcctgcctcagcctcccaaagtggtaggattatacacatgagccaccaccctcggcctactttacaatttgatgcaccttttctttacgtgactgtgatgcactttaatgggcagtgactttataaaatggtaactttattggatatgtggagccccaaatgggctgacgtgagaatgttggggtaggtggtgggtggctggatttagcaaagaaaaatgtaggctacccagttaactttgaatttcacatggatttttttttttttttttagtataagcatgaaatacttataccatacttttagcattaagcgtggaatttgggacataattatactaaaatatcattcattgtttatctcaaattaaaatatcactgggtaccctgtattttatcatatgttcgagtgccttctgtcagaatttggtgaccctttgagtctgttttaaaaaggagcatgtttggccggacacagtggctcacgtctgtaatcccagcactttgggaggctgaggcgggcagatcactagaggtcaggggttcaagaccagcctggccaacatggtgaaaccccgtctctaataaaaatacaaaaattagccaggtgtggtggtgcatccctgtaatcccagctacttgggaggctgagtcaggagaattgcttgaaccccagaggtagaggttgcagtgagccaagattgagccactggactccagcctggacaacagagaaagactccctcaaaaaaaaaagaaaaaaagcatgttcccacctccccataaggaaaggctcttcagaggaagttgaaggaacagaggctttatgtttgatttttgctttaatctgatgcctactgtttgattattcaatatttagagatggtactttggcaatcaagttatttctctccccaggttgcccacttcaatttttagtataaggatgtcccagagggataaatgccatcaaagttgtctttcttcttctgaactgtaactgggattccacaccctccttttccacccctccctagttgagcaataaaggggaaaataacagtatacaaatattcccaggccagttcctggtgtcaaggtacacagccatggatgaatcatgaggcttgagtgcatcagagacctaagcgtgggcaggaacccccagagtacccatgtgaatgttctgcttgctgcctcgcaccttttatgacaattcccacaagaagctatgtggtctgtttctacttctgaaagagcagcctttttcccttttttttttttttaaaccaccatcctttaaatcatttattatgtaactcttgtgtgctggtcagtcagtgtgtcaaaagtgtaaaaacttctttatttatttttttaatctatcttttaaaaaatattttctttctttttttcttttttcttcaaggcaggttcttgctctgtcacccaggctggagtgcagcagcacaatcatagctcattgtaacccagaacacctgggctcaagcaatcctcccacctcagcctcctaagcagtgaggactataggcatgcaccactacacctggctaattaaaaaaacatggccgggcacggtggctcattactataatcccagcactttgggaggctgaggcgggtggatacctgaggtcgggagttcaagaccagcctgaccaacatggtgaaaccccatctctactaaaaatacaaaattagccaggcacggtggcacatgcctgtaatcccagctactcaggaggctgaggcaggagaatcacttgaacccgggaggcggaggttgcagtgagccattgcactccagcctggcaacagagcgagactctgtctcaaaaaaaaaaaaacaaaaaaatttttttgtagagatgggggtcttgctgtgttgcccaggctgatctcaaacttctagccataagtgatcctaccgcatcaacttcccaaagcactgggattatgggtatgagctactgagccctgccaaatttctttatattaaaccaaaacgtacatttactgatatttggaaagaaagctcttttacttttatgccttcatccagtcttcatagatatcttcccttttacattataactgtaaatactgaggttagagaggttaactagttagttcaacagaataatataaatattgaataatataattaatgaataattagtgctgaacctgtcgcctcagccaggtctcctgattccaaatacagtttgccccagctccccacagtcttctagcttctctgccagtggagcaaattttccctaggtttacaggcctaagcacagattcttagttacttagtgcaagtattgccagagcccaaggggtgaattccaaagggtttttacaaggctatacataaaagataaagccctggcttgtatatcacttgcacataggagataaagccccagcagttgtatgtaaatttcaaaagcagagaagtatggcacaaagaaactcctgatagtaacactgtgttcccactttgcttaggggcatattggcaccgtagcatggtacacccttactgctacctgccatgaggccagataatagctagcagcccctggtctcattctactctggatgggtactgctgtttcctgaatgaaagacactgagattgatttcatgctaatgactgttggttaagagttcatgctttctattcacaatagcaaagacttggaaccaacccaaatgtccgtcaatgatagactggattaagaaaacgtggcacatatacaccatggaatactatgcagccataaaaaaggatgagttcatgtcctttgtagggacatggatgaagctggaaaccgtcattcttagcaaactattggaaggacagaaaaccaaacaccacatgttctcacttataggtgggaattgaacaatgagaacacttggatacaggaaggggaacatcacacaccggggcctcttgtggggtagggggaggggggagggatagcattaggagatatacctaatgtaaatgacgagttaatgggtgcagcagaccaacatggcacatgtatacatatgtaacaaacctgcacgttgtgcacatgtaccctagaacttaaagtataaaaaaaaaaaaaagttcatgctttgtggacaggtagcctgagttcattcatagctctactatttacctgaaaccttggactaattatttcacttttctgtgccccagtgttgtaatctgtaggatggggtactgcctgctccacagtgggactatgagaatgcttaaaataatgccaagcgcacagtcagctcaataaatgtcatctatgtagacaatgaaattcaagcataattccttaaacctttgtgccatacatccctttggcagtctggtaaagccttcattccttctcagcatcatgtttttaaatgagtaaaataaaatatataggattacacaggaaaccaattaaatactgctaccaagctatttaaaaatctatgatataatatgctttttaaattaaacccttaaatggatctagaggtaggtaaatgtctaacagcagatattttgaagttgcaatgaatgtaaatggcactttgagctatctacaactgaaatgcgatagaaaagtatctataatttctattagtgacagtcacaaatactactaatagtattgtggtttgttgcttatactcatcatcaaaggaaatactcaatttgagttaaaggtttaaataaagatgtatttttcccccatccaagttcatggatccctgaattctacccatggattccttggtcactggactccataggggtcacttggggaatgattgtgacaccaatgaaggaagccagcggatactgtttgctgtattatacctaccataggctcgtgatgaggaaataataaaataaataactgtaatgaaaaagaaaagaaaggaaaacaaaaggaacctaaaacagagaaggcaaatagctttccttttgagtgtcaattttaacagactccctgtggttgcgaaacaatgtgtctgaggctggctctgggttagagggagagtgctgttattgattagcaattcctgcatgacagcagagtggcaacagccatgcatctctgacctggcacagtcataagcatgttatagacataaagtgttagggaacaaataggctctagcaaaagtaaagagtgttcctcctctcatatcatcacttatatgtgtttataccatttatgttgtattttttacatgaatacttttagatttattaatctaatccaaaaaggtttgtatagctttctctatattaagagaaatatatgtatttcttaaatacacaaagttcttaaatctgatgccagcgaggattgcttccagccacaagtaacatatatcagattaatagtagttcattcaaagagggatttattttcctcacatgaaaaacagctctgtgggtgacccaatatagagcttgttcattgagccagtgattatatcaaggaactgggttcttcatatattttcattctttgatctccccctattgactttatagctgtatctttctcaaggatgcagaatggctgccgcagtctcaaacactgcgtgtgtgttcaaatcatgaagaaaggagattgagtgatgccagctagctctcttctcgtgactctcctttgtatctagaacacagtgtctttccccaaaacctgggtcatatgactacacctcaatacagcggagtctgggaaagcaaatatttgctttgcccaccactacaatagaaacgacaagggagaaagaaagggggttgggcatggcgttaattttgtcagccgctagggtctgccacccagaaaacagaagtccactaacaagcagggaactgattgttctgccagggaaaaagtctggcagtttcctactgaagaaatttggaagtcttgatggtccaggaaggataaaggcaaaaccttcattttcttttatcaaaaaggaaagccaagaaaaaaattagttaagtagaagttatgcacaaccctcatgtaactcttccatgttaatagcaggtaggctgcatatgaaaacatgatattatacaagaaaactagttgatgaagattgccctatttagcaccaattacttacgcaaacctaagttgactctgaaacaggaaccccatattaaacttttcaaacacatcagaatatgttactttgaacagattttatttaatccaaagagattatctttgaaaaaggtagatggtaaacatcgttatccctatttttgtatagtcaaataggcatagtagtaagttgtgtaaaattgacatccaaaccaatgcatgatactaaaacttggtgtacaaacagcagttacatcctattgctttgtatctacatctgtttctggagtcatataacatttgtagaatcttggaggtgttttaggctcatccttattttatccataaagaagactgacacctatagagattaactgacctgccaagggtcatggcagtttcactgctgagacaagaacacagatccctttacttctttctgagaaaagtacaaagtagtttaaagcaaaagcttccctgcttccagcacttctggctaagttgcgccgtgggaaaattgttttgtctgattcagttttctcatcttttaaactggaataatgctacctaatttacagggttgtttgaagaattaaatgaatgcatggaggtaaatcacttagaacagcggtaaattatacttttttattatttatttcctttgaccacccacaattatcatcagtgtcatcctcatcatcacaattaagattactaccacattaggctacataaactttttttttctctctctgttttataatttcaattttattttagattcaaggggtacatgtgcaggttttacatgggtatattgtctgatgctgaggtttggggaacaactgatgccatcacccaggtagtgagtatagtaccctatagtttttcagcccttgtctactcccttcccttccccttctagtagtccccagtgtctaccatcgtcatctttatgtccatgtgcaccattgtttagctcccagttaaagtgagaacatgcagtatttggttttctagcttatttttcctctcttaaatcacttctgtgacacgtaggccatgagatttattgtattttttaatgccttatttaaaaatttgtattatttaatacatttaatgcattattttttattatatttaaatattgatttatttgtactttttgccttattgctatattgtttcaaaaaatttaacattatttgagttacatgatttcaaatacatactgattaacattttaattagaaactttatgtctgatatgaattgccaaaatgtgtagttggtacaacctatgagtcattctgggttatctagaagaaactggtagcctgccccatactccagaagccttccccagtgtctagacctcagaagctgtcaggaatatgcacaggagaaggacacatggcaaatagctatttcgtctcttaaatgtatggtatgtgggaaccactgaaaaatgtaaagtttctacaaggtgctatttttattatttatggctctagagaacagagaaggtgaaaaatgtgagagagaagggaaagccaatagtatgtggccttcaaaacaaaagatcccacagatattgtcccaaactgcttcctggccctctagagtggagagggagggggaagacatcctattagagttcaacattctcttattatttccttcttttaattttctgggtatacaacagcaaatagttttgctgaagtagttacagaactagttggtgttctccaaccttcctattccaatacatactgtcatggatgggtacactaaaatctcagaattcactgctatatcactcatccatgtaaccaaaaaccacatgtacccccaaaagctattgaaataagataaatacattcttatttaaaaaaatactgtcatagggatgctaccttcttttcttttttgttagtaactatttgtgggatgtctttggtgtgtcaggctctgagcaatgccattttctcttggcttctttgcagtctctgtgtgaggcttacagtcatttttcacgtttgactcttcagaaggaagacagggctactggttctacatctggaactcttttcccacaacaccaacactgagaaatgtgacatggtgctgtgtttacatttgcataggaacttgcattataagttttatttgttgagttattggctttttttttttaataacccacatcagtatatagaactttgcaataggcatttttgttttaacttcatttctggtgcagttttattttcctacccttgtctttctattttctctttcatctgctttagacttaaactgtgttttatgtattgctgtaagcctctttaaaccctttctaaaacaaagcagggaatacataaacaaatagttttttgttttttgtttttttttctttgtaacagaaatcgacttaaagcctccagagaagtagaatctgtagaccttccacactgccacctgattaaaggaattggtatgtatatgaaaatgcttgttgggcacattgcattttttggccattaacattaaaacactcattaatggcattttagcatgaaattactgcttttcagtggataaatcacattagatcaacaaaaacctctttggtcaacctcttgatctgatgaaccctgtatttattcttctttcctaccctcactgtaaattattcttttttgtgtgtaattctatgtttagcatttgatttcttgcttgttttgtgacttctctgaactatttttgttgcgtctgtattgtttgtcaggtatggccgctgcagtctgtgttctgtgagccttgtggtcagctagtgaaggaagctttatgtaggcagtgacagcatttaccctgctcactactctataactaggatctgatcttatggctaacacgtaactgaccaatatggtttggttgtgtccccacccgaatctcatcttgaattgtagttcccataatccccacgtgttgtgggagggacccagtgagaggtcattgaatcatgaggtggttaccctgtgctgctgttctcgtgatagtgagtgagttctcatgagatctgatggttttataagggcttttcccccttttgctcggcacttctccttgctgccgccatgtgaagaagggtgtgttttcttccccttccaccaagattgtaagtttcctgaagcctccccaaccacacggaacagtgagtcaattaaacctctttcctttataaattacccggtctcaggtatgtctttattagcagcctgagaacggactgatgtaccggcacttcacaatatgtattgtaaaaacttgtttttattttatcttctaagctatgactgcagagggggagtctccctcttcccttgactttatgtaggatgtattgtggagtctgagtctttgagtaggggttcctaagagcaagccccaattttgctatagataaggagggatctgtccagattcttctccagcactgagggtctctctggtgtgtttgcagtttttctccaaggtagagtctgtgtcttgctgtcttttaccctttatcatctactaagtacatgtccctagtacataatagactagtagttagattatcaatgaacaataaatattggctttccttttttttaaattttaattttttttttttttttttttgagaggtggcctcactttgtcacccaggccagaatgcagtagcgcaatcttggctcactgcagccctgatatcctgggctcaagcgatcctcccgcctcgtcctcccaggtagctgagactacaggcacatgcccccactcatggctagttttttatttttgtagagacagggtcttgttatgttgtccaggctggtcttgaactcctggcctcaagcaatcctcccagcttggtctcccaaagtgctgggattgcaggcatgaggcactgagcccagccaatattggctttccttagatatggttcatggtatgattagaaacaaaaagaattagcagtcaaaacacctagtttctagttctattctgccacaatgtaaccttaggcaaagttggtttttgtatttgtcacctataatgatgagtttgtgattagactaatggtttttagactttaaaaagcctgggaccatttatttataatcttactctgagagccacagtgtggaaataactagactgtcattgagtcacttctagtcctttacaacaacatccttctctagaggtaggagagacaatttaatattttgttttactctttagaaattaaaactcgggttacatggaaatgttctcttctctgaataggtaacattgttaaacaagttttgagtgtccttccatctttttctttttatgaatactcctgtacataatttttaaaaacataagtgaggtcaaattatgcataatatttcaaaactagctttttgtacttaatactaggttttggaaacttatgtttgtacataatgttaccttttcttcacaactgcacagtattttttgtgcaaagttcatataaacagtgtatgtgcaaacaatatagaaagatataaaatggaaagtaaataaaaataaaaatctctcatcaaactcttcatcacccccaacagaaataaccccaaagataaagctcccttttttatctttcctgatagtttcagtgcatttgcaaacaaatatattgactctttttttcacaaatagaattttagtgtaaatatttcacaaccttcttcattcctaaaacagtgtgagcagctttccacatcagcatatatagttactttgttctttttaatattttcacattccatgatttatttaaccattccccttttaatgtacatttgggttgttacagttttttgcaactatgaacaaatcagtgaacatcattgctgttgagtttgtgtgtctgtagaatatgtccttaacaatgggattgttgttcccttagaatatgtgtttagagttttgacagtcattgctaagttgctctcaatttggcaacagtaataaactcagtacctcatagttgtaaccacattcactccagacagagttctcagcactcttttagtaaaaataaaccatcagttgacagtgccaccttcagagtttctctacaaataccttgcttgcctccctttctttttttcttcttttaaatcagcttcctcaggttgatctgcctctcattccttaggcatctgtttcctatgtgttctttctcctttttttcattgatacttttgtatttccccagttctacctcccctcccctagactggttggctgtcctggaatttcccttccttctttcaattgcccaaacactaagtgggaggaggcaaactcatatcaaatagcagattgactacatctgtgctggatcatgcagacagttcaagagtcccaagtaacttagcagcttcatcttgccttccagctgcaatcaagaagagccctctcagaactggtcactcagcaaaagccagatggcattagtaaaagatgttgggcaagggtgggagtttgggccagtgatctcttaggttacttttgctgctgagttaataattgtcacattattaaacagcccttggccctgggaagcccaccttctgtgaatacaagtctcagagtagacaatagggcacaaccagccatgttacatgacagactgccaagtgcattcctcttacaactcactgggatggagcgctcctcagagaaaaacaagcccagcaacatttgtattctgaacaggcatctgtctatgtttgtgacctttatgttgtgatgtgtgtgagctgctgtctggaattggaaagaatgaggaaatatgtcacctatggcccctcttgtgaagtgttaaatgcctctgaggcacttcaaaaggcaacagagcggagaggatgagtgattagaagcacatttgggatacatttttagatctaattagaattgtccttttttttttcttttttgcttttgccctgtggttagcacacaccatatgaacgtttgtcgaatgctatgttagtgatgcataatggttaataataacttttggttatatatctttaacaacagttgcttattcacaggtctttgataagaagaaataacaatgtgctggacacacatttctatacaggcaaaagtgactttttatgatagagagggctgtttcttattttctgttttgaaaacagtagtagctatgcacttgaggccaactaatccctctaagaggtgaaccttccttcccccttgcccttgattcccatcaacacacacatacatatgcacacactaccgtgcttcagtcaccatcactggaagtgaactatgtgcaacttttgggtgctttatatatatcatatcatattgtgtctgctttaataaatcatagttattgactacatatcatacaggatgtgtgccttctgtgggtcagaaaataagttcactatttagtccttttcaaaaattccttcccgatctatcttatagacagaaactaagcttttatacacccaagatttggcagattaacatctgcatattaaaatgtcaagagctagttaactttatttgaggcttaaaagttaaaaaatctgattttctaaatgtctggccttcaaaatttgagtggactgtctttctcaagataactaacaattttatgcacttggcagtcaagacctttacaataactgctgcttgggagattgaggggaaaaaagcattaaagtttgtggcccttataatcaagtactttacagtctactgatgggagaaaaggaaaacaaaacaaaacaaaaaaccactgtgagatatagatatgtcttttctttctctagcagataagtacctgaggctcaaggaggttaagcaacttttgcaaattcactttccaatatagtgtcttttcccagggtgactaatgtatatacttgatgagtgaaccagaaaagtaggaaataatatgttacatatgggatgctctattgggtatagtaaaggatgcgttgctgttataaaattatagtcacttagaaaagagatgtttatttttatttttctctcatcagtcttaaggtaagtgaatggcctagggtagttaggtgactgtgttccatatggtcattcaggggcaaatgctgatgaagcaacacagctgtcttcatctaagactagaactctgcttgttgccatttcccagcaggaaggggttgaaagaaaatttatgtagatttttttttctacccagtagttgcatatatattgtattctcacatcctattgacccaaacttagacatatggccacatctgtcagccagaaagggtgggcaatgttatctatagctgtgttgctacgtgcctattgctaaaaaggctaaaaaggaagaaggggaacatggatgctggtgaacacttggccacctctgacacagataattgctaaagtaataagaagagatggaaattaaatgtgctaagctaggagactttctaaagaaagggtttgtcatgctacgctgtgccattcatgtgtttttttgctcatgctgttccttgtgcctggaaattctccccctaattcccctgagcagtggatgcagtggataccctccccagatcccccccaacttccctgagtgttggctaccaaaagctctgagtgcacccagggagctaagtcctcctgcccacaggcaataatggactgacacggggtagacttaaagaaataagaggcacatcaatcaattgaaatgtgtgggaccttacctggactctgaattaaacaaactgtaattttttaaagctacaccttttaaacatgattggctatttgaacactaactagatatttgatgatattgaggaattattgtgaatttttagtgtagtaatgatattgtggtttgtataaatatatttagggataatatgatgcctcagatttgctttaaaataacacaggatgaggataagtggtaggactgcaagggaaacaagactggccatgagctgataactgttgaaggtgggtactgggtatataagggctcaccacaccattctcttgatttgtgtctatttcccataataaaaagtttaaagagagagaaccgatgaaggggagggagagagtcaagcacacaataagagtgacaaacagtgccaaatcagcccacagtattaagttttcacatatttacataaatatcacctggaatgcaatattgaaattaatgtatatcactagaataaaaaaagtaaagatttaataaatttgttttgaaataaaataagttgaaatacgaaaaagacagaaaaggttttgaaagaggttttaaagaaaagtgcaggatattcattggtaaagatgttggtgagaggcttggaagcaaaacttcaggggaaaaagacaacatatggaattgaccacaattgaatttacaagtgaagtggctttacagaggaatcaggggatgtttctgagagaggaaattcattaaattctaacttgaatattttctgtttgcctttaagtcagagcaaaggctttgagtcccagcttcccagtttgtgaccttgagcaattgcttaacttttccaaagcctccaatagtcttcactctaaaataaaagataatcatatgagatattgtatgcagggtatttacaaggagcctggtacttggtgtacctaatgtatgttagttattattattaaattagaggagcaaaaatttctctagcattgactgctcctgacataatcacaccgaagaggggatacacgatgataaaaccttcctgcagtagtggctatagaaatgatgacggggagaagatctggaaaatattccaaagaaggctacagatagatacattttttccattggaattaggcaatggagttaaacagaagttacaatatggttgaaataaatgtatttttttaaaaaaagatttctctttccttaattattaaaaaatatacaattttgtagaaaattttaaacaaagtataaagaaaaaaataaaaatcattcataatcctatcaaagaagcattgttaattttttctatatatcttctttttccacgtgtatacttggaaattaaattttctaaaataattttcaggaaaaacaaattttaattaattgagcttctactaaataggactgaaaagcaaaacctggactagaattctctctcggtgtgtgtgtgtgtgtgtgtgtgtgtgtgtgtgtgtctgtgtgtacatgtgtatgtgctgtgtatacatgtgtatgtggtgtagcgttcccctgattcttaacttattaccagtggacaaccaccgtggaactagagtctagtcattcttaacctttttgggggaatcacagtctcttttttgaatctgatgaaaatcaaggaccgtttttacagaaacgttctcatctgtgcatacatgagacattttgcattgcatagaatttccgagggttcacagatactttgaagcccaaaagtgatccacagaccccagattgagaactcctccgctatgccatgcttaagcttatttctgtgtatcttctttctgaggagcaggcagatgggtcatctttacaatgtgaagttcttggcatttttattttgttttgtttttctgcactacgatggagcaagcaacactggaggcaactggctaaatgcaaactcatgaagcaagaccaaaatggctggatagatagatgctgtttggttttgacaacctagaaataaccttgaagaaatcctatggagaagtcttaaagaggaagattggattttgtagactcaaagaatgtgtcatggtttggcttaatctaagccatttttattcttcttttcttgtgtttgggtctattatctgtctgtagaatttatacagtgagactgctggggaaagtcttatgtctaattatttgctgtgctgtgtggagtgtactgcagacagtcaataaacaatcaatagtaattgtagcctgcctcagagacaggagttagaaacttcaactggcttaggtgcatggtatttttcattaattttcttctgctagtttttttctctaatttaaagcctaaatttaaagattaaatagaaaagctttctttgcttatgagcacaagtaggcactgtttttaaaagaaggaatatataatcccaggtgttttacctctgttaatgagaaagatgtctgtttgcttcagattgaatgagcaaagaagaggacaaggatatttgcatggttaaatgcctatgagcccttccttcagaaagtaatattcccctgatgtcaattacttttatacggacatctggatgtttatcatgagagtgtacagatgtcaactttttcagtattatagctggaaatgtggtgataacttgactttgatttgagtaaacataaaatatctaacatttaaagtcagaagttcacttcaggaaggggtttaaactgacatttattaaaaagaatggttccttggaaaaaacatcagaaccatccctaaagatacagtcactctgataaagtaaacagagtcccagttatgctctgtgtaacaaataacagaacttgaacatgacatttatctgttccttaaacttacagaagctggctctgaagatattgacatacttcccaatggtctggctttttttagtgtggtgagtgtcttcttccttccccaaattcagcagaggagatacaagggtatttgatgagggctgcagaacagtaagttgcttttaaaattcattttccaaaatgcattctgaagaaaagagaggtcaaacaagatcttggaaaacttcctccagcttttctaaatgtagagatgaagactctttgcccattgagatagtgttctttatttccccattgcattgcactaaaatattccaatgcaatctgtgttttgttttgttttttcttttttaattttttttattttttgagacggagtcttgttctggttgccccggctggagtgcagtggcatgatctcagcttactgcaacctccgcctcccgggttcaagcaattcttttgcctcagcctcccgagtagctgggattacaggcgcccgccaccatgcccggctaatttttgtatttttagtagagatggggtttcgccgtgttggccaggctggtctcaaacacctgacctcaggtgatcgcctgcctcagcctcccaaagtgctggcattacgggagtgagccaccacgcccagcgcaatctgtgttttaaatgtgcactattaagagggatatttgaggtcttactgtggatactcaatactaacattatactattttaaatacagcatctactcatctttctattactattcaacttgaagcaaatattcttgccattattatttattttcaaatattataccaaccttgcccttttgctttctttcttttttcccctgaatagccaatcataagtggaaagtcattgagtttatttacacccttcattttgccttgattcttgtaagctgaaaaacaatatcctttctgggtatacaatagaaagactttaaaaacaattggcttgtgaatattgttgtgaatattgttgaaactagcttgtaacaatgtccattctaattggaaatccagataaggggacagatgaggaggttctgaccacctacctccctggcttgggcagacataggagttcttggcatcttcataggtccagtttttctggaggaagaagtaaccaactctgacacctgactgtaattattccatttcctctcaacatccattattttcaggctctgagactcaagagggatgtgaaatactgggagatacttagaagggagtcaccacactaataaaatagttgttagacttatgagaaaggtgagagaactcaggttggagtagaatgagaattagaacactcttcaggttcctgatggtttttatgtgaaagacagtgagcagctggttattaccactgaggcaataaagagatactgtgggctttagcagaaacaccagtatatgtatttagtttttaaaataaggttttaaaaggaatgttttatttaattgcctacacagaatgaataaagtgatatttatagtaggactctgggtttgtttaggagcacatgcttgcacatgtgtggcttaggaaaaaccactgggaccactagtctaaaatattcataagtaaagatgcaaacattctgaataaagtagaaggcagttgcattgatttttttatttgtttatttgtgttttttgttgttgttttgcaaggatgtgttcttggagatttttataatctagaattcacctatttcaagatttctctccagcccccatagtaataaatctgaagtaggagggatgaggtctccaaacacataaatctacagccattttagcttgggggcatgttatagttacaaagatcttatagccatatcaatagaactttttctgctttttttctgttaccctcctttgctcatttgactttttttaaaatttagaaacattcccagtttgctgctgtttttcatttacttggcattgtctctaataaaacctagagtgtactctcttctaaataaagaggtcctacattgtggaggttgttcattcttcttcctagcattttagctcatctaacccaacctattttacagttatgggttgagggtcacctcaaaactaatgtcacacttcatgaagaattggatgacatagaataaaatataaaaaatgtaaacaatgtgagtgtgcttaacaccactgaactgtacacttaaaaatggtgaaagtgatgaatgttgtatgtattttatcataattaaaaataaatttttaaaaagagaaaaaatacttaaataaataaggagtgcgaacataaccatgactagttatcaccatctgatagtgcttcctttgcatgtaaatcatgcttttgttttggggacattcataaagaatagggattaactgaagtggcactgccatgtaacaatagcataattccagtttgttctacttaccaggcttgccctccatgaaaatatacaattgtagataatcttttttaattggagagatttcctcttatgtccaattttatacataaagtaagacttttttattgtgtgcctaaatttgtgtaaatatgactgcatcgtattagtaaactgaattaggtagtgcattcacataaaatttaacatcaccaagaaggctttaccttaagaatgtaatgatgaatcaccattttagatagactgataggtaatttattaactgatttaaaagagaaaagacctatatcatctcagtgagtaccaaaaagcatttaataaaattcaatactcattcctaaagttccaagcaaactagaaagataaggaaaattcccacaaaactacagcaaacatcattcttgatggtgaagcattggctgcatttgcattaatgctcagaacaggaagaaaatacccaacaccacaaccatcagtaatctactagagttcttagtaattcagtaaaacgagaaaaagaaatgtgagatagaaaagaaaaagacaaaactgtcattagagaagcagggactggctcaattgcccaggctgatgtgcagtagtgcaatcatagctcactgcagcctgaactcctaaactcctgcgctcaagaggtccttccacctcagccttccgagcagctaggactacaagtgctcaccataacactcagctaatttttttttttttttttttttttttttttgtagagacagagtcttgctatgttgcccaggctggtctcaaactgctggcctcaagcagtcctcccacgtcagcctcccaaagtgctggaattataggcatgagccaccaggcctgacctaaagctgtagtaatttaaaaagtgttatattggcacaggaatagacatgagacattaaaataacaaaacagagagtccctaaatagaccaatatgtaaatgtcagagatctagcacatgataaaggtgatattttgaatcagtgggagaaggatggactgtatgccaggcactgttccaggcactgggatctagcagtgaacaaatttccacagtcagtatgtagatgtcacttttctccaccctcagctctccctggaatcacctagtccaccaaccttctgattactctctgaagagaataaatccctgatcttcttttcagttattttcaggctttcagtattccacctccccgttattattttttctgttatcttttctctgttttttgagtttttgtggctttatgccactactttaaccacaatctctatttatccttcatgtacagttcccatgttagtccataaaaatacttaagcttttgtatttaacatttttcaccgttttggaaagggtctaaaattcccaggactccacagctttgcaccagataagcctggaggaatactaatgatggatctaaaagaagaaaaaccaagggcacgggaattaagaatcagtcgtgggtttgatttggcctcattcaatccacatggcatcagcactttcatagacaacggtaagagccaatgggctaccaacatttagtaacgtgtgatggttcacaaatgactgtgaaaaatagatttggatcatatttctaggaagagaagaacaattaactcatgagtgatttctgtattcttcattacaaagaacttgttcatttgcctcttcagctggcagtaagttatgctacattttgaaattcctaacaggtaacacctgaaagaatgtttagatttcataatcttttcatatacctacgatcatcacatttaaaaaagaactgtatttttgaattaaagtagaaacagattatgcatgaattctgtatatggagtaggaaacactttcttaaaggtcagggagccaatgatcagaaataacaccagacggacagcaataggaaagacagagaatgatctgttaggtcgtctaacagcttatacattcaacctttccttgcctgtggtatttaaatgtcagtgcctgcccagaggtcccgtagttatgtcttgtaaattaactctgttctttcaattctttagatgacacagtttatctctttgttgtaaaccacccagaattcaagaatacagtggaaatttttaaatttgaagaagcagaaaattctctgttgcatctgaaaacagtcaaacatgagcttcttccaaggtacttcctcattttgttccttctctaatttatccccagcatttgcaaacaatccctatggtgggttgtcctgtcatcttttataagcgctaatgtatatattagctaatatgtaagagctaaagagcttatatttccttatttataaatgtgtgtgtatagtttccttataaaccagggcaagcatggcatatgaaagttgatgtcactcatactattcactgttctatgcggactcctttgagaaatgatgaagtgcccgactacagggtgatactcttcaggcccatcttgagggtagaaggcaaaccctaacattttttcctgctgtcaccctccatcttagatgactcatcacccagatgagtgtcttgccaaggaagaatggcctgttttttattgggtttgtatgctttgcatgggactttataccaatcgctttcatagggttagtgatggttgcatgctagtaatcccacagaattagagccactcaagttgagagtgagtcattacacttcaagaacataaagctggttgaaaatgtggctaagagagaatcatgtgtacccccacccccagttcagtgtgtattagcctactgcttcttttagtttaaacttgatgaatatttttaatttctaatgaaatttcatttctaatgaaattaaaaatattgcctatctagggcctatctatgcctatctagggcataagcatgtaacttccaatcattccttccaaaaatgcacttgataaaaaaaaataggagcataaataccatccaagcattatggtgctctttcagaaaaatgagacctaccttccctgtagctctatatttttcatttagcaaagaataaagcagctctttcagaaatttttgcatagagtaattggaatttaaatttaataacaccctcacctaactggtcttaaaatgaaattgtttttagcatataaatctctcacctgaagcattgtactatggcaattttatcatccatctctctgcaagtgtttattgagtgcctgttcattctcggcatgtcagctttgtgaagcaggtagaaattgaacagtcaaccttagtttgactaataactaagccagggaaattagaaaaatccaggaactgagtaaatggaagctaggtaaatgttactgactgcctaaccagctcaccagccaatcaggctctctccagctctgtactgtggacagctctgtccttacgtataattgttaaaccctacatttcttgctgtcaaaaaacatgccctgatggcactaagttctttcttctcttatggtaatcctgccataattgctaaatgacctgtgttcagattacctggtaccatacaaaattgttctctggcaacaatattatagtatattgtatatgactatagtcgtgatttttagctcgtcttttcctcttaccaaaaatttaaagcacatgttgcataaatcttatgagtacttaatatttaatatggagaccaacaggccttttgtttcctctcacatgctatttttctttttcagtgtgaatgacatcacagctgttggaccggcacatttctatgccacaaatgaccactacttctctgatcctttcttaaagtatttagaaacatacttgaacttacactgggcaaatgttgtttactacagtccaaatgaagttaaagtggtagcagaaggatttgattcagcaaatgggatcaatatttcacctgatgataagtatggccccttatagaatatcttcatttttcttcagttgtggtgctggccaaattctttactttgctttctttgtcaatgtgaaaatagttttcttgacatttatggtatattatacatataatatatagatacactatatatataattatatatgttttgtatatatatttacatatacttagtcacatgtatttatatgcaaatacaataccatatttaagtaaactatataatacagtaatatatatgtatttatatataatatataaagtttggaatacatcattgtcaaatttaattttataaatataaattttaaagtgtgatcatactgatgcatacatattgaagtatcaggtatttccttttaaataaatgtattatttttattggctatacattattccattataaggatgatcttaaactaatttaaccaattctctattgatggatatgtgtataggggtggggagttctacataaaaaatattttatacttcttatttaccatggaattttaaacaagtattttttttaaagaaaaagtccctaggagagtgttttttttttgttttgttttttggagatggagtctcactccgtcgcccaggctggagtgcaatggcatgatctcagctcacctcaacctccgcctcctgggttcaagtgattctcctgcctcagcctcccaagtagctgggattataggcatgcgccaccatgcttggctaattttgtatttttagtagagatgaggtttctccatgttggtcaggctagtcttgaacctccaacctcaggtgatccgcccacctcagcctcccgaagtgctgggattacaggcatatgccaccacacctggctctaagagagtattataacataatggttaaacttgcagattttggactcatacaggcctgggttcaaatcccacccagggcactggctaaatggttctatgagctacttttctgtagaacagacccctagaaatagaactatttgctcaaacagtgtgattcttttaaatgttaactttaatagatattgccaaattgtcctccagaattatctcattatttttatatgcacaaccacaacctataagagaagatattaaattcttgatagctttcttatctactgcctcagcacactgaaaaatttaaactactacaaatacaacataaaataaatttggcactccttgacaactaaatgcccttatttttgtaatccaatttctcctcctttcttgttgactatagaaaaagaatgtagaatcatttaatttaaattgtctctaactgacctgatccaacctctgcagccaaatctgtttttcactcttatatttccattatgagagtcaaactttccaatcacccaagctaacaaaaaaataacaataatgaaaagggagaatcagcttttactcctctttcaccattcctatccagcctgtaggcaggtcctgttggttctacctgtgcctccttcctctacccccaaactcctttccctttgagtgagacctgcctaatttaggttgtcatcctctctgactagcatatgagactttcttccaatttgttttctgtctacttggatttttttcactcttgccaattttgtctgtctatctctattagccttgaagggctccccaaagagggaactctgtcttcctcacctttgactccttatgccagtacagtgccaggcacaaagcaaatgctcaggaattgtggaacagaactgaccatttgttgccactttattattctaagatttcagtggaatccaattgcttatcaaatcaaggcagggtaaagggttggactttgtttaacaggccacctccaacctcccttttctactatttccatgctttctatgctttagacaaagaactcattgttttaaacattccttcctcttcttgctcctgtgattctgctcttgtgcttgcttctgcctgggaagtgcctcctccgtcctcatctcaaatctcatctctctttacacagccactgcagatgccccttccttggtgagcctttctgtgtcctcggaagttagctatttctagacctgaactatttctcatgcttattaggtgtttaatgtgtacaaaccagtgagatttgttccaacacactataaactttcaaggagagaggctgtgtcttcttcatgtttatatctgctgcaacactgagttcatggcttttcacacataattgctcaacagagcaggtgccatggaaagtcaattcaatgagtaaaattacctcaaaatagtctgttaattcactcacctttgaagtagacagattattctgcattgatacttatctcttactcttaaaattcgctatgtattaataaatattttattgaatattaaggaatgatcactattttaataagatgttctttaccatatatttctatatgtacatgataattagaagtatcaaattatattgtggaatgtaaaagcttttcttctgaagccaagcatttgttttattgtcatttcagtggcaaatatggacttcatattcaaaatgatgttctatattatttttccttacaagctttttgaaaaacaatttaataattccatgattgttgtagcaccactgaattgattctgaaagcttactttttaaataaaaattgacctttatcaagcattccttgagggcccatgattgattaacttcttggcaggttattaagacttattctttcacactgtattaatgaagctttatattggcatggagctctaaccactgtgtcctttctgcaaaggtatatctatgttgctgacatattggctcatgaaattcatgttttggaaaaacacactaatatgaatttaactcagttgaaggtaaaatatttatttttacatatagacagtaatctattatgctttgcaatgacatagtttttctataagagtaccacacgtagaacaaaatatggatgccagtgtagctattctgggtttttaaatactccctacaactagagaaagctcctgtttccagcgatctcaagaactgaccatgattacatgcagcagcaggttgagagtgatattcatcagatttagggcccattccatgaagtattgatggcagtggaagaattccaataagaattttcacaattgaaaatactaatagatgaattctcaaatgaaggtttatgcacagtgtcagttctttcaataatacatgaaggtagaaattgggttccacaccattattattttcttcctactcaacaacacatattttaggttgattaagaatttcctatcttgctttgattgagttccttgagctaactgatcattgtgcatcttttaaaggaaaaggagttcagtttttaagatagatttttacagagaccgattatcaccctaactttcttaatttcagggaagaagaaaagtggctccaaaccagtttttaatacattccttttaagcaatattggtgttagaaggtggaagcagggcgatgtgtaatttcctcacatgcatagaggcaggaaggttacctctaaattatttaatcaagtttctcatgtcatttagattttgacaatttctcatttggaaggtacttgagctggatacactggtggataatttatctattgatccttcctcgggggacatctgggtaggctgtcatcctaatggccagaagctcttcgtgtatgacccgaacaatcctccctcgtcagaggtttttatattttcagttttttaaacttaattattcaagtccttttgaactaataatacaataaattgtcacagggatgatttgtttagttattttaaagcaataatataataagcttatgtcgtggttttgtaattgcgttaagccaataattggcagaatgttacattgttcaaatactttaagaaaggtaatcttttgatgtattaaattatggtggaaactagtcaaaaggcatttttataaagacatgtgcccttcttgggtggtatactggcaatttttaaaatatctgatttattgtcagctcaccacatgatgtgatatttgttcatgttgaagtagtgtgaaagtaggcacattagtatgaaagtatttctattaaagctgaattgctataataacactaaatcctgtgttggcatggaataactagatggttttaagaaagtactttctttgaagattggagaaagtactttaatttaaacattaaaaagattggtaactgctattttcaacagcatgtccccttaatcagtgtgtcattgtggaaaacagggcttattgatgattgagtgacatgcatgtacggtggtcttatattcatactttgtatcccctgaataggttctccgcatccagaacattctatctgagaagcctacagtgactacagtttatgccaacaatgggtctgttctccaaggaagttctgtagcctcagtgtatgatgggaagctgctcataggcactttataccacagagccttgtattgtgaactctaaattgtacttttggcatgaaagtgcgataacttaacaattaattttctatgaattgctaattctgagggaatttaaccagcaacattgacccagaaatgtatggcatgtgtagttaattttattccagtaaggaacggcccttttagttcttagagcacttttaacaaaaaaggaaaatgaacaggttctttaaaatgccaagcaagggacagaaaagaaagctgctttcgaataaagtgaatacattttgcacaaagtaagcctcacctttgccttccaactgccagaacatggattccactgaaatagagtgaattatatttccttaaaatgtgagtgacctcacttctggcactgtgactactatggctgtttagaactactgataacgtattttgatgttttgtacttacatctttgtttaccattaaaaagttggagttatattaaagactaactaaaatccc

SEQ ID NO: 453 - DNA, 8925 bp, Homo sapiens
ggtcagaggccacgcccccggaagcggcggtgcaggtacgaaaagcgcgcgcggggattccaggagtcgtggtgaccagggaggggagccgggccagcgggcggcaggagactaggggagctgagccatgggcttgggggagagcggggccgggagctcgaaggagaccagaagagcagggtcgggggctcgagggagacgaggagagcggggccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagagtgagtgcaaggttttatgagtggaattagccctcagcagatgggggagccagaaggcagttggagtgggaaggtgattttcccctggagtcgggctgctgagcagcctgggctctcctctgaccgcccctgccaaactcatggttccatcagttgatggcctgctggtgcctgttggtgtgctttccacgtcctcttgacgtccagcggcttgtgtctctgcccactataaaaaaccactggggtttttttataggcacaggacggggacgtggcgggctcgggaaatgcaacatttgggcaaaaaaacagaaatgcctgtcctcacccaggtccctgggcacaggcctgggtgtggagccctggccagagaccacgccctcctctacccagcacttccctgcccccttccttatcatctggtcccttttctcagacaccacaacttccaagaaggatcactggtcctgaaccctgtgtcttgtccaggtgtggaccccagaaaagttggtcctggctgggcgcagtggctcacgcctgtaatctcagcactttgggaggctgaggtgggtggatcgcttgagctcaggagttcgtgaccagcctgggcaacgtgacaaaaccccatctctactaaaaatacagaaattagctgggtgtggcggctcatgcctgtggtcccagctatgtgggatgctgaggcaggaggatggcttcagccagggaggcggaggttacagtgaaccgcgatcacgccactctcctccagcctgggcaacagagcaggatcttgtctcaaaataaataaaggaaagttggtcctggccctccagcatttctccagggtccttttttcagcagggacctggcggaggcatcgccctcagagtcctctggacctggacctgcacacctatgggagcaggaaggacccttgtgacttccagtggcccccctgggtgccaggtcccacagtagccacagcaggagcagagtgggtggggtataaactcctatcacaggagggaggactagccgggcctggctgggtggacctgtgtctacagccacacatttcctgggaatctggaagcctgctacagagaggccaggtcccactagactgaaagaagttcctgttaatccaaaggcctgacctgaggaccacaggataaactgcgtggttattttggtgccaatcaggcacggggactgttgttcctcactgtgtgcctataagcagggggttcctgggggtagacgcaggagcaagagcacgctctggaaaggtgatgttgtcctctgcacctgagtactgacttgtggagaaggaaggtagcgccggcctctgctctgcttgatcagccctgctgaccactgggttctgtttctaccccagaaaatcactggttcaatggcagttttccacctgccacaagggaagccacacgtggcagggctggggagttacagcatacccccccgccccccactgcctcccagagcacgtccccttcctcctggcccctggcacgtgcttcctccacgcacgtcatggctgactctgccctctcaccttcctttcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggaggtaaggatggggcaggtctggccatagaaccggctttcccagggcacagggattcgggctgtagggccacacccttggtttcaccactaagagctaagtgacctggagcagggggttaagcgtgagcctcagtgtcttcatctcagaatgaagaacagtccgcagcccttcggactcttgtgaagataaaatgaggaaatgaactcgaaggacttagaacggtgcgcggtgtgcggtgcgtgctgagtgcgtgttagctgttgtggtgcggtggtgctgggggctgcagggcgtatctggaagcctctgtgcagcagcttgaattgaaccctcccagcaccctcactgttgccgaagggctcgtcagtcacttggttcctctgtctgttcagtggagctgatgatcgctttcatctcacactcgctgtgcacaaagcctcactgcatcctcaacacagccagcttcacctaggaaggaactgaagcccagagaggttgagccgtttacccaagatcacacagtcctccagacgcccctcaaccctcacagggtaaatgagatcatctgtgtaaacatcgctgcacagacgttagcccccgttcgtgtttttgttctgagaaaggtaggccagcttgcctggagaggagaactacagagtaaagagggtcctggcacggaggaaagccaggacgctgcagcctagtggctttccaattttttcatcacaacctgcagtaagaaatacgttttgtactctgatagagtgtacacactcaggtgtgcaggtacagctaaagtaagttgcagtagccgcccttattacataaaagggggctctacttttccgattcatttctctttttttctccagaggtgggatctcacccatggcacactcttggctcactgcagcctcaaactcttgggctcaaacgatcctcctgcctcagcctcacgaacagctgggaccacaggcacatgccaccacgctcagttcgttttttaattctttgtagagatggtgtctcattaactcccaggctcaagcgatcctccctcccgggcctcccagagtgctgagattgcaggtgtgggccactggcttgacccttttttttttttcaattgcaatccactaagccgatttcccggggtacatgggtcccaaccctcagtttggagagccctgtgtgtgcttcccctccaaggcttgggaccccagaccgcagccacacggacacgttcgatcagtcactgtggcaggtgccagtgcgacaggctctgtgctgggggccgcagctggggaggaggaccactgggtgtgagtcgggcatacagcgtgtccctgccaggagtgtgtgcagagcgaccacagcacaggaaacaggaaaggtggccccgggggttctctgcccagccctttgtctttgatctgctaagactgcccatcagctcatggatttctgtagcgctgctctgtgtggggcctggggacatgaggaggaacaggtcagtccctgcctctgtggagctctcgtgtcatctggctgccgggttcaggagacctgcagaaggaggtctggtccatacctcgtggccaggggcctccaggagaaaggaagggagaataactgggcaccaggaaaatgctctgagggcctgacgttggctgggagagtgtggaaggagggaggaaggagacatttgcagaagcacagagggctggaggagcgccagctgtgcagagaagtggtgggtgtgagtggagcaggcagcggtgctgaggaggctggatggaggaactccaggtggctggatttccgcttctcgtcctgctggtgacaagcaaagcacaggccccctcggcagccctgctttattttcttctgaactttgtcacggtcgaaggaactttcctcctaccctctgtaaatattacacaaacagagggaccatcactccagaccctcaaagctgaatacagtggtggcttgctgtcagaccagggtttgagggggggaactgaggcacagagccggaagcctgtgacttccatcctcgggtgtaacctggagacgggggtttcaccatgttggccaggctggtcttgaacacctgacctcacgggatccacccgcctcggcttcccaaagtgctgtgattacaggcgtgagccaccgtgcccagccgagaccctgtcttaaagaaagaaagaaaaaaatccttcgttggggagcatctgcaagcatgaggaatgggggacactggagccagacaggctggtgcttaggggtcccagggccccgggaacccagcagcaaacagcctcgccctcaggggatgacgtaccatcagccacaggccaccagcacggccctgggcttcagtacctgcgagtctgaatggatttgctcctggggcaaccccaggcccgtgctgctcaggagcgggaggcagggaggagcgtcggcagcccggtctctggggaggctggttcctgctttatccacgcaatacccagtcctattctatcaggaggaccccaagatgggccctaactcccaggccaagagccggtttaggcaccctccccgcttgcctgcagggggcaggcctgagcgcctaaccccagtccagagggctggactcagaccctcctctgtggggcaggggacaggcacgtagggagtactgaattgtgggggtgtgcagatttgggcttcaggcgcacagtgtgagccgacctttctagacagcatccctggtccccaaagactagcgaggccggggacacaggagcagcgatgggaagcaggcccgccggaacctccgactcccacctccccacgccacggacgctgcaccaccctgtgtttttgtttcatgtatttctcaccctgttccccgtgttccgcctggggaaccgagtgccatggacagagcagacacttgggcagaactgaacagcgtcatcttcgcctgcctggcgctccctgcctgggaaatggagcttcagctctgtctcccggcggattcttgatgcttcctacgctgccatgtgctagggaagattaactaaaatcagtcacaatatcccactgggaggtgacgctttttaagacgagcaacagccggccgccaagaggcgggtgaggccccactgagcacttctattgcatctaactggggagccatttatacccaagtagaagcacacgttcactttgtagctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctacagaaaaacacacacacagaaaaattagccgggcatggtaagaggaggagactgaggtgcccagcggctgcagcccgtgcatccccagggtcccagcacagagtgggtgttcagaagtgtctgctgagggactgagcaagaacccgactgagcacagcaagcaaacgctcagaacgggaggtcagcagcaccgctgtgcccaacacgggtttccaccataacccgaagttggaacgttttattcttccataccaaacaggagttgagaaggcggctgggttccttgaggtgtggaatgtcatgcactcctcctttcttgcgtggaaagcccgaggtataaagtgtgtatgatgtttgcttttttttttttttttttttttaagacagggtctagctcggttgcccaggctggagtgcagtggagtaatcccagctcactgcagcctccaactcctgggctcaagcattcctcccatctcagtctcctgaggagctgggactacaggcgagtgccaccatgcccagctaatttctgtcctttttgtagaaacagggttttgccatattgcccaagctggtctcaaactccggagctcaagcaatcaatcctcccaccttggcctccaaaaatgctgggattacaggcatgagccaccctgcacccaacctgtttgcatttttattttttaactttaagctattaagggttaatgtttgcatttcttaagggaaaaacagaggagaaagagccaaaggaaaaacactgaaatggtagcattcctgggtgatgagtttatggcgttttgtttcctggttgtctataacaaatatgtaatttttaaattagcaacagcgttagactacttcggggaaacctggctctgtgtgccacgaagcagggaagggcttgttcccaggcgcagcagcacttgggcatcccgtggtgaagtcagccccttacacctcctccaggcacagctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggccatccgcccaaaccatctctgagtgccagggaccgggcagcctgcgtccccctccaccccacagtgccagcgtggggcccatgagccgtggtctctgcaccgaggctccagtagcgtacctgcccctgctctgcgcccaccctaaaatgagaaacacggtaatgaggatgaaatataaacgatcgtcaggttcctcacgatcactcagtgaactcctcagagagtcagtgtacgtttgggctggccagacgcagtggctcacccctgtaatcccagcactgtggactgtgggaggccgaggcaggaggatcgttgagcccaggagttcaagaccagtctgggcaacacagtgagaccccatctctacaaaaaaacatggttttgttgttgttgctgttgttgttttgagacgaagtctcgctctgtcgcccaggctggagggcaatggcgcaatctcggctcactgcaagctccacctcccaggttcacaccattctcctgcctcagcctcccaagtagctgggactacaggcgcccgccaccacgcccggctaatttttttgtatttttagtagagacggggtttcaccgtgttagccaggatggtctcgatctcctgacctcgtgatcctcccgcctcggcctcccaaagtgctgggattacaggcgtgagccaccgcgcccggccaaaaaaaacatgttttttaagcatgaagtttgggttgcacctcagtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcggtgg

SEQ ID NO: 454 - DNA, 67133 bp, Homo sapiens
atgttggattgtgcggccgccgccgccgctgcgggagggttgggggaggagttgggagtttagcgcagtcgccggagtgcgaggacaacgaccatccggccctagcctggccgggcgggtgccgggagcttccctttctcagcgcggcgcgaaggtggctcgccgtcagcgcctgcttccctcgacctcgtcctcctccccgctccggaggagctgcgagatgtggcgcctctgactccacttctccccgcccctgtcaccgagagggggaacgagctctcgcccactcgccggaggagacggccctggactcccaaccccgccggcgaaaccatgagctccgtccagcagcagccgccgccgccgcggagggtcaccaacgtggggtccctgttgctcaccccgcaggagaacgagtccctcttcactttcctcggcaagaaatgtgtggtcagtggacgagacccgcgtcgccacccgtgacattacctcacgggcccgggcttgggggccgggaagtgggagtggggaaggaggcgggagcggcgcgggccaggcctcccgccagccccggccccggccccggcccctcgtcggcgccctcgccctgctcccagggtgcgggccgtggcggtcgggcgccgccttcccgagctgctggagaataagggagtgtcacctccgcaggcctgtcctccagcctggccgggcctcggcccgcgcccttgctgctggttaaaactttattctcaggccacaaggggattttcttgcaagagccgcttggtcctagaatctgggcccttgttctagctctcgcttcacctcttactgcttgatctgggggtacgttccttaacaatgccaggtttgaggagtggataggtcggggaaggaaggtggtttttaatctcccattaggattccaggagggaatgaagtcgagtgcaagagcctgggctctcttcggattagagagggtgcaagaaatgttattgctcttcgttaaagagaaacaagatttatttctctagcaaccttgcctaggcctggtttctactctccttcccactgattttttttttccccccattggtgggagggggtgctgctctccccgcagccatgcgcagggaaacctcaatctctggtagctcttggcttttggggccgagaatgattcttagtttggtgctgtgcggccaattccaaccccagatggccggttgggagcgagcagttctgctgtgggaaggggaatgtgtgttgttgacggaagcattcattacattggctgctggcaattctgggggtggggaggttctgctctgtggtgtaggccttgtcgggatcatactgcggtgactgggttgaagtgtggtttgttgaaatactggctggatccctttctctccactttgctagcacctgcagagtatgtgccactggaacccagaaaacacggaaatttcaacaaagcaataccattttataactcctttaagtaatattaggtatgccaaaccagatttcacctgcttctttaagaagttaggattagacaatttctggaaagttattggattcattgttaacttcataggagtccaccctttgtatcttgtgccatccggttggagattgaatcgttccattcaatttcagatgtgtttcatatttcggaatttagaccttagagaacattgagtttcctgattagaaggatgaaacaagaggagtggctcaaaacgagaattttgggtaacaactttaagcccctccccattcacacacacttttttcaacaaatgagaaaactgatccagtgagcccaagtcatacagcaatttaataatgtaaccagaactagaaaaccaggactcctcacacctagtcctatcccattgtactttgcactacatcatgttgttttagaagggtatttttttttcctgttactgatttatttctaaaagtggtgttaaagaaataaccactttgcctttttcaccaaaaactaattaaaatacaagattcttaaagcaccactaatgtttgcatatgctcagtttaggaaaatcttcagcactttgaatgttagttacctccaatgaaaaaaattcagttgctggtttagtagattagctatgtaacctgtatcaaaaaggaagtagttgtgctgtgttctacataccagacacattaactttaggcagaaaggacattacatttatacacaagtatactaattgttctgtgcttacctgtagttttactggtttcgaaaaatggcagatggggaaaaatactgtgatagagaaaaatgatgttgcacattggttagtgtaagtggattgctgaataggctctcagtattcagtgcttaatttctttatgccatcttttattaatcaactgtaccttttgaatttgtcatttaaaaaccacactttcagttgtctgcttttgtgggatgaagtcgttgcaaatactaatttcaatatttgaagtccctagttaatagagagtgaagtaagagtgatattttaatttttgaaataatcttttcctcccttggctgattattcaggttgtttttgtcctttaaaacattactgaaatatattgtctcataataaatccagcagtaagatttacaggtcagaccaaatgtgttaggcagaagtatactcagtactcagagctctacctaagaattcaagaaatgaaacagaagcagttatagtcgaagctctggaggagcttcatttcttctttcattcaacaaacatgtattgaataaatgttgaggtcaaaatctggaagggctgatacttgtcctcagggagcttactaggtctaaaaagggaaacgtgtaaactgataagtcagtgcttcagagtgatgtgtaagaggctgcttttcacagtagaaaatgccttggctttgtaacagcaaatgtgggttcaaactgggggtcactttggacaagtttcttgagcttcctatcctagatttggttttctcatctgtaaaacaaggatactatctcatggggtagttgtgtggattaagactgtgtataaatatatggaaactatttttataaaggtttaggggattaaaggagagaatggtgggagagaggatgattaaaagctttttaaaatggataactgattatttatatttaaacaggtactccctaggctgatgagaggtatgaaacagcttgaaaagttaggagacctactaataagtttgttaggtttgttagggagcaaggagggcttctgcttgggctctcagatttaggtatgaattggaatcattgtggagattatgagaaatgcatatgcctaggcccaattcctagatattactcagaatcactggatctgaggtgaagcttggacatgtctatttttagcaagcttgacagaaaattctaaagtatatcacagtttgaaaaccactgctaaagtccacgttgtctgataggataatccttgagcacattggaaatcttaatagatttttcttcaatttttggtctatattttgcaaattgaagctaaattaagttaaaccaaattcttttagtacagcatttctctcaccgctgaagataccagtgtacatttcacaactaagaaggagatacagttggggaagtattgcactatttaatggggactcacaagatcatatttgacttagaaaattttcaggggaaaggtggaggcagtatagaaggtggattgaggattgtgagggaaagacaagggaaatcagatagttgatttatagtattgcaggtgaaatatgatgagggcctgaattaagagagtactttgggaattcaagaacaattaaagtctccagcagaaattagtcccagttatatatagaaggtgagggaagggagtttcaataaaggcaggcattataaccaccagcagaaaaagtacacagaaacatatttttattctcattcgctgcaaatatgcctaaatgttaatgagactctggattggtgattggcttcatggaggaggcagatcatcagtaaatcttttgttttaccacagtttctaaaaattcattttgtggaaattgagatttcattgtaatacataaatacatgatatgtacttttacataaatagttctgatgccattcattagctggtagtattatgaagggagaatgagaaggttataaacaagattactaggtcttattttgtagttagatctgttgcctttcatgtagtgtgattcagttaattttatataaagagtatgtgcagttttgctaagtgaagttcaacatatatagtcctgaataagtgagaaactaaggaataggaaaaaataaaacattaaactacgtctctacagccatatctggtttatatggattggggctgataatgttattgagcattatctttccctgccatactcacctggtttgttttttcaagatttagtgatacttaagccatttttattaatcaaccttaatctttatttcctttaactcctcagcacttgttttaacttgcttattttctttagttttttgtttcctcactatatataattcttggagatagactttatgcctaggtagtcttctataatttttgtaacttctggctcccagatcagtgaatacttattgattgattgaataattataattactcgtttattttttaggagctcattctgcgtttcttattgcttgattaggttgttaagcccttcagtttctaatgcacatggtatctggactttagtcttcatttattaagcgaccgaaatggtttagttgtgctgctgaactaatataggtggtaacagttgtctaacagtagtttgtttgtgttctaaatcagacctgttgggtagggattcttacataggcatacagggaaggatatgcttagagggatcattgtattgatgatggcctgagtaaggcactgttggtggaaagtttagaccgggaatgtatttcaccttgagtagtaaggaaagataaaagttaaaattcactggatttggaatatacaaagatgagaagatacctttgtctagtatagaggaaaaagatgagcacaaaaatgtatgtgacgcagcgtagctgtaagcacaagaagagattcagaaaagtccaacagggttgggttatgaattttacttctggttattcttagctctatatatataatacagggacatttcttaactagtctcagccttcatgtctagatttgtaaaatgggcttagtcaaggatttcaaagagtaattcaatcattatggaaaatacttagagtccatgacacaaagtattctgggagtttggaggagcatatgaaagaaagttgttatgaatactattcagtgctcagtttagatttcctgttactggcagggaggatttagagtaaaattttcagctctatattgtatttgttttgacttaggtaaattaacaattttaaagtcagttaattataggtgtgtaaattaaaagttaaggagcagcttgaatgtatctctttggggagtgtctgggcagcctgagcctccctggctgctaattgaagaggaagaaaggggtcctgatgaaaaagttaggagttcctgaattttagtccatgctctgctaccatacattgtgaatatgaacaggaattttttttttttttttttttgagacagagtcttgctttgtcgccaaggcgggagtgcagtggcacgatctcggctcactgcaacctcggcctcccaggttcaagttattctcctccctcagcctcccaagtagctggaactacaggcgtgtgccactacccctggctaatttttgtatttttagtacagacagggtttcaccatgctggccaggctggtctcgaactcctgacctcaggtgatctgtccgcttcaacctcccaaagtgctgggattacaggtgtgagccactgtgcctggccatttctcccttcctgaacttcacttttctaatttgaaaatgaagggtcagacaagataactccacagtctttccagctttaatgcttaatcagtttaactattctagattccagggactctagcagggaaagaacaggcctaatgttaactctagcatatatgtgttttgcacagccgagactaatatagcatatatctaagcagaaggtagataatcctgaattatttcattgaaaattcccatttttaattcacctttttctaagcattgtaatttaataggcatttcacttttaaaacagcagagtgaacagaataaaaaagcattagtagtagaattaccaactcttagctaacttagaattattatttgtaattataatgtatttttgggttattagaaactgcttttttggttaagatggaattatttttaagaatttctcttttgttaaccaattccatctagaatcctaattctggatgaaattgtattagtgatatgataggtgttacatgttactgcttattttccaatattaaaaaaatcggtttttagtttcagtggtagacttaatagttatagtgaattgacttggttactttagagactgattcaagattgaggttactgtggggattcatttgtgtgattaaaataatcttggttttcttaaatttttttgtaatgcactggacaacatgctgaaattatggcttattatattagtgaattttgtattcctgaaacagcataccaagagacactagaacctttgacagaacttttctgaaacccaaatgaatgccaaaattaggcatgcttttaagatgcaaagggctgggttttatcttttactgtctttcttgcttattcaacttctgttcttgctgtgctctggatattagaaagcacagctcttgaggaaaagatgtgactgggccttttgaacagtgtctctttcaccaagttctgccagtcactctttggccatctctctgttgtggacagttgtagggattttatttaaaatatactatttttttaaaaagttatcttttaatgtaaaaattgtatctatgagtaatatcagattataaagtctggaaataaagtcttgattagagagcaggtttgattaggacattcaggattcctcataacatatagaattggagctacttaagcgttggccaaagtacagaggagccgggttctatttgttttgctgctgagcaattcctaccatgtgtatcagtattctagtcttctatagtaagatttttaaaaagtctttataaaaactggtaagagcaaaactttcctaaggaaatgcatgcttgtagtaatctcatgtatttcacttttgtccatattctatagattttttaaataaataatattaatggaagtataatggtagcccattctagttttgagtagaaaaacagattttaaaagagcagataagggttgaactttgttataatttattctgtctagaagtcatagctttcctaatagagttcactcttactctaaaggttctagaaacaaaagtttatacattcatagtcacagtaataggatatacattgttaactataaatataattcttataggtcacctagcatcgttgatggattcttggaaactgtgactttaggtgaaacaacacataatgaaaccagttttaccatagggtaattgatataaacaagagctaagtttctgtagcatatatcaccaaacttctaaataaagacaaaaacacttctaatattaattaatgaaataaatgtgagctgtaacacatttaagaaagagtaataaaaacaagataattatttacccagttacttcacttcagtctcaggtggctggagcctatcctggcagctcagggtacaaggcaagaaccaaccctggacaggacatcatcccatcgcagggtgcactcatacctacacccacaactcactcgcacacttgctcatcctgggataatgtagacagaccagtgaacctaacatgcacatttttgggatgtgggaggaaatccaagtacccagagaacccaatagacatggggagtacctgcaaactccacacagacagtgaccccagcttgaaaatgattttcttttctcatcaaagttaataatgggctggacgtggtggttcacacctttaatcgcagcgctttgggaggctgaggcaggaagatcacttgaggccagtagtttgccaccagcgtgggcaacatagacctaatctctacaagaaaaagtagctggtagtggtggcccatgtctgtagtcccagttactccagaggctgaggcaggaggttcacttgagcccaggaattcaaggatgcagtaagccatgatgagggcattgcactccagcctgggcaacataggaagacctggtctcttaaaaacaaaaaaaaaagttatgatgaaaggacattgaacaaaatgatgttgaacaaaaggatgttatttgaggacctgctgtattaagtatttagtaattaggagacatttggcatgcttaaccatattcataaatatagtgtaatacaaaataaatcttatttattgcatctatgttagtagtctcagaagtattcgagagttatactgatataatagcatataggagagtaaaactaattagaaaacattattttctcataggagttaatgcactgtagaggaattgtaaccctttttttaaagagaccaaataattgactgtaatgttgaagaggtaaatacagaaaagcccctcaagaaaatgtgatcaaatgaaagatatatatataaaagataatatatgagatatatctgacatatgtatgagatatatatgtcttatcaatcaactcctttactaatacataaactgatgcataaactagctagaaactgaaatgatttttattagtgaaacgtagtcaagtcttgaggacttactaagcacataacaccctcccagtatcttggaatatgagggagcagtaaggaaaatccaggttttacccctcagttattcactgtatagctgaagaagacaaaaattatgcacaaaaagatatatgctgcaaaccagcatatatatatatatatacacacacacacacacacacacacacacacacacacacatatataaatgtataaaagatttgaataatagagaggagagataggtatatcattgtgggacttgaatatgaaaaaccttaaatagcctagagaattgatgtcagaaacaagcagcttatcaggtacagatgctcttctacttatgatggattatgtcctgataaacctgtcgtaagttgaaaatgttgtagtcaaaaatgcatttaacacacctaacccaccaaacattatagcttagcctagccttccttaaatgtgctcagaacatttacaataacctacagttgggcaacctgatgtaacacaaagcccattttataataaagtgttgaatattttacataatttgttgaatactgtactgaaagtacaaaactaaatggttgcatgggtactcaaagtatggtttctactgaatgcatattgctttcgcaccattgtaaagctgaaaaattgtaagtggaaccatcattagttggggagtgtttatatcaggaaatgtgtaaacaaaagtttgggatagaaaatgtgtatagaattttaggaggcattgaggagactggttggctagaattgagaatgacatttgcttgggcagatagtggatggtaagtttgaagagtaaattgaggctagattttggaagacctttgaacttcaagtcttaaggattgaactttattccctagaaagtaaggaaacactaagatttcttcaagaaatttcaagataggaaggatctggagaaagaaaattggaaattattattcataatagaaataaggattgagtaatactttattgtttactaaatttcttatttattagttcagcacatcagatctgactaagaaacctggaattgtggcagcttctagagcaagcttgtccaacctgcggcccaggatggctttgaaggtggcccaatccaaattcataaactttcttaaaacagtttgagattttgggttttttttttgcagttttttgtttttgttttgctcatcacctatcattggtgttaccgtattttgtgtgtgactcaagacaattcttcttcttccaatgtggcccagggaaaccaaaagattggacacccctgatgtatagcaaaaaaaaggactaagtccttgatgtatgtgtccatggcagacaccaacaatcacagcattttttcctactgagttcagacatggtttctaactacctgttgtattcctagaggcaaccactaccaattgtccaggttcacgatagatgaaatctagttgtcattccaaggctagataccagaaacgtgaagaaaaaattggcaatatttaattggcttgtgaattctggatgacaacaaaacctcatactataaatggctagatagtaggaactagaactttggactctagtgttgattattgcggctgtgggagtgggattagatctgtgaaggtgtcaagctcaagattacagagggaacagtctagctaatgttttacttggccagcagcattggaagaggatggctttggccaagtgctaaagtgctattctctttaatttgctagaaacatggtatacatattgttctgcaacttaactttttcacttttattaatatatataaatatatatttccatgtttatatctgttgcatcctttttattaatatattactgccttatatcaagttatatttatgtgtaattaacctctattaatgggtgtaatagttttccctgtagacagtctcacactggtgaaaacatcttattgttcaattcatagtttttggtgaaattgaatatcttttcatatcagttgaccatttatatttcttctgtgaattgcctcttcttgtccttagaccaattttctattggattatttgtttttgtcttagtgacttggaggagcactttatatgttaaagataataattctatactgtagtattttttgtggtttgtcatttatcttttgacaagtacttggttttggtcattgtacaggtttaacattttttgtagttaagtggaataatctttctattatcatatcaagttccctagctcagaattgcaaaaatatttgctcacatttttctggtatttttatggttttattttgaacatttaaatctttaatctttctggaagtgaatttggaaaaggaatgtaatagaaatccagctttttatttttataaatggctagttgtcccaacaccatttattgagcaatttattttctcccatatgaaatgctttttttttttttttttttgggagacggagtcttgctctgtcacccagactggagtacagtggcgctatctctgctcactgcaagctccacctcccaggtcaagagattctcctgcctcagcctcctgagtagctggaactacaggcatgcaccaccacgcccagctaacttttgtatttttagtagagatggggtttcaccttgttggccaggatggtcttgatctcttgacctcgttatctgcccaccttagcctcccagagtgctgggattacaggcgtgagccaccgcgcctgtctgaaatgctgcttttataatttactaaattacaaggagtacgtagaccaagcttttccaacccgtggcccatgggctgcatgtggcccaggacggttttgaatacagcccaaaacaaattcataaacagtcttaaaacatgatatttttttttgcaattttttaaaagttcatcagctattgttagggttaatgtattttatgtgtggcccaaaacaattcttctttgaatgtggcccagggaagccaaaagattagacagccctaagtcttagacttatttttgaagtttcttctatttctttcatttgtttatttcttggccagtacactggattttaattagtgtagcttcataatgatgatacagtttgataagagtaagtctctcattactcttcaatattttctggctattttaatatgcatgtgcttagtgtttttttctaaggctttatcctttaccaaaaaacatttggcttgatttggagtagcattggatttgtagattaattttggaagattgacatattgaggcttcccattggaaagcaagaatttttatttattatttgtcttgttttcttctgcacttttatacttttcttatatatacattacccatttctttaacattttttttgaagtgcaaaataatacccaggtattacataatgtaatgtatcacataatggtgtttcagtcagtgatggaccacatatgtgataaggccccataagattataatggagcagaaaaatccctatcacccagtgacgtagccctaccgactattatgctgtattgttgccatgtattttacttctacaaatgttataaattccatgatgcatttttatagcttttgctgtaaagattcagttatcttttagagacatttaaatagtaagggaaaaaaaccttatatttattcacttggttatcatttctggtacccttaattcatctgtctaaatctaggtatttctctggtatcattttcttgcagtgagaaggagaagtatttttttctttccttcttttaaaatgtttcttgtaatgcaggtcttctacttataaattctttcaggttgatataacttaaaagtctgtattttatcccagttcttgaaagaaattttctctgggtataaaattataagttgataggtttttctttctgttctttaaagatactgctccagtatcttctggtttgcattatttctgacaggaaatctgctgttgtttttttctttaattttctgtacataatgtatctttttttctctgactgcttttctgatttttcgctttattactagtttgaagggatctgattatgatgtgcctttgtgcagttttcttattctttatcttgctgggttttaactaagtttacatcaagtttggaaacttcagacatgattttttcaagtatctacttctctttccctggccctgcgtttcagatatattagactgcttgaagttgtcccatacctcactgctgtatagcattttttcctccctgtcctcctcgtcttcctcctcctccttgctttttccttttctgtgtttctttcggatagcagttgttgctatgcctttaaattcacaaatattttgtctacaatatctaatctgccataaaaaccgtccactgtatttttcatttcagacattgtagttttcatttctagaagtttgatttgcgtgttttttaaatatatgtccagtctttgctctagctacattttgaaatatatggactacagatataacaattgttctaatgtcctgtctgctagctacattttaaaatatatggactacagatataacaactgttctaatgtcctgtctcctatcatctgagtcagtttctgttttattcctattttcactatgggtcttttcctgtttttttttttttcctgcatttttggcaacttttgattgaatgccagattttgtaaaatttaccttgactcttttaataagtcttgaatttttgatggtaagaagctattttttttccatgaagtcatttgtataattgctaattgatctgttttaatagcaacctgctcttttgtgtgctctttacaataatacttaagtaaatatttctgaagatacagatagttttttttaattcccattgaatttttttttttttttttggtcagacacttgcactgtgtattcattgtagtcactctactctttgctgctggttttcctcagctgtcttattattcttggttgtttgtttatatttatatttgaaggactgcttgctcaatataggtagctggcatgcatttttttaaaaaatgaaatcttattttttagagcagttttacatttacaggaaaattgtgcagaaagtgcaaagggttgccatatactctgtctccttccctactcttcagtttctcctattaataatattttgtattaggtaaatttgttacaattgatgatccagtattgatacattattattaactaaagttcatagttgacgttagatttaagtctttgtattgtacagatcattgggttttggtttcacaagtacataacatcatgtccaccgttacagtgtcataccagaatagtttaactgccctacagataccctgcactgcagttattcctcccgcccctccctgctgaaatcctatcactcactgatttttttttttttttttttttttacattttctatagtgttgccttttccagcatgtcatatagttggaatcatacagtatgtagcctttatagactggctccctgtttctgttgcaccacattcacaccagcatttagttttaccagtgttttggatttttagttattttaatagttttgctatcatatctcattgcttttgcaattccctaatgccatatgatgttgaccatcttttcatatgactatttgccatttgtatatcttctttggtgagacgtccaggtcctttgtcagattttttattgggtgtgtttatgtcttattgatgagctttaagagttccttatctatttcagaatcaattcctgtatcagctgtgtgtttcacatgtatttttatctgagtctgtggcttgccttttctttcttttatcagtgtctttcacagaaagaagtttttaattttaatgaagtccatccagttcatcagctttttctttcatggattgatcatgtttttggtattgtatctaaaaagtcatcaccgacccccaggtcacccaggttttgttttatgttctcttctagaactcttacagttttgcaattgacatttagatctctcatccgttttgagttaatttctgtgtaagtcataaggtcagtgcctggatttgatttttttttttttttttttttggcacgtggatgtctagctttttaccacttgttgagaagattattatcagttctttattggattgcctttgctcctttgtcaaagatcatttgactgcatttgtatgggtctacttctgggccaccagtctattttgtctatttgtgtttgctctcaacaaggccacactgcctgattactgcagctttatagtaagtcttgaagacaggtagtgtcagtcctctgatgttactcttactcttcagcattgtgttgactattctgagtctttttcctttccatatctttccgttttttgatatccacaaaataactaggattttgactgggattctattgaatctatagatccatttgtggaaattgacatttgagcagtatttttttcctatgtgaacctgaaatacctcttgtttaggtcatctttgatttctttcatcaaaattttgtagtcatatagatcttatttattagatttatacagagattttttttggtactaatataggtggtgctgtgtttttaatttcaggtgttaattggtcattcctggtacacaggaaagcagttgactttgcatattaaccttgtatgctacaaccttgcttgatataaaggcttattggtttccagaaattttttgtttctttgattctttaggattttctacattggtaattatgtcatctgcaaacaaagacagttttattttttccttctcaatctgtataccgtttattgtgttacattagctagaacttctagaaggatatggaataggagtggtgagaggaaacatttttactttgttcccagtattaggggaggaacagtctactttttctccagtaagtatggggttagctgcaggttattgatggaaatgctttatcaagttgaggacgttccctgctatttttgagatttttttttattatgaatgagtatgcttttactgtatctgttcatatgatcatttggtttttctttagcctattgatatgataggttatattagttgacttttgagtgttgagccaaccttgcatacctagaataaatttcacttggttttgatgtttaattcttatatattgttgggttcaatttgctaatatgttgttgattttttttccatctttgttcatgagagatagtggtttgcaattttccttttttgttagatctttatctggtgttggtattagcttaatgctggctttacaaaatagttacgaagtagtccttctgcttctatttctggaagagatttctatcatgtattcctcatatgtttaggataattcaccagtgaaaccatctgctatggtgttttttgctttggaaggttattaataattaatccaatttttaaatggtcataggcctattcagattgtctagtttttgtgtaaattttgatagatcgtgtctttccaggaattggcccatttaatctagattactaaaatttgtaggcatagagtttttcaaaatattccttgttagtcttttaatgtctggaagatcaatagtgatagacctcttctttttttatttttattttttattttttatttttcgagacagagtctcgctctatcacccaggctggagtgcagtggcgcagtctcggctcactgcaagctccgcctcccgggttcacgccattctcctgcctcagccttctgagtagccgggactacaggcgtccgccaccacacccggctaatttttttttgtatttttagtagagacggggtttcaccatgttagccaggatggtcttgatctcctgatctcgtgatctgcctgccttggcctcccaaagtgctgggattacaggtgtgagccaccgcgcctggccgccttttctgtttttatgttagtaatttgtgtcttttctctttttttcttggttaagctggttagaagcttgtcagttttattgactttcatttctctgttgatttcctattttcagttgcattgatttctgctataattctttttttcttttcatctgctaactttgggtttaatttgatcttccttttctagtttcgtaagttagatacttaggttattgattttaaatcctttttcttttctagcacatttctgcttttcctgcattgtactcattttcatgagttacattttcatcttcatttagtttagaatattttaaaatttctcttgagactcctttgactcatgaattatttagaagtatgtttagaaatatttacgaattttcctgtctgttactgatttatagtttcattccattatggtctgagagcatactttgtgtgatttctattcttttaaatttgttaaggtgtgttttatggcccaaaatgtggtctctcttggtgatcgttccatatgtgtttgagaagaatgtgtattgtactgttgttagatgctgcattctataaatgtcaactagatccagttgattggtgctgtgcagttcagttctatccttcctgattttttgcccacttgtcaatcactgatagaggagtgttgaagtctctaagtaaaatagaggatctatctatatttgtccttgtagttatgtgggcttttgcctcatgtattttgacctgtattgttagctgcatacatattacagattgttatgtctttttgtataattgacccttttatcattatgtagtgtccctttttatccttggtatatatgtgtgcatatatatatgtatgtatgtatatatgtgtgtgtatacatacttactctgaagcatactttgcctgaaattaatatagctgctccagctttctttcagttagtgttatcagggtctgtctttctctatccctttgcttttaatttatctgtgtgtttttatatttaaaatgggtgtcttcattgagtacacatggacacaagacaacaacagacacccaggcctacttgagggtggggggtaggagaaggatgaagatttaaaaactaccagtgggatactatgctgattacctgggcgacaattacctgtacaccaaacccctgtgacatgcaatttacccgtataacaaacctgcacatgtactccctgaacctaaaataaaaattggaaataaataaaataggtttcttgtagactatatagagtcgggttgttattttttaacccattctgacagtcttcttttaattggtgtatttagaccattcacatacgattattggcagttggattaatatcaactgtaactgtttttgttgtccttagtcttttctttttctcccattctttggttttaattgagcattttatgtgattccattgtctctctttttctaacagcagttatacttatgtttacaattttttaagtggttgccctgtagtttgcaatatgtatgtacaactaatctcaatctagtatcgaattatactctagtgctttgtgaatagtggagtactttagaacacaatattcccattttcttcctcccatccctccccactgtcattaattttatttatctaaaagctataataactgaatacattgtgtctactgttattttaatcaaactattttctatgagatcaattaaaaagaaaaaaattattcaccatttattcgttctctaacaatattttttctgtatgtatgtgtattcaagtttctgacctctatcattttctctaaagaactttaaacattttttgctaggcgtatcagtaacaaatttcttcaattttcagttgaaaaattatttctctttcgaaaatgtttgaaggataattttgctggatacagaatgttaggttgttgtatttttttctttcaacactttaaatatttcactcaactctttcactatactctctccttgtttgcatgatttctgaagagaagtccaatataattcttaacttttttcttccactggagagaaaattcctccaataggaatttttaggtttattgaaggcacacagaatgaattcttaattttttgagccttgtttcatgctcctaattattatttttttcctatttttgagaaagacctaagaaagtttgagaagcttttaactttatttgattaaacatacaccggattatcacaatctcatattaagggagctcaaagtaatgctcatagaatagtcgtaactattgaatttaactgtcagaaattcactgttagaaaatctggaaattagaaattggcttcatgtgtacacccacatacgtatctgtaggaagacttattttagtgctacattgtagattgatttttatgttgttgtatctctttattccataactttacatcaacctgttcatttccaaaaacaagaatcttccatggaatgctaggaacagtttggagtaatctaaaacattatgtaatacacagctgcgagactttgaaaaaagctctgatagcagtcaggtgacttacttaaaaaatactgtgtcttactcattaaaaatatagtgctgattattaaagacttagtccttcactgtccagtatggtacttggtagccattagccacatgagctattgagcaattgaaatgtaattaattcaaattgagatgttgagtaagtgtgaaatacacactggatttctaagacttagtgcaaaaaaaaatgtaaactatttcatttaatattgattacatgttgaaatggtagaattttaatatattcagtatataaaatttattgaaattaatttcacttttgatttacaagttggctacaaaataattgaaattggttattggcttgcattatatttccaacagatactgtagacataggcagttcacagagtaataatgacgacagtgcaaatcatctataaaccttaccacccagaaataacacttattaacatttttgtccaaatcctcctaggttttgtcttacatgaattattgaagaagtacacatgtatgtacttactctcagcaaacacacacccacaggcacagacattaatggtttgtttttttgttcgttcgtttgttttgttttgttttttgagacagagtctccagacgactaacagcagttatgtataatggagttgcccaggctggagtgcagtggtacgagttcagctcactgcaaactccgccacccacgttcaagcgattctcctgcctcagcctcccaagtagctgggattacaggtgctcaccactaccatatttttttgtatttttagtagagatggggcttcactgtgttggacaggctggtcttgaactcctgacctcgtgatctgcctgcctcggcctcccaaagtgctgggatcacaggtgtgagccgctgcgcccggctgacattaatgttttattggaccttgtttcttgtcagtagatatataccattatcagtggacacatttatggaatcagcaatttcctagagatggacagttgttgggttgttgttttccctttctacctttttactccctaatatagcaggccacacacacatgctcttcatctgtcttcaccagacttgatctattcttttatgacaatttctaagaaataagtttgctcagttttaaatttaatttttgccttgccaaattgcattttccaataatctgtaccttttataatgacagtctagtgttttctttgtagttcttgaaagtgcccagtccccaggtaatgttaaacaaatgtgagtttttttatttttttgtatttcattctgtaaaatgctctgaattttaaaatgtgatctttctgaatgctgtccatgctttttgtaagagtcttagagacatctcactttgaaaatgaaagtggatgcctgagatgatgaatacagcagtatattttacaattaagctttcttgtctcccttgtaaagtgaggtacatttcttttcaaataaagcaagtaaggttacattaatgtttattgtttataagagctttctttccaatttatctagctaccatgaaatgaagtgcgtcaaacataagaagtcgttagtgtttttggtggtttgcattaacgcttcatcttaagattctttttttcacttaagaaattacggtataatttatgtataataaaatacacagatcttaaatattaactttgatgaattttgacaaatgatacagagtatgaccatacccccaaaataaagtttagaatgtttgtaatacctcaaaaagttccattgggagtctaaccagttggttcctttctaattcctgcctctctcctatcttcgtccaccctttgcaatcactttctgatttctgtcatgatggcttagttttgtctgttttgtcctcttcactcagtatatacgtttttgagattcatctctgttattgtacacatgttcattctttttttattagtcaactggtcagtgtttaccatgaatttaccacaatttgtttgtctgttcttctgttaatggatatttgagtttcccgtttttgactattatgaataaggctcctgtgttcttgtataagtttgtgtgtgtgtgtgtgtgtgtgtgtgtgtgacacatatttttatttcttttgggcaaatagctcaggaattacattgtcactggaaagatgtatgtttatttttataagaaactttcagatagttctccaagtggttgtgcaatctttgcacttccaccagctatgtatgagacttcccattgctccacatctccagtattttatgtggtcagtccttttgtttttggtcattttggtggatatgaaatggcatctcagtgtggcttttcattatatttccttgatgactaatggtattctttcaccctttcagtgcttattggccattcatgtatctttgttttttgtgtagcacttcaggtcttttgcccatagatttagtgggttgattgctctttattaatgatttgtagggatgttatatatattctggacacaagattattgttagagatacgtacttcagatattttctcccagtctgtagcttgcctaattattattattattattatttgagatgaagtctcactctgtcgcccaggctggagtgcagtggtgcattcttggctcactgcaacctctgcctcatgggttcaagtgattctcttgcttcaacctcctgagcagctgggattacaggtgcgtgccaacacactcagctaatttatctattttgattagagatgagagtttcaccatgttggccaggctggtcttgaactcctgacctcaagtaatccacccgccttggcctcccaaagtactgggattacaggcagccaccacacctggccctaattaatttttaatgatgttttttgatgggcaggattttttagttttggtgaggctaatgtatcttttttttttctttaaccttttctagcacatgtatttgtggtttgagaaatcttggcctatgccaaggggtcacagtcacagtcttctgctgcttctaggagctttgtgattctaacttgaggtttatgatccatctcaaattttttgtgttatataaagtgcaaaaaaggtcatatgagatgatcatatgaattttttctttacagtttcattttttccctatgtagttaatttgatacagcaccatttggtaaaaaagccttatcttttgtcattgaattgacttggaaccctttttaataataattgaccttatatgtttgggtctatttctggagtctgacctgtcccattcatttgtttttccatccttatataatatattattgatatgattgtaattagaatgatttttcacattcatatgcatgaagaatattgatctaaatactggtctgtaacattaacagagttaatactggctttgcaagacctttaaaaaatatgctttagatctctaggtaatatttaacagtgaacttatgtttgcttaaaacactgatctgtttatcttcttttcttgtgaccaaaattaactgttagggattcttacagacttagtgttgaataaaaatttttagtttagggaaggaattgaaatcccacctcccccttccagaagccagtgggacatttaatttaaatgttttctgcactgagacacatggttcacagcatggggtctgcagtaaagcagatctaaatttataaccctgttctttgagtttctacctctgtgacaacgggcaagttactaaatctagctcaattttaatttcctcatgtatgaacttagttccttctaggattgatattaaataagaaaatacaagtaaagttcttagcactctgcctgatacaagtatcagttctagacagttgttatattaatatttttatttgggattctaatgaggaaaaaaacatatttcaagaaattgtttttttttaaatataacctaatgtaaattaaaatagaaataggtttcagaggcataaattctgtgtaaaattacatgtgttttaatttttatctttgcatacatagctttacagttttcaaattatatccctccttttttaaaaaaaacagattattagcatcttgagtttaaaagtctgttccgtattttcatagcacagtagtgatgagcatacttaatatttattgagtaatttaatagaacattaaatttacatacagtttgtgtaccacaataatgtgtaaaagatagaacaccatctgtttttaagaccgtcttgaaaaccacaaaattgttcagttaaccaaatgtactgaaaattatttcgtgcttctatgctcatctgacttacagccttgttgtactttgaaaattagtgggaaaagtacattctttttaaaaatgtacgttgactttagtatgctgttttttgcctcagaactctcactacttccttctattggggaagctttgagaattagtgggaaaagtacattctttttaaaaatgtatgttgactttggtatgcttttttttgcccccaaactctcaccacttccttctattggggaagctgttgtagaagcaaattgttgtggcatttaaaacagtatgaagggggatgcattaactgaggtttttcaccatgtcatataaatgtttatgattagttatgaagtgccaagaagaaaagtgtcatcattcttctaaaaataatttcaataccacagattagcagtttgtaatgttctgaaaaattgtttaagacaattttgatagcacagcagtaatcaatacgattctaagaaaggcacccctctcagttcaatccggcaaatgaataaatgcaaaacgcatataaaatactgtgttggaggctaaaggtaataacagttcaagagcatgtggcccttgtctttagagggtgaacagtgttttggtgaagcaaaccctacatgggaacttataagtcattcaataagtgctttattggatgtataaatgaaatattatgagaatacagaaagggagaaatatttgcttgaggaaattgaaaaaacttgatcaagtgtgacatttgaactctacatatatggagtttgaaaagttttcaacattatgtttcagcagagtgaacactataagctgagaagtatgatatgtttgggggtctgcagattaattggctgctatctctgatatatattgggttcataacaagatagtgtcaaagtgttgattgccccagactaagaaatagcttgaattcttgaagaagagtttggactttatttttatcaaataggaacctgttacgttttcaaatattgatctgtgtcctaaaagataactggcaagcacttacgaaagaataaagtagaggcagtgtctcctcttgggaagggggagctattacaatacttcaggccaaagcaaggtataaatttgagatctcgcttatatacttgtatataacagcatatacatataatgaaaaagtgtgtcatttctcattgaatttcattaagatttcagagatatgagaatatacacaatcttttagaagtgtattgttagctaagcttcttttgtacaaataaaatgaactaattctggctggctcaaccaaaaaggaattttttggctaccagaggatcccatggaatccaaagcagaattgaacaaggaagtttcaggaacagcaggaagctgggaagctctgagaaaaacagcaggagttattggaacttttctgaactccaagcctctccttccttactaaacccatcagtcctgggtcccagtttagaattctaaattcctgggagagaatcttaatttaattgattgagcttagcacaagtgcttgttcctggagagaggcaatgagtctctaacactggaagtattggggttggggaatgggtggtactggcaaggtaggtttgtcatatgtatacaagccagcaaaaatcctattaaaatgtactacatgattattaatttggtttttcactgacctaaacttgctttagatgccatcgttcaaaatatttactctctactgtattgaagtgtttttttagttacagctccaatctgagatttgcacatagtaaaggtgtgaatgttatctttcttatttttggaagcctgggcttttttcagattctctttaattgaccaacatactgaaaataaaagaaatattagtcttttcattactagcttctgttggctagtaatagagccttaaaatgatctgattagaaatgttgcaatgatacatctgataatatcataattagcatttaataatgcatacaatgccagtgttctaagtactttatgtgtattaaccctataataaggaactttacatgtattaactaaataaagttagtcccattttatagatgggaaaacagggatagggtagttcagtaattgcttaaaaccacattgctaataagtggtggaatctattcccagagtctgtgctttcagtcataacactattcttccctgggacattcctgattctttgccctcacttgtgtccagttagcattcagggctcccttcttagccttcccagaacatttttattcttgctttcattttggtacttatactttgttataattattattatttttgttgttattttttgagacagagtctccctctgtcacccaggctggagtgcagtggcgatcttggctcactgcaacctctgcctcccaggttcaagcaattctcatacctctgggattgcagtcacacaccaccacgcctggctgatttttgtatttttaatagaggcgtggggtttcgccatgttggccacgctggtgttgaactcctggcctcaagtgatctacctgcctcagcctcccaatgtgctaggattacaggcgtgagccaccatggccagcctacaattatttttctaaacatatctcctttttaggttattaacatcttggagacagagaccttcttttaatcatctaagatgattaagataataaataattgttaattgaattaataccctgttcagatttagtctctaggttagccagacattttgtgaataaatacgattctttaaattatttttattaggaacattcctttgtgtagttatcccaactttgaccttctgttgaccttataaattccatatcttgttctaataaattatttgcatgagattatccctaggactttccagagcattattgtccaatagaactttttatgatgctgtccaatatggtagacatctgtgattattgcgcacttgaaatgtagcaggtgtgactttgagagacaacatttttaacatatttgaatagccattgtggctagtggtgaccttattaaacagtacagctccagagagcaaaagcaagatgagtccagaaactaacagtaccctcccgcctgcccctgcccccacccccaaagccacccagctttggagcttacctagagaggacagtaacagtgtaaaagatctgtgtggactcaaagtgaaatcattcccaattaatttatacattctaaaaaatagagaacatttattaaatctcaatcgcagctcactgcagcctctgtctcctgggttcaagcatttctcttgcctcagcctcctgagtagctgggactgggactacaggcgcccgccaccacgcctgaccaaattttgtgtttttagtagcgacagggtttcatcatgttggacatgctggtcctcaggtgatccactctccttggcctcccaaagtgctgaaattacagatgtgagccaccacacccagccttaagtctcttaaattgtgaataaaatgtaaatcttaaaaacaaaacttgagaaaggttcttggattctttggtggggttttttgttgttgttgttcgtttgtttgttttttggggtggatgctatctagctcttgtgtgtaatgtacatgagagtctcaaatgttgtactttaagtccttaggttgtatgttgaatttaaactgttacttgttacaaagcccttacctttaccttatgccttcaaaagctcatatttaaataaaatggctctcaaagtaacctaccttttgcacgttttttgcccaccttgattgtacatgtcagtcaagcaaactaaaagtgcttatttatataaagtatatgtacatccctgtgactgtccttaaatgcttattagatcattgaattgctgaatatagaataacaaatatggaagacaaaaaattttaatttgcttatttttattaatcatgtttaagagtttgaaagactgcaagagtaagtttgtaaaagaaatcaaagactttgttgttcattatagactggctatctccctatagtagccagagtttgctttttattagtttaagcccctaggcactgtagtatgttattcagcaatgtttatttttaattttttagggggaagctaaagagctactcaaaattcttgctaggttactgtttctaggtcagaaaggttatttttgtttgtttgtttcagacttgcaccataatgtgatttgagtaggtcttttttttttaacgtgtatatattttaaatcaatttttaatttttggaaagccaatacatccacatggtttaaaaatcccacagtgtgcaggcacctgtagtcccagctaccaggaggctgaggcaggagaatggcatgaacccaggaggcggagcttgcagtgagccaagattgtgccactgtactccagcctgggcgagagaatgagactccatctcaaaaaaaaaaaaaaaaaatcccacagtgtgaaaagaaagtgatgtttctcatttatccagtccttcatttgcctagtcatttcttctccaacaaaatacctgtccacacacagaacctttaaacaactgttactagttttgtctgttcttcagaaggttctgtgcatacataggcaaatgtaagttatttattcttgtttgtggtattgtgtacagacgttagtatatgctacccttacttttacatcttgccttttattcagataacagtgtatcttgttcatcttatcattacttgaataacaactttttttttttttttttgcagctgtatggtatcctatttgtatagctgaactgtgctttatttaatgagtgtgtatttttcttgatgaccaaaatattcgagtaattttggataattttaagattctgaagatttgaattaatgatttaaataatggttttgatagaagtcattgtaaagtgtgttacccctttaccctggtttagttaaatagatcaaacacgttactgaactgattttaattcttatatgataaactggttgttgggaaacaggtttgggggtaaccatatattttgtgctaggtgagtatagaaataagacagggccctatcttcaaggagttgacagtctgctgagaagacctaagtgaacagattataatacagtaactggtataatgaaggttcctaggcactatgggaactcaatggataggcctttgtcacagactgagggaaaggtgggttgggaggttcctgtcacaggtgagcagtgactagtgactatctggctggtggcttgggtggtaaaaagaatttaccaagacagttgtaactacagaaaggcagatttcttagagacagtatgaaaatatgttgcaagggtgcaacagacaggtcagcaagagaggagctgactgccaggatacaaaggcttgctggagattttatagaatggtgcttgtgctctgtactgaagagggctttgtgccatactgataacaaggttgcagtgagctaacttgaatttttctgtcagccaagggtctgctgatagctgagctcaggaagatcatgagttatttgcacagaagggctatgtgtcctggaccatgaagaaaggcagacttacagcttactgctttctctttttgctttccttgggtcatctcgccagcctgacttccctcccagattaggacttcacagttcccataggcaacatcatagctgaagtttgaacagtgaccaagtgaaaggagagtcagagagggtacttcacttttgggagcatggatttcgacataaaggatcaggatatgagagaggttaatgacttctaagacagtcccatgtgacttcagcatatcatgtggtagatgacaatgaggctgcacatttctttttatgatcagaaacattattttcccaatattttgcactgctgatcagaacacatgtaaaatattgacttcattttaacaagggtgaccagactaataaagggattcataaaccaggtcagatgaggaatgatcaaaataaattttaccttaaaaagagatgatgtgacaagtagagttttagtggaacatcgctgtggaagcgaaaatgttgctgccactacacagaagtaagtatgctgtaactggaggatgtggtatataccttcggttttgcattattatagctatagtacctggcattatgcctgccacataacaaatgctcaacagatacttgaatgaaagaataaaaaatacaaaacgtgtgggtggcaattgccaggaaaacaggtttagattaactatttaaaattttctaacagtaagatattcttactgcttaaacagtaaaatagtttttccttcaggttgtgagcaccccattacagcaagcatttaagcaaatgctatgtaatcatctgttaaaaatattatatggggctgggcatggtggttcatgcctgtaatcccagcactttgggagaccaaggcaggaggatcacttgaggctaggagttggagaccagcctagaccacatagtgagaccctttctcttaaaaaaaaatgttatatgaaggattcttaaaacattgaatatagaagactctcctccttccagatacactcattgtcattacccacctatcttagtgtttttgtgtttttttgaagttgcttggctttagttttcttaaatggataagatcactatatgttcaaaagttgtttcgttaagtgtggtttggcaaaatgaatatattcgcttagatagttgtttgttttcttcatatacaaaattctattgttctgattgatgcatcattttctcaccccaagcaaggctaatccaggttttgtggcctgaagcttataattgggagcggctctcattaagaaaaacaatccaaaattaagtctaaaagtgaatgtttatttggtgtgagaaaagatcacaacaaataaaaaatgccataaacttcacaaaatttagacaagtagcttattgctattataacttgctgtgtttattattaattaacagtccaatatattatacctatttggtactttttttctacctattgtggccatgtattcattcatcacttctttacatgacagttttatattttatataggaagagtcttttcctcttgcataagacttgacagagtaccaaccatggaccaaattcagcctgcttgtttttataaataaagttttttgcagcgcaggcatatccatataatctatggctgcttttgtgtgcaacaatggatgagttgaaagagatcatgagttggaagcgtaaagtattaaatatctggctttttacagaaaaagactcctgttctaacatatttgctcaaaatttatttactatcgatagctgtgaagctgaaaaaaaaagttttgaaaccagttactagtaatgtaatagcacatctgtaatttccttcactttgcataaaacatgtttcttgcctggggagaactttacatctcatttgtttggaccactgtccctgacccctgaagtgtccatgtagttggatcatagtatgtcacacccagcaggagctgggcaacactcatgcaaatccttgggttaaagattgagtccggatgcatcatgtggtccaagagggacaggaaattactgctaggagctaggcggatacagagatagtgcattcttgatggaagtaccacgatcatcttcagggacagctaaagaggagcccctaggcatgaggctacagttgctgctggtcctgtgtcccaaaggagaataatcaaagccttgtaagggactctacgaagtaaaagatcctgaaacttaaacctaattagcttcatggtaagttcacctcttttccccaggacaaacaacttaatgtctgtttggagtttttcccttcataaacatgtttttttttctcatgcaccagcaatcctttactttctacaaccactaccacaaactctccctccctgccattttccctgccccaaaattaaggtaaaaaacaaaccaaaagggggcgttagagaaataaaactatattaaggatatatccttcttggaggatcatttagctggcatagggcaaaaatatgacaaattaggattgggatgaatcactgattatgtagtgtatgttgagtatagaattagcagctgattgggaaattcatccaaagctgtataatatgtgacctctggcaaataaattgagctcacctataaaatgaggggattgtattatatgcttgataaaatatatggtgaagtggtattaagtgctatttggctctagcattcaggaatacccacatcccaccagcaactgcagtaactacttttcaccctctcatcccaaactgttcccacagaagagtagtagcaaagttaaaaaacaaaaatctctctttctctcccccttccttcctgcctccctctttctctctccctctctctttacctctctctccctccatcctgcagttgcactctccctccctctcttttttttccccttgttatcaggacttggggctccactagtaatgttaaactttgggccgggcacagtggctcacgcctgtaatcccagcactttgggagggtgaggcaagcagatcgcctgagttcaagcaatcgtcaagcagattcaagcagatcgtcaggagttcaagaccagcctggccaacatgctgaaaccccatctctacaaaaatacaaaaattagctgggcatgatggtgggtttctgtaatcccagcttcttgggaggctgaggtgggagaattgcttgaacctgggaggcggaggttacagttagccaagatcgtgccattgcactcctccaccctgggtgagagagcgagcctccatctaaataaataaataaaaataaaaataaactgattggtgagctgggactcctagggtaccccctttccaactttattccctgaaaatccagacccaaatttcaggttttaccataatccaactgaatttgcaagaaacagaaggaaaaggagacagaagagagaggaaaaactccttttaagtagatccacttaagttacagggtagggcagaagagaaccagccgcacctatgagctgcccttttaacacagtgtcctcacccatttgcaaatataacccagtctataatgagatcagtattcctctcacctttatctgtatatgattatccttctggtagtagaaagttgagaatacagtaagacttgccatttttagttttaacatctaattttgattgtttactggtaatgctaaaggtctgtgccacataatactttgcagttttctagatgtatgaatttaaatcataggcagtatataagattggtgtgtggttgtgaatgacctaagcctgctgtgtagcacacacctttccatatggcttttgtatataataaagtgattttttaaatggttccaaacaggaatgtgcactgataatgaaggtgaggtctaaaacttttatgatttgtaaccaaaaatttgtcataactatactgctagaaatggaatagaggaagacgtggagccatttcttataggttatgtcttttagtatattaaaacaatcccctacatctgttatctgttgttgcaaacaaaccacctaatgactttgtgacttatagcagtatcaacaaatttctcattctgtagattgagtgattggtctgctggtgactaatctcaccagaatgtagggactgggctcagaaaggacagttgaaatggactagggccttgctctctatgtggtctttgattccaggttttagggcagcacttccaaaagggcaagctacaaggtgcaagtattcccgcttctccttccatttaccagtgtcttcttcatcaaaacaagtcacatagacaaatccagcataagtggaggaagataatatataagaacttgaatcaagggccattacaggaatgatgtgctactgtaccaaatctccagtcaaggtttccaaactgtatgtggctgtttatctctttaaatcactgaattgagctgtgttttgtattactttaacattaaatctgtgtcttcaatccatgccactcttctctttcttatttcctactccacacagttcaccaaactttcctatggtagggtctttttgatgagtctacttagaatgccatttcctccatacttactcctcaccagcgctttgttcacttgactcaccctttttcattcttcaggtaagatgtcacctcagggaagccttcctacactagttaggttttacatttttcttgcatactaatttttcctagtagcattttaatagttattaatgccaatctcccctttattaactagatgttttatgaggaccttgtctaattcatttttgtatttgccctcattttcattcttgtcctcacccccagttatcccagtcccttgtacatagtaggttcttcataaacatttggtgaacaaatatgtctggcagagaaattttcttaaaaagcagctaagatctaaaagactctctgtgtttggtccctaagatagcagctgtttctatctggctccgtttttcttcactgttgagattctgtttgttattttatgcttttgtggttttcctccttcattcctccaggtttgcttttttagaaatttatttcttgtggagtcttttgtcattgccatattctttttaaaacgtgtactgtttttgtttgttttctcttttcttttctggttatttctcattgtagaaattaccaggtgataagatcccttgtctccaaagtgaatttttgtgttttcttttcctggatagttcttactgatactcaccactctcaggagttgttgttccctgccagatacattgtttttcttttttaaatttatgatttctgtattgggttttgaggtgggcaggtaacaggtgttgctactttaattatttagaacattgtttcatgagatcactacataataaactgtaggaattcaaccaaattctttgcatttctttacttttatactactttttataatgtatagattaaaattttacagtcatctcttagtatccatgggggattggttctagggccacccacagataccaaagttcacacatactgaggtcctttagaacccacccatgtgaaaagtctgccctcctgttttgtgggtatctcatcctgctaataactgtatttttcaatccacgtttggttgcggatgcagaaccctgcgatatggagtcctgactgtatttagtgaagaagatctgcatgtaagtggacccacacagttcaaacccatattgttcaagggccaactgtatattcagagtaataataggtcatttcatgtaaatatatcatcagagcatctaggaatgtatttaaatcttagcttttatataatgagaacacttagaatggattttctcatgttagttttcagacatttgaggccaaatgcaacattcagatacatgcgtacatataaaagttggagtatttgactgttaatctaggccaacatgatcatagaaaagactttattttgttaagtcatatgatttccccccacatttagtgtattttggatatttattgaaaatatatatttggccaggcacagtggctcgcatctgtaatccctacactttaggaggccaaggtaggaggatcacttgaggtcaggagtttgagaccagcctgcgtaacatagttagactgcatctctacaaaaaattagaaaattagcccgtcatagtggtgtgtgctggtagtcccagctactcagaaggctgagtgaggtaggaggatcacttgaacctaggggcttgatgctgtggtgagcgatctcactcaccattgcactcctgcctgggtgacagagcaagaccttgtctcaaaaataaaaagagaaaatatgtttaaatattttctttaacattgtatatttgttagattaaaataattttagttattattaaatattcagttattcagtattaaatcattttagtatttgttgtaggcagttgatggctaaaaacaaggatccctgtgactcctagtattttctagtctttttgtggtctagctgtttctgtagtcaaagaaatacctattttcctgatctaaaattcttattctgacctgttacataatgtggttgttctgaaaatgtgaaaggaatttaaacagtagaagtgctgaatgtttgtggtttaagtcttatgcaggatagaacttttaagaaagttggtacacatatagagggaataggaggaagtgggagttttcttagttttgggccattgcagcagtggctaacatatatagaggtagtaatggctctggggagaggaccaccttctcaagattgctgtggttgtgaaagagagctaagggtcatacattttaatgaatcattcgtgcttgttaaagttagaaataatttcatacttaaagatacagtacaaagaacttctatatatccttcatccagatttgccaaatgtttattacatttaccatgtttttttctctatatatatgtatacatgcatgttatttttttctgaataacatgagaataagttgcagacataatgcctctttataatatttcaggctatatatcctaaaatcagagtcattctgttattattgtagtatcattatcaaaatcagaacatgtagtttttaacaaatacttgttcacttggggacaaagtataggtggagtgaaagtacaagcttgcagaactactttaagtgcttatgggaattgcagtctttttagtggttaggaaatcaatacagaaaattattctgatttagagtaagaccagtggaataacagagtaacacaaggtacacaaacaagcacttcagaaatgtgaaaaaaaaaccaaacaaaccaaaaaactccaataaaagtcatttcaacctaaggaatcagagaaatacttctcaactggtgcagagtcaacctcaaagaggtggaagtcccaggcagaaggacagtgggagggaattcacttcctagaatacatcccccatattcttcctgcccttgatcatcatagttctgagaatgaatatgtcattacagttactcagtactgaagtatcaggaatacacaagatatgacaggttctgtttctaccaaagttgatacagtactttttttccttttaattaccagattttaaccttaacattattagggtaataagaaatagatttcccttcctaagcacttgttcttaggttgtttttcattaatatcttcttaattacgaaagacaagaaggaatggaattgatttgttgtaattacttaaaggaatggaaggaatgtctgtaaaaacttaattaagtcactgtcaatctagagtgtggggattagtgactgtttttatattgtctagcattaatatactgtattaaatgtatagcagttattctcatattcactgtaattattctgaattagaaaaggctttacaaggtgctgtggtatgtcattttcagactgccagatgaaggtaagaattaatgaaatagacacttagactgataataagagtgtagcaaattttttgaaaatccagttactgaaaattgcttttgaatagttgtttttttagttttaatgtttataatgcagtatcctgtctgtgaaaaattatagcattgttagtctttatttcttaagcaagtgttttaagaatttaagtttatctaaaggttaaaatgttttttagtttgggtttttttttgttttgttttgttttttaaagttcacatatatagccacatgatgttttacaacgtgaatatttataacatcatgaatatttagtcctttggctagcaaggggattttcataatgggatttcagaccctattgaataacttttttgtgtgtgtgtgtgagctgttacttcttgatttctggtaaaaagcgaagtagggagatttttagatcttcattttggtacatctagtttcctaattgctatctttttagaaatgaatgtattttgacagcaccatactaaaaaagactttatgcgaattctccttagaactaacaaattgcttgtttgatttttgcattcttcagcctggtatttggtacctttagatagtgtatgcaagacgcatttttctgaagttttcagtgctggcagcaggatgcctgtggcactatcatcctgagattgtgcacttgcaaacacaagtgtgttttgagcaggccaaaaagtgtcccacattcttcagtctcctctttgaaacccagtgtcccaggatacacattttttgtttttaagttatcataatttttattgactcttgcagaaatttttctgttcctttgtgtcctactcagtactgtatgtgaagttcaaggttgagtttggtctgtaatgttaaaaacataacattgaacattgttatctgagcaagtctttatggacttttgatcctaacagtatactgatcttacatttctgaatttagtatctaattataaaagatttgtgcatataattgttctttgaaattcctcttaccaaaaaagggcacccctcaggcatagttcagtaaacctaaaacagcatatcttcaaatcttaatgtagtctattttttattacagagcccaaattccgttgaactaaggtaccataattacttaatcagctcctattttaggttatttcagttcttcctctttaaaaaaatatatatttatatgaaatattttatttttatatttatattaaaatatgaagtattatattctaaatgattttcttaatttctagtttagaagtgaaattactttatcagaaaacataattatggctttcagaggatttgtaagtgctttatcagtgtaagtgtgtatcactttcatagaaacttaaggttgaatagttacattctaggttataaagtaaacttaatttagaataaaattagtttacaccttttcatgatatagtcttgaggaagggggcaacatggtgtactggaaaatcctaatgccctgaagtgtccattgcatgtaacgagttagcttccctcctatacatctgaaagggttctatttagggactatccttggtaaaattgagacaatagtcactcaaatctttttcatatcctcagtatagcattaaaactgcgtggccacttgtgcaaatcacttacaatcttaaactcactttagaaaggagatactataatctgccttccagggtggtaatactgctttcaagtttgtctcaatccttatctagataagtgcttaactgctttatacaagtcagccattactaatgctactacttcattgcttaagtgttcactttattgggaaacagtgtaatagggggagtaagaatgctagatttgaagtcacaaattgcctggatttggaatttcagctctgccatttagctgtgtggtattgggcaaattaacccctttagtgtcgggtttctcaagtaaaaaatgaagttatcatagtaataacaaatgaggctatatttaaaagtgattaacacatttcctaacacattttaagcatcaataaatgttttcagtaattattgttatgtgattattgtattagttatttattactacataagaaattacttcagaaactagtggcttaaaataacaatacatgtttattatttccttgtttctgtgaatcaggaatttaggagcagcttagctgggtggttgcggtcaagctgtcagcaggggctatgatcatctacatattattttgaacctaatggttataaattttatattttgcagactatgtcttcagcagtggtgcagttatatgcagcagatcggaactgtatgtggtcaaagaagtgcagtggtgttgcttgtcttgttaaggacaatccacagagatcttattttttaagaatatttgacattaaggtgagttttgttttgctttcactttaaactaggtgattaggttttctatatcaattataatttagtttagatttgtttatcctatatgtgatatttaaatttatacataaactaatattagaagagtgaagcttggtttttagatattgcatacggaaatcatgaccaaatgggaacatgtctgaagccagaatgtgaatagtttcctattttatctttctcctgctaccacgcattaaggctttttttttttttaaattatgcctgttggttcttgggctttctttacactctgtatttttttaatgaaactcttttattccacctggttcattatagaatagcgtagatagtctgttcaggtaacaacaaaataatattttagctcagtatgtactgttatttagcccaggtttaaaacatttcaatatctataaaaatctgtttgctactcatttttccttatattgtttctcatgatagatatattcagattttcatagctttatatccctcccttccaatcataaatcacattgttatagattgaataccttgttaggtattcatttcttacagttgtcataaaaatattttgctaagatgaagtctccattatttttttaaaaaacctttctgtaagtaagcctccatgattaatatttatatgtggcaataagtgcaatgagattttaattacaaaaaactaaaactgcctttaaactcttgggcgctaatatgacctgatagataacagtgaagagatttttacacctctggtctcagctttatttgtaaaatcagataaccatcttggtttgttatgaggtatttcactgagattaaatgagatctcagttatggtatttggtaaattagtgcttcttttgttgttgttgttgttgttttgagacagggtcttgctcttgctctgtcacccagcctggagtgcacagcttactgcaaccttgatctccttggcccaagcaatcttcccacctcagccttctgagtagctgtgactacaggtgcatgccaccacacctggctaatttttgtattttcttatagagatgggttctgctgttttgcccagcctggattcaaactcctggactcaagtgatcctcctgcctcaggctcccaaagtgctgggattacaggcctgagccaccagtcccgggctaaattagtgcatcttaatgtctgcttccaagacagctgagagatatgacatgcttctgtcactagcagtggcttactagtaatcactagcagtggctaactatggcagtgattctggggggtggggaacacatacgtagtttgaaagaaacccccaagtgctttgacatatttctcataaccattgagaagcactatttagaaatggcatacacttactactccactaagaagaaagggattccattgcagtggttataatgtgtgaacagtgtattttacatatttttaaattgtggtctaggtagaaccttgcatttctgaatagggcaatgactatctttctctaaccacttatttccaattgctggacactcataattcgtcacctttggtattaagattaaacatattttttatactatggcaatagatatggcagccatcatggcactcttatccatagtttaaccttgatacattttaattatcagtctctttctgcatcatgattaatactacttatactagtatataattagaaaggtactctgcaaaagttaagaatttgaagatggttaattagcagtacaaggaaggtatatttgaccctcccacatctataaaattgaggaaaagaacataaagtattcctgcagtgtttgatagtacattgtctaaatattgctggtggaactgtgctttggtaatcagttcatgtacaaaagtatcctattccttctatgtaacattgatgacctagtaattattctggttattatgtatttgaccaagtagctgaatttggaaatggttggctagtgagattatatcttagctgaattaaactgacttgatatgtaggttttatgaaagatacgttatccagtgttttcagttttaagaaattactgattagattatgtgacactatttatatattataaatatgttacatgtgtgcattaaaagttatttttaatataaacagttttcttaatatgagtcatcttctttgttttattcctagagattatgttttggtagttcttattttaatttttaacttttttctaggatgggaaactattgtgggaacaagagctatacaataactttgtatataatagtcctagaggatattttcatacctttgctggagatgtaagtcatatttttctttattgccatctttacttttttcattgcttgccttttctaatccaaattatttatagaaccttattgaaagatcaaattcaatttgctattttatttttttgctgaagatgaaatattcaaattagtatatgtgtctgctgtgataggtaacttctctaatagtaatcttttacttgaacttcttcatgcttttgtgttaagttattcagatcataaaataatgtcttatctgctagtaaaattaacctttcgttctttagaaatatacttcttttcctcattgtttttatgatataaagctaaattcatacattctgttgtttcccctttgtgatgaaaatatttcagacttgtcaagttgctcttaattttgccaatgaagaagaagcaaaaaaatttcgaaaagcagttacagaccttttgggccgtcgacaaaggaaatctggtaacccttttttaattacttaaatcaggccagcaaactaatgctcatggggcaagtgtggtccatttcctgttttttgtaaataaaagtttactgaaacttaactgtattcattggtttacatgttgtctttggctattttttgtcacaacacagttaaatagtgatgacagtgatatatggtcctcaaagccaaaattattatctgaaatatttactatttacaaaaaaatttggtggtccttaccttaaaataaataatatttttgttgagaactattttttttagatttaccgaagggcccaatacaataaccttttttgttgataaaatttcatatatattgacttttaattttgcatttgtgatagcattttttgtaaagttttaaaagtattttatactttgtaaacaaagactttaggtaagcttagaagcaaataagcagagttgctaacaagatctgtaaacattgccttgtctttctattttgttcctaatgctatatactataaaacccataaggaacttagtttagtgtgtgaaacaactctaacacatataaaacaattatagaacaatgcaggatagtataaagctttaagttaattggagtagaactattacttgacaacagtgaaccaggtgtttctcttgtaaagtggagaagggtgactaggaaaggggaacctctccaaaatcatcttaagcagatgagtttcagaagaaagaacatgtgctttcatccagtcctatagttccaaaaactgtatgccaatgactctcaaagttttttcttcagtactgacacatcttccctgaccttcagactctgtctactcaagtggcagaatagcctttagacttaacacggtctgagcagaatatttgatccatgtcctgtatcctgaaccttagccccactcagatctgttcctattcttctactaatcttccttgtttcagtaaaaggcatttgttccatcttatccctcaggctcaccatggtccctcataaatcctatcagagtcctattgactctgccttcaaaaacatgtcctgtctgactatttcttaccatttctgctgctaccatcctaatccaggccaccatgatctgtcagctgggctgccacactagctctctgactggtcttcctgctgctactcaatcctttttactatctcttttctatacagtagccagagtaaacttttagaattgtagattaggttatatcactttctctatttaaaattctgtaagagcttcctatcatatacacataaaatctatagtccttaaccatggcctgtggaaccctacatgatctagtccctgactttccttcttgtctcctttcactgtgccatttgctcactgtagtccagtcttcatgatgttctttcatgttgcaccctccttggggcctttgaatgtattgttcccttacttattttatttagatctctacttaaatgtcgggtcttctgaaaaatcttccttagtcacacgtatgtcaatttaggaataagacagtttagtgaattaatttttttatgttgatgttgtcttacatatatttaataatattcttctaatttattttctaacagagaaaagacgagatcccccaaatggtaagctttttgacaattattaatcttttaagattttagatgacagtttaatccttgtggaaacatgtaccatacattagtaatatttagtatcttttacatgttaatccttgtggaaacatgtaccatacattagtaagtaatgtttagtatctatgatcaaattatacagtttattgtgttcctatttttaattaatgattgacagatgagacttaggaaacaatattctttgatatttttctaacatgaagaaagaatacatagggtgaagatcactaatacttattatattttaattctggattcacagttgactaagtatacaatcggaccttaacatttttcctagaggcagtacattttgtctagaatatttgttaatgtcctactttaagatttacctttcattcttatttcaaaatattatttcacattgcttatgtgttatatgaagcccctttcaaaatgaacacctactgttgtggtgtatttagaactaatttagctctgtataatgctctttaatttgataatgaccacttgaagtattatgaattcattttttaaaaaacattgaataccagagagtaaaagcagaataccaggatgtaaaagataaggtctcaggggtagaaattcttactctagacttcataaactccctgaaattgtgtgctaaatatgttcttttctctggagagagaggatccatggctttcatcgtatttaaatgaggttcctgactctatgaaggtaaagaatcattctccagcacactttgttatgatagagaaaatggctgctttttaaaagcatatctcaaatcctcttatcagaacctagaatgattattcaaggaaaacttacataatacagagttcttaatatatgacagctattggtgattgttggggtttcttttaaacagatacgttgccttttgattttgtccttaaatttctttttctgatacagaaacatgaaccaaatgttgctgtattaaattctgggttgtttaccttattattaattttttaaatgcctgactaccttcagtagtgcttaacaggtaccaaatattgtatagtttcactttttcttttgaatagaaatattaatactttttagggctgttacggggattgaagtaatcaaagcttagcatagtgcttaataaatattagttattctgatgaagatgatgacaacaataatagcaactactagttaatgatcttttactacctgccaggcactgtacagcaaccttctgaagtagctcctattatctcttttatagataaggaaaccgaagcacagataggtaacttgctcaaggtctcataactagtaagtagtgaagcaagattcagcatcagatgatttgaccctagagactggccctttaaccactatgttatgtcaagatgattttgaaggcaaaactgagacacagggtaaatatcatgtctcaggatatataaattagtacatggcagaggcaaaagaaacagaagcagctgagttacaggttgctcatctgtgaacttttaatgtagtagtagaaattttccttgatataagcctagtatttcaacctttttgaatttgttacattattttgagtttggagagtatatacagtattgagtaccaacagagaagactttctagtggtgccatcgaaacactttggggaaagtaaccccatattttaaagtgtagatgctgtagaaataatataattaaaattaaggttgtaaatacatgtatccatgttggatcagttccaggatccccccatggatacaaaacttcgttgatactcaagtctgcgatacaaacaacatagtatttgcatgtaactacagattctcctatatgctttaaatcctctgtagagtactcataatacctaatacgatgtaaatgctaggtacatttggtcttagccaaaaggctgagaagtaatgctgggtaaatagttgttatactgtattgtctagggaataatagcaagaatgttctgtacatgttcagaacagatggacccatccatttttatttttaatccacagttggtcgaatccatggatgtggaatgcatggatatggaactgtgaatatggagggctgaacatttataaaatgaatttctgaagaggcatctagtttccatgaatagatagaatttgaaaattctttatataacagtggtgtttcataattttattacccctactaagagacccacttagaattaaatgtagtttcaggccgggcgcggtggctctcgcctgtaatcccagcactttgggaggctgaggtgggcggatcacctgaggtcaggagttcaagaccagcctggccaacataacgaaaccccgtctctattaaaagtacaaaaattagctgggcatggtggcgcatgtctgtaatcccagctactcgggaggctgaggcaggagaattgcttgaacccagaaggcggaggttgcaagtgagccgagatcacaccattgcactccagcctgggcaaaaagagcaagactccgtctcaaaaaaaaaagaattaaatgtagtttctttctatgagttggccattggttttaaatctttagttttaatcatttggcccagtggtttcagacttctttcattaaataaatggagggttttttttttaatagtgttgttaaaggacaaaattatacagcatgtattgccaatacttgtatacttataaaatatacatataatatggaattaatatattaatacacaaagaatgaaataaataattattaatacaagttgtaatattttaaaactgctttgcattcaactatcttgctttccccactaagtggagaccactgtttaggaggcagcattattactttactgtatttggtgcaccaccactaggtggcagtgggcccctggaccatgtcctccagtagctatgcaggtgctttgtctcagatccttatttagattatcagtttaccacaccttttcaaattttaattattaaaaagatactttatgtagaatttacatacattcctaaaatgcagttcagtaacttcctcactcctaatttctttattggtcagtctcacattttagcatatatgctttccaatgatttgttctcagcttcgtgactgcttgacatcagaggcctctaggccacctgtttttcaactgttttccttggtgaggcttctttgcttcttatgtaattaatgggaaacttgagttcttttagatttaaaattaactagacatgtctgttcacaagaacatttaaaaaccttttcatgcaacagttatccttaatcagaaggagttaatttgtcatttgttttttaaaaaagaaggaaaacagcccgccttcattatatgtttacatagtagttcttaggaggagtgtaatttcataaatggaataattaaactttactagaaatgacttcagtacgtacatctgttactaaatctttcatatactttatgttgtttaaaaaatggctctataccttaaacaggttatcactttttttagtgtgtcgcttgaaacagatacttaatttggctctagaataccattttaaacttatttcctaacatcttcaaactctaaagtaaataaccattgtcaacagaaataaccgagtacctaacctcttgaatgtatagaaatccatttttttctaaattctgtaagttgttagtaaatatttgttgaataatgacttgttggaccacagaccaagaaaactgaaaaattggcaaacaaagaatgtattatgacatttgtaaaattagcggtgttatccaccttgtagtttgacttttgtgtaagaggtataagaggtagaatagttggccgggcacggtggctcacgcctgtaatcccaacactttgggaggccgaggcaggtggatcacgaggtcaggaaatcaagaccatcctggctaatacgatgaaaccccatctctactaaaatatgaaaaattagccaggcttagtggcacacacctgtagtcccagccacctgggaggctgaggcaggagaatcacttgaacccggaggtgaaggttgcagtgagccgagatggcgccattgcactccagcctgggcgagagagtgagactccatctcaaaaaaaaaaaagaggtaaagtagttaattggaagggtagtggactaggaaccaagatatcagaatacacttttgcttctgtcactaatcatatgactttataaagatcacctgactcttactgtccttcattttcattaataaaatgaaaggcaattttgaaaagaaactctaatttcccatctaatactaattttctatatatctccattatatggatttttctttatagtcttacttaaataatgttgttttttttttttttttttttttttttttttttgagacggagtttcgctctgttgcccaggctggagtgcagtggcgctatttcgactcactgcaagctcctcctcccgggttcacgccattctcctgcctcagcctcccgtgtagctgggactacaggcgcgcgccaccatgcccggataattttttgtattgttagtagagacggggtttcaccgtgttagccaggatggtctcgacctcctgacctcgtgatccgcccgtctcggcctcccaaagtgctgggattacaggcgtgagccaccgcgcccggccttaaataatgttttaactagtactaatgaaattcatctataatgacttaaagagataatgttgatgcataataatatattcatgcctgatttttgggtagagaaagaggggaaacagtctgattacagtatgagttaaacattgttactcatttcacatatcacttacattttgttcctatcctcattcttgaatcttcctcagagacagctgaattactttctctagtgagttatataaatcaaggttataagaagctgatttttcaaaaatatactagcttggataatttaaatcattaaacttaactttatccaactgtgtttccatgctagtcatctatagtataatagatggcttttatataagctaaagtggcagaaaatatttttgttgttttctgtttttatattttactggtgagtctgattgtttatagttgctatttgaatacttagttccggaaaagtcatatgaataaagagagtgcctaattctttttctttttttccttttttgagacagggtcttgctctgtcgcccgggctggagtcagtggcgcaatctcagcccactgcaacctctgcctcccaggttcaagtgattctcctgcctcagcctcctgagtagcagggattataggcacacaccaccacgcccggctaatttttgtattagaggcgcggtttcaccatattggccaggctggtctcgaactcctgacctcatgatctgcccgccttggccttccaaagtgctgggattacaggcgtgagccactgtgcctggccagggagtacctaattctgatactcctaattctgtcttaattcttacattttattaagatataaagataagaaacaaagtaatttgtagcatccttattgtggatagtgttgctgatactgactggtaaagataagaagtgagagggcagaaagggaagaatgagaagtaaaagtagaccaccagataagtctgtgaaggtctgagtgtaaccccaattcaaccctctagtccctacattctggatattctcagtaagtcctttattttgtacaactacataaatgtcgaaatctgatacctgagcaaatttgaaaattcacatcctaatcaccctttcaggtcattcgatactgcttaactcacctttacttactgatctagttatttttcatattattcctgggcactaaaaaagcttttaatgattttatccatattattcactagctctcatttttcccaaaaactatttcttatccatatcaacaacttcctatggaatttttgaatgaaattgtaactaaaactttaggattattaaaatattatatataaataggatttgaatattaagggaaaagagttgaattttggtgatattaaaaatatgcctttccaaattatttacttttttgataaggtgacatggctttcataaatttgttttagttttgttttatctttaatagtagagttgggagaaaatagggtatatacaatttacccatgtaaataaactttttttttttttcagataattttagtaagtaggatactttggcagtttggggcataattaaagaataacagtcaagttggattttaaggatcaactaatatacattagccttgagatttctatttgccatttattgattatgttggggatccccaagaccatcctcagaggtggtgattcaccaggacttacaggacttaatatatagctgtactcatggcaaacatttattacagtgaaaacacatataaaacaaaatcagcaaagggaaagacacatgggatgaagttcataaaaaaaaaaaaccacacacaagtttccaagagttctcccagtggagaacacagaggttgcacctaattcctccaataatgaattgtgacaacttgtgaaatgttgtctaaaggaaaagcttgagacttggtgcccagggttttcgttgagggctagttacataggtctaccctgccttgcacttaccaagatttcagactcccagaaggaaagtagatgttcaacataaactgcattgttagcacaaacagtttagacacaataagcccaccttgtcagggaatagtgggaaccctcttgaaatccaacttcccaagtggtcaactgagggccaaccttgcaagtggtcctttctaagaagagcagtctaaagtgtgctgccttaaactcttttctacacaacgatgatagtatttcatatgttttggaagtggtcgttaatgtagtcacctcagaggaacttggtctcaaaggaggatttgtcagagaaccatatataaaaataggatctctgaggaacatgtgttgccctttagttgaatttttaagaaatttttcagttgaatgctccacattcagactttcatacttttaagatcaagaattttattttgaattgtaagacaagttttctgctacatttagtaccacttctgaagatactattaataatatggaaagatgcctttgacatttttactgttgattcttgcacaagatgagtgctttaagaatttttgtgttttaaatttttaaattctatacttctgatagtcaaggtgtatgcgtactggtggggaaaatatcatttgacttaaggatgccagttctggaaaaaatggtagtaataattttaagtaccctttttcttcttgactaataaagttgaaacaaagagttaaggctatatttctttgttaaatttaaaacaaaaatagatactttactttctttatccttgttacaagatatgtttcactttactgttgagcaatgtgttggatatgaggctattataatcaaaatttaagagattagactaattatatttaaattctagctggaagttcatattctttatgaaatttaatggcataaaaatgtaagtttgctttgaaatagtgcatctacactcatttcaagaacttaacaggttttagaaatttaggcagcactttatgaaaaaaatgtagaagtttaaaatataaataatttataatgaagtgatcctatttcagaaaaagtatttaaattgtaaattatgattgtatatcagttatcttaaattatatcccttttatataatttggttttatttgcaggtcctaatctacccatggctacagttgatataaaaaatccagaaatcacaacaaatagattttatggtccacaagtcaacaacatctcccataccaaagaaaagaagaagggaaaagctaaaaagaagagattaaccaaggcagatataggaacaccaagcaatttccagtaagacagttcttttgttgttcttatcttcacttttgatttattcattgctgttcttgatttttaacttgttagaaaattttcttctcttttcgggagggtgtgtacattcatcacttggataccgttttaactatgtactttattggagtttttttttttttttaaggcagctgctcaatagatgttcttggaatcttatggtttatttactttttcaactatgagaaaagaaaaattagataaagttgtttcttcaactaattattgaacataaaaatgatttctcactttgctctaaaaatagcatttagaaattgtttacagatactgcctaggggcagtaaaaacctttggtatttaacatatttcaagcattttcatatgcattattttattagctcattatgaaacccttatcccgtcatatatataatgcttggactcttatgctaatttgacaattaaggaaatagatgctcagagagattgtacaaaaattttaagtttcagttagtagcagagtcagggctagaatcctgttcttctgactccttgtacatagtttttatcacaatatggttatgtctgtgagaactgttagttcagaccaaaaattcaaagccaaatgtagattgggtttcatatatattgtgtttataatgccctttatgcattttgtttttctattttttttctattttctacttcaggcacattggacatgttggttgggatccaaatacaggctttgatgtaagtatgttttcaaatcatatacgttataactgtatgtggaaatgtgttggcctattttagatttttttaaattcatttttgtggtttctagtatctgtttgaatgtgcttgtgttttatgtatgtatacaactgaggtttaaaaccatattattgttctgtcattcatggctaagtctctaaagacttagactaaggttttgtgtaccttggctttatacactgtataaataaaatccttgtgctttgaaagccaagagaagaaaatcatttctgccaagtgataatttcaggggagtgtataccaaattactagaaagtagtataatcaaattctgaatattcagttgttgaattctccagatcttttcattctcctgttctttttggcagttttgccgttgttttatagcactgtgaaactgctggcaaaaattaatcagcgtttggatgcattattttaaagagatattatttgtgattggagtaaaaaatatttttagttatttttgttatagctacaatgttaactcaacaaacatactgagcacctcttgtgctgggcattgtgcaaggtgcttgggattacaggaagatccttgctctcagattttcaaattaatttactttttttgtgtttattcctgatttttacatacttacttaggacaaggtagaataaatgagcattggagatgtctgaatcatgaataggctaatagaaatctaaatgagatgccctctttttgaaggcagggaacaaaaaagaagaataaaatagggaatatatctgttcagttttttttaataaaatattttagttagcacataagtaatataagcatgttaaaagtttaggcaaaataatttcagaaggacacagatgagacttaaaattatgttttttaaattgggatatatttttatagttagcagttactttcttttgtagctgaataatttggatccagaattgaagaatcttttcgatatgtgtggaatctcagaggcacaacttaaagacagagaaacatcaaaagttatatatgactttattgaaaaaacaggaggtgttgaagctgttaaaaatgaactgcggaggcaaggtaacttttatctctattcagcgttctgttttgttttaatcttttgaggtcagtttcatggaaaccagttaacattcatacatgtgaacccttccttgagcagaatgttgaagtctatggacaactaatgtggcccatcacactgtgtcttaacattatttcattataactaaaaaaactttacaaggttttgtttattctttattcataaaaatccatacaaaatcttcccagctattctattttaaagtaaaaacttatagttgcctaaatgttatacttaaggaatcctataaaccaccagattttattgtaattcagaagtaataatttaaatataatcactttctaattagtaatatacgcatttccagaatataaataatgtaaactttctattttgaaatacaaatcctttttcttggataaagtatgaaattttcttttgtacctgagagcacaatttataaccttttaagatttgatatttattttaaaggacctcgtatttcagttttgtcttaataattattgcagtaaaatgcagataaaatactctaaattttccaattaacagtcatctctttgctaccttattaggactgctttcttttcttcttcctagcttttgcatactcataatagtgtagttaagcaaaagctccggttaaaacattcttctgaagaacttaactgtcattttaaattaggcattcagtttacttatgtctttttcattgccagtgttcatttaaactttgattgatagattgacttatatagttcataaacattattatgccagtactagtctcaggatatttagatgtaaaggattctcatgcctcagccacccaagtagctgagattacaggcatgcaccactacaccctgctaatttttatatttttaatagaaacggggtttttccatgttagccaggttggtctcaaactcttggcctcaagtgatcctcccgctttggcctcccaaagtgctgggattacaggcatgagccaccatgctcagccaagtttatttttctgttatatcttacattttcactgatgtggaataagaatgctaatatcatgactactggaataatagtaatttttgttaataactttaattttgcagtgtatggaaattctcagttaatttgttaataaccagttcatgtctctggaataagtaattgagcatttcaacaaagcaaccagcctcctataatgccattactagaattgcagacaatttttagagatacagacattatgctataaaagtacaaatgtaaattaaatgacaaaggcttacattttgaaaggaaagcattatatttgggctttagcgcagattaatgtgaatgaattctattaagctatgctacactataattctgaatgtgaattgattttacttaaaaaaataagtgtacttgattcttttttaaagagggaaggtatttatttttattaaaatgtaaactaatgctaattaacaaaatgtttaatttcattggtatattttgttattattttgtaaagtagaaaatgtttattccccttactttcagaactggtactaattccaaaaaaataaactattctgttttagctcatatttttttaagaaccaataagaaagtgatctttaggctgacaattctcaaaaaaaattgtgagatatcatctgtgctcaggtatctttgtaaaataaaatgcaaagatgagacccttttttggtattattcaatttttatacatgttaaaatgaattacttttcaatatgatgtttatgagaagaaaaaagcatgccttctttttttctgtttgcatttcagcaccaccacctccaccaccatcaaggggagggccacctcctcctcctccccctccacacaactcaggtcctcctcctcctcctgctaggggaagaggcgctcctcccccaccaccttcaagagctcccacagctgcacctccaccaccgcctccttccaggccaagtgtagcagtccctccaccaccgccaaataggatgtaccctcctccacctccagcccttccctcctcagcaccttcagggcctccaccaccacctccatctgtgttgggggtagggccagtggcaccacccccaccgcctccacctccacctcctcctgggccaccgcccccgcctggcctgccttctgatggggaccatcaggttccaactactgcaggaaacaaagcagctcttttagatcaaattagagagggtgctcagctaaaaaaagtggagcagaacagtcggccagtgtcctgctctggacgagatgcactgttagaccagatacgacagggtatccaactaaaatctgtaagtaagcttttttttttttcattttagatcctttatcataatggaattttaaagtaatttattgaaagatatttttgaaaagtgtattcttttttcctcttgctaattcattcttaaccctataaatttaaaaatacttttacatgcagtgacatgcacaaatttttaattcagctttgatacatctctatagccatgtaacccatatctctatatccaaatgtagggtatttctgtcaccccagaaggttttctcatacctcttcccagttaatttttccataaacaatcactgatctaatcaccatagattagttttacctattctagaacttcatgtgaatggaattttacaggatgtttgcaattcattgttctagactttactttcaaataaaaggtactttaaagaaaaatccttattaagctgtgagaattaaaaatagccctacttgaaaccaattgtgatcaccttaggaaatctaaaccagtagctttatgaaaattaaatcatgttccaaagttttcatgttctaaaatttagattagtagagaatcagaccaaaaaaattgaaagagttgtaatagaatttctgacagtgatggcaaataaatttaggattatctgatttggatgaggtaatcatttaatcttacaggtcatttaatcttctagagttcagcaaacattttcctataaaggatcaggtagtaaaaccttgggcttatataggcagtatggcctcttgtgaccactcagctctgctgttttaccgcagaagcaccacagacaatacataaatgaatggacatgcttgtgttctataaaactatatttggacactgaaatttgaattttatataactttcacatatcaaaaatactcttattttctttcagccatttaaaaatgtaaaaatcaagcttaatttttagatagttttaaaaaaaaatccaagaacaggctggatttggcccatgggctcaagtttgctgactcctatcctagaacctaacctgtctacatttacatacttcttttggagccttttataacatgttctccaggacttcagggaggtcatggatgatagagtttttctgtgaagtaaatggagacgacagaggatgttttaattgaaaattatttcccagtataggaattaaagtaactttctagatctcagaaactttgtctaaaaggagggtaatagataggaagcacaactaattgaatgaaaacatgtaaacattagcatagatctaagaagactctgatctttaaaatatatctagctcttttctttacatgtattcaggatgacacttaaacctatgaacagtcatctctgttctctttccccctttagatcagactaaaggcctgtcaagagcagttgaagaactttaaagagtggttagtggggagaattaatgtcaaaatgaccacagcccagcttttaccttggaatctctgctagttcctgtgtcattctcattcccgtaactctcactcctaacccacctttttgttttccttttctatttccttttcacaaaccaactttgtttctttctctcatttagctataataaggtgatttaaaatttttaacgaataaagttgtatcctcatttattttaaaaagtttaagagttaaatttctatttactttctccataactttctcccatcccaactctccctttctttccaaaaaaaaaaaaagaagcagcaaaacctgttaattgatgtgtaagaatgggggccatttttatcctaaataatcactttccttttgattgcatttattgcaatcatagggtgcataatcagtgaactattggcatgttatacatgtaatccgagttcgttattttttgaaaaagaccattttgtggttgaaatttctatggctatgtttctttaaattttttgagtaaatcatcaatttattctgtgatgaatatgattaacataaaaccatagacttactttaaagagctagtaggaggtattgaatactcacatatatttttgaattccatggttttagtacctcaaatagtactttgttcaagtaagcacttcaaaaaatgtgtttgatgagagtatgctcacttctgctttgtgctctctgctttacattatcacattgcttaaaggtagtctaaatgtccctaccgctgttgtacctccttgagagccttgtgcagaaatacaaagctctgaaactctctgttatcttttttcatttgtggtacttctatactggaaatagttaatacataatgtttaaagccaaaatactaaggaatgaatctatatcttagggggaaccactttgaatttttttaaaaaaggtgtttactccagaaagaacaaggagtattagaggaagaattgtacagatcaaaatggaaagtttgtctaaataaaattgtctttgggaaatgattaagaatttcaaaaatatatattatatatgtatgtattaaaacataggtaattatttaatacagctatgctgtttcatctttaattataattttttttttcatgaatgcactttggcacagctggaagtacttcagttagggattgttacttgcctagtgaggcaggtacattttgaaagttgatcaactcatctccttaaaaagaaattatatactatgagaaaagaggttcattttgaaggtataaatgtaacataaaggtgtaaagctgaatttttgtaggcaaatataagtttctacagttgtttttcaatatcttcagtgtgcgtcccacgtaacaactctggagtctaagtattaacctctgtttataacatgaaatcccttgataaaagctttaaagttgatcatctaagtctgtgtgtgctggaataaacagaagtaacccagcaagtattattcaggagagggtttgttatctgaatgtaaacatagatttggaaatgtatttttggcttatacattaagatggaaaggaaatatttttgaataatatctttaaggcagcagtttatttcttgttaatttgattaatcttgtcctgcgcttgccagtttgatatcttttttgtcttttacaataagaagtgattctaagaaagtaggactttctggagacaaagattcttggctaaagatttattactgagttttgctaactttcttttccaaggtggctgatggccaagagtctacaccaccaacacctgcacccacttcaggaattgtgggtgcattaatggaagtgatgcagaaaaggagcaaagccattcattcttcaggtagagagagagagagagagagagagagagagagacagagagagtgtgcgtgtgtgtttaataaatttgaatgtttgacgttctgttatttttatgactgtctttgctagctttctctctgctaattgagtaactactgatgtgggctctaggatgtattttaaaaagttgttgcctgtgtgactagtctctctgagacttaacaaatgcaacaccaccacagccatagccataaattgaaagaacagctttgggaatattgacagttttgtttcctatatcaggaaatgctaatagacttcctagcaaacaacctctaaacaaagcttgagatttttagatctcattcctgtgacattactgtgacatgaaaaattcagggctgggtgcggtgactcacacctgtaatcccagcactttgggaggccgaggcgggtggatcacctgaggtcgggagttcgagaccagcctggcctacatggagaaactccatctctactaaaaatacaaaaaagttagccggcgtggtggcgcatgcctgtaattccagctactcgggaggctgaggcaggagaattgcttgaacccaggaggcagaggttgtggtgagccaagatcgcaccattgcactccgacatgggcaacaagagcaaaacttcgtctcaaaaataaaatgaataaataataataataataaatcgggccatttacctcatctgtaaggattagggataagaatttcagtaatttttactgtttctagagtttgctaaagaatactaactttttttaaacctttctttttcattttctaaaaggttgatttgaagaaaccagtacctattctgaggttattattaaacatatacataccaccatataaatattcctttaaagaaagaacaagaatatgagttttgctgattggagtagttgaggtttgctaaatagcttctccaacatgatgtgctagaatcagatctttcttcttagatttatttaatctctgtgagcctcagtttcttgtttgttacattcagagaactcacaaaacatatagatgtgagaattaaatagtatgtcactaacctgcagattgcctagcacatagtaggtgcttaataaatgttaccttccttttgtttctctgtaaggatgtccatgtcttaagatccttgagcaatgtttgttttccttaaataggcatatttgtacctaccctccattacagagatagagataaatatttattgtggaataataataaaattttaacaaaaaaaaagtccctgccttcatcgacatgcattaggtctaatgagagagagagacaagcaataaacaaagaaaactagaaaaacatacagtatgttaaatggtgacatgaagtaaggacaaaagtctaacagaaaagggaaatagggggcagactgttgagagagaggttcattttgaaatgataaaggatgataagggacaataaagcctaactgaggtgacatttgagaaaagaccagcagttcaggaagtgaaccatgtagaaaactagggaaagtgtatccgatggaaagaacagaaaatataaagtctgtgaggttgagaaacaatgaggagatcacggagcttgcaagggagggagggaaagaatagtaaggaatgaaatacaagaagtagtaggaggccagtggtaaggctttggagacccctgaaagtgcactagcttttattctgcatatgatgggaagccattggagggtttttagcagaggtgtagtaatgatccaagcaagaggtgatggaggcttgaaccaggtttatagcaccaatgagaagtggttaaatattaattatattttgaatgtggagatcactggttttgatgatggtttgaaagtgaaggttgaagaaaaagaagagtgcaaaatgactccaaggtttttgacttgaacaactggaaaggggaaagacttacgaagaaaaagtttgagagggaagattaggagtttgattttacatattaaatttgagatacctattaattcaactatagatgtggagtaggcatttcgttatgagtctggaagtcacaggagaggtctgaattgttaaattgcatgtcagtaggatatacatagacacctggtatttaaagttatggttatgtttatggtatagtcttctttagcataaaaacagtgaaaattacctaaattcttagccctaatcctcacagatgaggtaaactgcctgaattttttatgtcatagtaatgtcataggaatgagatctaaaaatctcaagctttgtttagaggttgtttgctaggaagagataaagaaaggtcttcattcattcataaagaaatgtaaggcttctgtgaactacatgattctgaaaaagcatttattctatgctggtatctgtgagttctgctaaatatttccctacaataagtttttttttaatagtatgtaatagtcacgctaatataatgaaaatataggatggtttttacttattttcagacccatttattttaactgttagtatttctgtggtagtacctgatgatgaaattattagctacttcttcctcttcaccatagatactgataagtttctgtcttttgtcagtctgtaatgccagcatagtcaggtgtctttgatgcttttcatccaggtaaattttgtgaagcatgtctagcaaaatctggtagcaaattatttcccttgctagaagagtaaacagaaattaacatgactcaattgaactcctttccaaataaattctgtaacaatttagagctgaccatgagacttaaataaataaataaataaataataaataattatcgttttaaaagtaacaacttagtttagggctaagagaagataatgttgcttctcttgggcttctgttaattttcaagttctaatactagagctccagtacttcttcaaatactaccttcacacaatcaattttacatgagaaaaatagaagaaaaagattgttctgtgttctgtacatgtaacccacacgtatgtcacctagtcttactggctttttatcattatcaagtacaattactcagccactgtcccactttatatacttggccttcatgggtcctatatatatatttatatacatatttatatatatttatatatttatatataggtatatgtatttatatatttataggtgtatatatttatacatattttatatatagatatatgaagaggttaaatatggaaagtcagtataatatagaagtatgcttataaaatctgataactaaatattccttcaacaaatatttattgaatggctggtgtgtagtgctgttttggtgttgaggatacagtgagaaataagataggcaaggtccgtgctgtcatggagcttaatagataaagtacaataattttagatattagcaagtgatatgaggaaagtaaaatgggataggccgttactgattatggggaagagctatactttacatatgatggtcaggaaaggcctctctgaggaagtagtttatgaatggtttctaaatgatgaaaagattcagtttaacgaagaaatagctactgcagaagttctaaagccagaataagattggtgagtttaagggacagaaaggagaccatcttactagagagagtgacttgaagggagagtacatatgagagaagtttggggagagagagagacaataactggacaaatcatgtagggtcttatggagggaggtagcatcagatttcattcaaatagcagtggtagccacaggaggactttaagaagggtagcaacatattttttaaacttgaaatttaaataatatcactccatttgctctgagtcaaatagactctagagttgcaataatccaagcaggatgtgatggtggtgtggagagtagcagtgaaagaggtgaaaaagagcaggcttgataattggatcgtgaaaaaggaggaagtaataataatttctaggtttttggcctgattatgtgacaggatggtgatgccatttattgagatggagcagcagaccaggatggagcaggaaaagaagattggggaaggaaataaaagttagaagttttgagtttgagaatccatatgaagagtacaagaaggtagttggatttgtgacagaaaggtcaacccagatgattttatacattaacaggttgaaatttgtcacatagatattaaggaactagaaccattgtcttctaagccctgttttaatctttagtttactatcatactctatagatatatttctttagattcactttaaactgttttagtaactagattcttctgggagtcacattatctgtgtttcaggagttaaataattggagaaaccacccaagaattatgtaatgtcattttatttatgcatatgttttaattgtcttgattttcttgtagatgaagatgaagatgaagatgatgaagaagattttgaggatgatgatgagtgggaagactgatctatatattatatatatatatatatttttaaggtgaaatactaaacactactttctgtctgtggattctgtaaaattatcatgtaaatgttctaccaatttgctgtatatttttgttgccttttttgcttttttttaatctgtgcaatacctcatttaatctgtaaaggtttgtcgtaatcctctacaaagctactccctgttattgtgtgcaagtttacaccaggatgctcacttgatttgtgaatatttttcattccatcaacaagggagtttaaatactatatgtgagactgacaaaaaccttaatgtaatttacttataatgccagaaggaaaacactattttcataccctactttttctgtacctaaattttcttaaaaaaaaatctagtatagcactacattcttttttaagtgatgcagaccttagtttctttagcccctttattttgaatacaatgctacatatgaatgttgaagctgatacattgcacagttctgtagacatcactacaccgatgtagtttctcaaattttagcaatatgctctacataaaatcactacagagatactagtggggaagacgattaacacacctcttacagtaatactgcctgttattggtatagcagtggtatttgcagactgggatcataaggagcccttaaatacttgttattgactggggttatttttatgctgtagcaaatgtgacaggctctttttagcaaaatttttgaaaatttttttggtattactctgaaacaaaatttaagttggagtttcagggatttagggagtagttttcattctacatgaactgaggtaatattatggtaactccaatatttggttaaaaaaactatacaaatcagaatagtactaaaatactgtagaattttagcatttttattttgcactttgtgtggattgaggtgttcagaaataccaaccataaaaatgtaatctagttggcaaaggtgtgcgctaaaacacggaaccgaacatgcattgatttggataacttttgagggtttttgtcaaatagcatgtgaagagttacatttttcttaaaagattggtggtcccaatgtcagagttcttggaacagataactgaatgatagattttttttttttaaagataaaactttacaacctgcacatttgttatgcatactaaatggtgtgttaaaattagggtttctttgcctctctacactacactaatctgcctaaaggtggttgtttcatatttataatgctaattatcatacctacctactttaaattttaggtagaaaattatctgatttaaatacaaacatatttttctcacattgagtaatatgcataatgtagttccaaatgtatttcattactatagtcacaatatccaactaaaaattacgctatctagaattgtaccaaccaaaatctcgtattggcagatcttgacaggctggacctgcaagatgtggcttgaattttaaccatttattacataatctctagtgatcatgcatctagttatcataagaaataatttaaaaggttttgttgctgaaagcagtaagtggtgcagtaaaatacttaagttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaaattttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtacccattcttcgagttcaaagcacaattttaaacatgtaaaatggatatataatttgccaaaggtaattaatttattctttttttcttaaagaagaaaaagacattggttgttgttacaaaaagtctaaattactgttggttgaaacacagcagctgtggagttcagtccaggcatgaagactaaatctgctttaccaagtaaggtgtaaggttgcatgtttcagtcctctaccatcctgcactgtgagcagcactatacctgtgcgttgtctgaaagccttccgtatattctccagctaaatggtcgtctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaaatagaataaaataa

SEQ ID NO: 455 - DNA, 176189 bp, Homo sapiens
agagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctcttttgtctcccactcgcgggttgcaggccgagtttggggatgcggagtgggcgaaagtcgctccggggacgcttctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacctgttgtcctgcgcggcctccgctccgtggcctggtgattccgtacttcagttttggaaaactttctgctggattgcctggacccttttttctctttccagactcctagtggaaagatttggcaaggaaaaaaaaatgagcttgcgtcagggaagaaaaataatatgctgtgtgttagggtctggcgtttgagcgtggtactctttcatgctctcagatgttttaatttggtcaaactcctgcaggttttctcttttaagcggttaacaaactgttcagagtacatagtatgaacttggcacctgtgttacgtcatttaatccttacaacgattctggtttattgtattcctcattgttttaggggaagaaaccgagtcgcaaagaggttaactaacttgtctaagggagctgggatttgaacccaggaacatcgtattctggcaaacgaattaggaagaaaaaaaaccaaaactgtttgcaaacacttttacgtttaggaacatttttcagttactcttacttgaaattatcgctattttgttgctggagttgaaaacaactactttattgtatttacttgtgagaggagttaaactttgaattagagtgtaacttaatgcgtctcattgttttcagttgttgaaataaagaatgtgaaccagaattatttagatttttaaatttgaagctaaaatatgggcaattctctgatctaggaatggggtgagtgtatgaaaggccgattgaaatgtagaatgcgtttttagtagaaccagactcagttcttgtttaatttttcctccattttccgtggagcccactttaaactttttctactttcttcacttctccccaccctttacagaagaggttgaggcacttagcaggagctccttcattaaattccttctgttactggcttcttaaccttccgtcaaagagggagaatttttttttttttttttgtctttcttattagttaacaccttggggtttttttcctttccttctaattttcctgcttagtggagcgtgagttattttctctgtcgtatttgggttctttaaagtacaaatgttcttaagattttttcagtttacaaaaaccttttcttaagtctgctactccttcaagctgtcttgttgctgcttttccttttcaaatcttattaacattttaaaaagcttgttcgtaataaaagtaacacatggttgttaattgcgaactagcgcaacattgaaattaaaatttagtcattcacaatccatctctagagattgccaagtgtagtctgcttttcctgcctttgcctggttggtggctagccactcatttcttaaccccttgttatctggatttcaccttcacaaggaactataacctaatcaacacatttaactacctttttctaagtcctctccttgagttttctgtaagatttaacatcgacttcacattttcagatgcctctccttgggtttcattcatctatactcgctgtattctaacacagggtccaaggcagtaagatacaacagatccttccctcatggagcttaaagtctagtggggaaatacttattgaaaaataaagtctctagttaaatataattgtgattttaattaaggtgcagaatattataagaacttcaaatggagacctgatctggtgcttgtggtggtgggagaatctgggaaagataccttaaaattgctttgttggaacccaggcagattgtgaaggatgagcaagagttaactattaactagatgaagaggggccttttgtgacattatactgactttgttcctctccgccacttttctgccttctgtttcttctttcctctttaatatgcgttctccaagtttcacttttcagatcacttttctctatgtctctagtcccttagaatgattgttcagacctttctgttggaataattctcaattctttgtttatgtgtcttctgaatcacgtttttttgtttgtttgttttgttttttcttttttattcagttgctttctacatatctgtacctgattgttctgagctgcttttccttagcaaacttgcctctttggtgttctttatttttgttgatgtcataccaaacccaaaccttttcccatttcatcatatcttgtctgtagccaacatctgttgattctgctttatgatattgtaactcttctgctctctattcttgctaactgtggggcaattctgaattcatattggtgtgaaggtagtagtcaaatcataaaacgagttgggcagctttccttctttttctctttttcaggatcattttagactgggattatctgttccttgaaagtttggaagacctcccctatgtgaccatttaggcctagatcttttttctggagaggactttgagtaacacttcaatttctttaatagctgttggtttgtgtcgattttctgattctcatatgaattttaatgtttcacatttttttcaggaatttattttcaaatctagtgttatttggctttcacgtagttctccccccaccaccccgcgactccacccccaccccctaactctaaatcaagttctcatcccacctggactaatgttatgattttcttgccttcacttttctcctttatctaatcttatgtatttctgcctaaattaatctgtaagcccagttcttaccacttcgccactcagaagtttcctaggtcttccattaaatgaaatattttctgtggtatttgcctcagatttacctgtttttttttttttttttttttaataccttattgttttttctttctttctttctttctttctttttttttttttttttttttttgatacagagtctcgcactgtcgcctgggctggagtgcaatggcgtgagctcagctcattgcaacctctgcctcctgggttcaagggattctcctgcctcagcctcccaggtagctgggaccacgcctggctaatttttgtatttttagtagaggtggggttttgccatgttggccaggctggtcttaaactcctgacctcagttgatccgctcgcctcagcctccctgtgctggggttacacaggtgaggcactgtggctggcctttatagcagtttttatacaaatattagtttcactactagtttgcagggtgggtctgtaacggacttttcttgcatattaaaaggaataaatggggaaaggctcctgtctagcctaacagtagctgttgaactgtcctgatctgactattggatcttaggagcagcgaaccatggagagaaaggaaaatgggtttcctatcacactaaattttgaagtaggaaccatttcttttccttttctactttcccaccttttactagtttttaggctttaggatgtctttttaacatcacaaggtccatattgaccaagttggaccaactttttaacacaagattaaatgttgacttgcattgagttatgtccattgtaagatacacagtagtgttacagaccacttaaaatatgcttctagttgtaagaagccattgattgtaaggtgcaccccaattccggagatgctaaaatatgaaaaatggatgcatcttagaattgatgaatagtgtttctctccctaatcaaagctcttggatgtgcctggaaatccccagtagtgttttttgaaaagaacactagttaggggcatagggagatcagatgatcagtagactccatctcagggtggcccctgtggtccctaagccagttcgtatgggcagtttaatatataactaatgagtagacattgaatagatgagtaaattatctttgagtatcttttatttactctgatgttgtagactttgttactcttttatagttttatatttctgatgagccttcctttcttatggcacagatttgttatactgttaaagtctggaacagtggagcttggctcttgatccagctgtatataattggctgttgacttatgaaggaggacaggagtatgctagagatagggataaaatattataatcacatttgcagttagggagattagttacatgttggaaaatcattttgaagaaaggaagactgaagatgttcaaacttgtaggaaggtctttctggcctagcccggattaaacccatttatgcctagtgttccactattggaacgctaagcacgtgggagttatttatatcctgctcaaggtcatcaccaaggtctgattgcaaaaattcaaaaaattgcagcctcaggcataaatgggttaagatggtggcagataattagggcctggaatggataggaggcgataactagcgtggatgagagaaggaatgggattggcaagaacaactcctggatttctagcttggaaagcagggtagatgtgggtgacagatatgaaaaatgaggtgggagagctggtttgtagaagaaaatagtattggatcacatggagtttgagatatctgaaacagccaagtagggatttccacttggcagttgtctatatgggtctggggtttgacagaggtttgtgctggaggtaggcatttgggagtcattgctgtatagattttatattccaacagtgggaattgggtggctctctcaagtgactcttgcttacaagtgacagccctaactcaagttagcttaaaggagggaaaagcttctccccactaacccccatgatattgaaaggtctagaaatagacatggctggacctaagtgctcaaatgatataattaattgaggttgtcttttctgttcttcacttttgtggtctcatttcaggcaggtgcatatatctggcagaggaagacataggttataggttatagaattacaggttataggttatagacctcgtatcgagaactccttgtatggtctagcaaagagcctaaaacagcattgagaattttttttctttctttttgagacggagtcttgctatgtttcccaggctggagtgcagtggtgcgatctgggctcactgcaacctccgcctcctgggttcaagtgattatcctggctcagcttcccgagtagctgggtttaacaggcgcccgccaatacgcctggctcctttttgtatttttagtagagacagggttttgcctcgtgggccaggctggtctcaactcctgacctcaggtgatccttccgccttggcctcccaaagttctgggattacaggtgtgagccactgcgcctggccagtcttgagaaatttcaacttaaggcctgggtagagaagatagacattaaataattatctagttgtagttatgttaagatctacaaaaaggaagtccagggaatgttacaagactgataagggaagctgggctgttcaggatgcgggtactttggaaggctttcctgagaaaggtagcccgcagagtgagaccttaggcaagaaaggacaaggagactgtttttggaagtattcagtagtatttatttatttatttgagacggagtctcactctgtcgcccaggctggagtgcagtggcgtgatcttggctcactgcaacctctacctcccgggttaagcgattctcatgcctcagcctcccaagtagttggggtcacaagcgtgagccaccacgcctggctaatttttgtatttttagtagagacggggtttcgctgtgttggtcaggctgatctcgaactcctgacctcgtgatccgcccacctcggcctcccaaagtgctgggattacaggcatgagccactgcgcccggccagaagtattcggtaaagtgagcagtttttgcagctttttaaaaattttaaaggcaatacatctattgtgggtaatttgggaagtataaaaagccataaagaagcagcggaatgattaagtttcagcttctaattttttataaataatgtctgatactggttttactactgagtacctattcaatcacggatgccacactaacccaatccgaatcttcgtttctttatcttaaaaaatagaaggaacatggtgaactttaagataatttttctgcttaaaaaaagaaaaagaaagaaaatatcttgacttgcagcacagttagctgccgaaattgaaggtcatataatgcttttggtcctaatgacatcactggacttctgacttttggctgaagaatcacgccagccttggcagtccttgcaagtaccaaagggagtatggcttatgcctgcggtgcccttcccgtatcctgctttcttacctccttttttgagcattaatttttttttctttagcctttgggtaaagtatcaaaatgttgagaagatagactctcaattttgaaggtgagaaatctgtaggagacttggatagttgtttttttttttttttttttgagacggagtctcgctctgtcgcccaggctggagtgcagtggcgcatgttggctcactgcaagctctgcctcccgggttcacgccattctcctgcctcagcctcctgagtagctgggaccacaggagcccgccaccacgcctagctaattttttctattttttagtagagacagggtttcaccgtgttagccaggatggtctcaatctcctgacctcgtgatcctcccgcctcagcctcccaaagtgctgggattacaggcgtgagccaccacatctggctgacttggatagttttgatactgttttatgtatattaagatttgtaggtagttttcttactagtaattaaaatgctttgtaatgtatttcaagagtatagggtcttgagtgttttaaatttgtatataagaatgttttagattcctggctaaaagaagctcttgttagaaaatattaaagtaaaggctgttaaattttggtgaggctcttaatgtctgcatttttcaagaatcatttaaaaatgtcatgaaataaaaatatttcagtggtaactgttcagaagtatcttaaatgtataccaaatcaatgaaatataatcgctgggtgacagattattcttccttcattttataatcttttatttaataaaaatgtgggggaaaaattgcatgttgaagttgtacgtgtatattttagcaaaaactgttaatctttctgaagtactgctttggtcatcatccctatttgttaaatatttttccctgttttcttatttgcttacaatagaaaatccagaatatcttggactggtctcctgctctggccaagtcagccttttctgctttgcttcctttcctactattttatcagcctaagtcacgtaaatatccgattcaggtttgggttcagaatccttagacctctactgtccactacaatagatagccactaccacatgtggctgttgaagacttgaactgtggctagtctaagtgtgaattacgtaccagattttgaagatagtaccaaaagatgtaaaatatctcattatgcttttaaaatattggttatatagtgagatgatactgttagggatacattggattaaagaaatatattaaaactgattttggccgggcatggtggctcatgcctgtaatcccagcactgtgggaggattgcttgagcccagcagcttgagaccagcctgggtaacgtggtgagaccttgtctcagttaaaaaaacaaaactgatttcacaggattctttttactttttaaatgtggcaactagaaagtttaaaattacacgtcatattggacagtactgcctttgactttcctttccctggttctttgcccatcagaatgctttaaaatctagtataaatccttggccaggtgctgtggctcacgcctgtaatcccagcactttgggaggccgaggcgggaggatcacgaggtcaggaactcgagaccagcctgaccaacatggtgaaaccccatctccactaaaaatacaaaaattagccgggtgtggtggcacgcctgtaatcccaggtactcaggaggctaagacaggagaatcacttgaacctgggaggtggaggttgcagtgagccgagattgcaccattgcactccagcctgggcgacagagtaagactctgtctcaaaaaaaaaaaaaaaaaaaaaagaatattcctctctctcctatgaagccctcctcagtggtccaagcctcatagttggctctttgctgcatcattatttgaagataatcttttggtatattagatttctttactacaaaccttctcagaacttttaatatgctaatacacatggtgaaactctagtatagtttccctaactacgtattaccatagaactgtgtgttttctgttaacagaagttacacatatttgtggttgaaatttcaaacaatacagaaatgaagtaatgaaagtcttctgtaatcatgcttcacctgtgccccaagattgccactgttgaaagtatagagctagaaaaaattttcttttctgttgccttctttctttttttctgtccccatttcctaaaatggggtcatacgatacatccttatctttaaatttattttcactgaatatatagggggattctttttatgtcagtaaatttcaatttcctcattcttttttttttttttgagggaaggtcttgttctgttgcccaggctgcagtggtgctgtggtgcaaacagctcactgcagcatccaactcctgggctcaagcaatcctcccatctcagcctcctgaatagctgggaccagaggtgcatgctaccatgcccagctaattaaaaaatttttgtgtgtgtggaggtgggatctcaccatgatgcctaggctggtctcgaactcctgggctaaagtgatcctcccacctaggcctcccaaagtgctgagattacaggtgtgaggtgttgtgcgcagccttaatcatctcattctttatagtagttaagcagttattccattttctgattataccttaattttacttaccagtttcgtgttaatgaataattagattatttccatttttttcttttgcattgcaaatatgctgtggtgtttgtacatatcctttgagactgtttttattttatgaaatgaattcttagaaatgcatttactataagagaagccgtgcagattggatggaaagtgccaagccaccctgcaaaatcttcgtaaccattcatattccagccaacagtatttgaatatgttctctcctcccaacataatcatatcagtcttttttttttttttttgagacggagtctcgctctttcacccaggcgggagtgcagtggcgctatctctgctcacagcaagctccgcctcctgggttcatgccattctcctgcctcagcctcccgagtacaggcgcccgccatcacacctggctaatttttttttgtatttttagtggagacggggtttcaccgtgttagccaggatggttttttttttttttttggagaccgagtcttgctctgctgccaggctggagtgcagtggtgccatcctggctcactgcagcctctgcctcccggattcaagtgattctcctgactcagcctccggagtagctcagacaacaggtgcacgtcaccatgtccagctaatttttgtatttttagtagagacagggtttcaccatgttggtcaggatggtcttgatctcgtgacctcgtgatccgcccgccttggcctcccaaagtgctgggattacaggcgtgaggcaccacgcccggccatatcagtctgtttttatctttgccagtttgccagctgaaaaaacattcatgatataaggtttctttgctgttgtatgaatattaaaaaacaaaaaattttaagtttcatttgtcttatactctcaacttgttatacgctcctttgatttttgtgctaaaatatttcgtattgctaacagtacacatgcatgctttgtacaaagtaaatgttcagatatttgtatctgttcatggcaaaggcgtccagaatatgctactgcaacataaaaattatttggaaacctggtggctcatgcttgtaatcccagcactttgggtggcggaggcaggaggatcacttgagcctaggagctctagaccagcctgggcaatatgttgagactctgtctctacaaaaatttaaaaatcaatgagatgtggtggtatgcacttgtagtctcagcaactcaggaagctgaggtggggggatcgcttgagcccaggagttcgagactgcagtgagccatgatcttacactgcactccagcctgagtgacaaagcaagaccctgtctcaaacaaacaaaacatatattttaatctggaaacatttgagaatagcttttttttcctcctgaactcccttgtctgcctaaaactagatcctcccccaaagaactcaattgtcataacttccagttgtcataaatcccttccttgggagttttgcaagcagggaagatggtctcttgtcgctggagagaatttggcaccacacctaaacagacattgttataaactatcctatgtccaactgttgtcctaagggtccatttgtctttcctacatgttacttgttttcctgcaacagcccattgttcttttctagttccagttcccctagtaagatggtacacatgccccaaattcggacagcccccttgggtcacatttttctgtgaattattctacatatgtgaatcaaatctgtcatttctcttgcagatgtgttctttgtcagtttaatttatcagacctcaattactgaacctaagagggtgtaggaagtttttcttctctgacaatggccaaattgatatttttctggctgtaagggcaagggataataataaagtaacgtttttctaagaataaatataaatatcttaaatataaagagcgtgagtaaagtttctttaaagtacattaaaaaaactgttatccaaaatgaaacatttgttaaaagaagtggattatgctattaaagatgtgccccccacccccatgtgtttgttcctatcgtagtaatgctgattgttaatggatggcatagtaactttaattgtgttcacaggcctttgttcttaaaattatgcactcttccctgttttttcttagcattttatcaatttgcatagaagagaaaatgatttgtaacaggtttctctggtcacatcactgaggagagtcaacaaaagaagtcattcaattgaggttaaatctttacacaaagaaggcattaatagcttaaaagaataaagaaatcctgatatggttattgtgacttttccatttatctggttatgaaataactaaaaaggttaattaaatgttggcttatttctaggtttagttatgcatcggtgtgtttattgctttctgtgccttattacactctgcttactaggtttgtgaccttgagccaaagttgttaattactctaagccttcttttctcatatgtgaaacaaggataataatggtcctctctctcagggctactgtgaggactaaatgaatgatgagtgcagttcagtgcttaacactgtgcttgccactgtagtagcttaatgaatgttagtgaagatgagtatttctgagagaaataagcaggacagttctatcttaaaatgcaggtttgaatggcttcacatacagggtccttgaaaattaaatctgatcttgttgctttctaaaagtatgcattattttagcttccatgttaatattcacatttgaatttgcaaaatgcttctgtgtatcatcagtactggcaaattgatataggaaattttgttgcttttcctgctttgtacatcaagaattggaggctaatgaaggttaattttcccaccaatgtcaaacaagttggtgtaaaagagtaaatagatctagagctgaactctgtagttctacctactagggaggctgaggtgagaggatcacttgaggccaggattttgcagctgtaatgcattatgagaataatgtgctatgtaaatagcaactgcgcttcagcgtggacaacatagcgagaccctgtctctaaaaagaaaaaagtaaatagaatcagacttttcctcattcactcagagtggatgattaggacctcaaagttacatataaagtaaagtcaaagactccacatgctaaagaaagccctaggcattagtggccagaatcctttccagggcttattaagatgtggcagaattaggtcacaagttggggggagaaggaattgtgccagaattgtcattgcagctattagtttgcctagcagggagcactgtagtttttcttcccttctccttcccttggagtgtccttcccttagaaacttagtgtggagaggtctaagagaaccattcctggaggttaagaatactagcagaagatggaatggagtatctgattacctaggcagtattaattacgcagcaggctggtttatctgtacctatttgagcaaaggataaggaaaattagaaatcccagtgtggatggaggggtggcagtgaccttcttttagttcaggtgggtaatgcagatgtaaccaggcaccagccttcttgccaggcaggctgtgctggacaggggagcaaaagtagttggaagagggtgagctgaggctgggcaaggtgatgcagacctataatcgcagtactttgggaggccgaggtgggaggatcattgagctcaggagttcgagatcagcctgggcaacatggcgaaaccccgtctctacaaaaagtataaaaattagctaggcgtggtggcgggcgcctgtggtcccagctgctcaggaggctgaggtggcagattggcttgagcccaggaggttgaggctacagtgagctgagatcgtgctactgcacatcagcctaagtgacagtgaggccctgtgtcatattcccagcttcttgggcaactgaggcaggaggactgcctgagcccagaaggttgaggctgcagtgagctatgatcttatcactgcacttcagtctgcgagagagagaccctgtctcaaaaccaaacaaaacaatacaacaaatggagggtgagctgaagcagatcttcaggtgggctgagagcctctagtctcctttgtcatgaaagaaccccacttgtccccagaagaaaagctatcatttgtctgcttgtgatacagacagtgtagtcagtattagccaggaaagtggcaactgagatagctactccagtctctctcctccctcccctattcatcagaccacaccccttcctccaggctagctctcttggactgggtgcacccaatctgaatttgaagagaaaggaggtgattgtaagactgaagattaacgttttaaactgtactttttaataaccaaaagctataggaacttttcaagatctccataagaagtggaaaagggagatttgaccaaccacaattagggatagggatagagaaacaattgtttcttgtgtttgtaccgatttcagaccctttgttaagagccttaagttcccattaccttaagttcccattaaggcctttggacacattaagttcccattaagttcccaccaaggcctttggacaccaaatcccattctctttttctccgtatgaggctgtcacagtactatagatgaccatttgatcttctcagtggcctgtttccaaatgcattctgattctcaatactattttagcattaagtgtatcatttaattttatctcagatttataagctgtatattatatgataacccttttaattggaatattaattcaaatatcttaattcctttttatggaattgttggagtttatcaaaccttggaaacgttaaataacataaaaagcactcaaaaagaaacactaattcaatattttatttttacttagtgtttgagattttgaattttagaaagttttaaattaatattcagctgttattcacatataaaaggtaagtaggttttagtttaaagaatgttgagcaataaaatataagattgagatggattaaatggtatctgacatatttccttactctgaatcgatttaacctttacaagtattctatgatatagttactattatcagttcccttttacatgaggaaactaaggctgcagaggttaagtagcttgtcaagggttgcatagttcctaagtggcagagctgggattcaaacccaggcagtctggattttagagtccatgctcttaaccacataattatattgtcaaatggaggaggagaattttaagatgaggatgtgtactaggcacagagttgacttttaacaattaacctctcttttaatatttaaaacgtggtagagattttccacatttaaattttccacagttaatctttgagattgattgattgattgattgaagcagggtctcacgcattccattccccaggcaggagtgcagtggtgtgaacatggctcactgtagcctcggctgcctgggctcaagcttagatcctcccgccttgacctcccaaagtgctgggattacagctgtgagccactgtgcctggctccaatttatacttttttactttactgattttgtttttcctttgcatcttaaacaatattaaaaggtcagtggcatatagttgtttaaaaaaatatttatccaaaattcttcccacataccttctttaaaaattagtgcttttttttttctcatctctgagatgtatacatgtttaattggcgatggtcagagataggttttttttttttttttttttttgagacagagtctttctctgtcgcccaggctggagtacagtggcacgatcttggctcagtgcaagctccacctcccgggttcacgccattctcctgcctcagcctcctgagtagctgggactacaggcgtcctccaccatgcccggctaatgttttgtatttttagtagagacggggtttcaccgtgttagccaggatggtctcgatctcctgacctcatgatctccccaccttggtctcccaaagtgctgggattacaggcgtgagccaccgcgcccggccagagatagatcttttttcacagctttaccatgagtattactcttaaaataaatgaccttgggtaggtgcttgcataacataattatgttatttgtatcgtttcatagaataaattaaaacctaccctgtgagagaacaagaagaaaaagagagtcagttgaaaatgaaagtgattaagtccatctgtggggcagtttttggagtcagattgagaaatgaaatctgatttttacctgttaatgctgctgaataataataatatggaatattattaaattgcttttgttctcttaacagtcatttaaatgtaattggttatggcatgtagacgtctaaaaatcatcccattcctttaaagtttcttttcaaaacaagtcttttttccctcctgattgcaaaaataatgcttacagaacaaattgaaacacatagaaaagccctgagaagaaagtaaaaatcccctgtatttatactactcaaaggtaacatctataaacattttggtatatatactgtaagtttaaaaaattctacaatgtttctactgtaatttaagaatttgtgcaaataagttgagtaaagctaagttcatcctgagcgtctgaacctggaatataaggaacttgaaatttgtaggggtgggggtatctgaatagaaatagaaagttctgaaaatttggctgtcttattctagttatcttttttttttttttttcctgaatgttcttcctttccttctcagcttttgccacttttaagtttttttttttaatcaagatgtttcacatttgatatgttcttcagtaataatagactaaaatataataagatgtagggaagcagaacctaaactgtaggaggttaaaaaccagatgaaggccaggtgtggtggctcacgcctgtgatcccagcactttgggaggctgaggcgggtggatcacctgaggtcaggagtttgagactagcctagctaacatatagtggaaccctgtctctactaaaaaagtacaaaaattagctgggcatggtggcgggcacctgtaatcccagctacttgggaagctgaggcaagagaatcacttgaacccgggaggtggaggttgcagtgagccgagatcacgccactgcattgcactccagcaacagagcaagactccgtctcagaaagaaaaaaaaaaaaaaaaaaaacacaacaccagatggaaatagaaaatctaaaacctctagcagaatgaagctagaaagaatggaatctaaacactgaaattatacatctgctaggcagctgtgcgttctttatttataggttctgttgtggaaatagcaaaagaaactttgaaagaaaaagatatcttaaatagactaagcatatattcttatcactgtgatatgcacatttttagctgtacagcatgtatttcattctttttttttttttttgagacagagtcttactctgtcgccaggctggagtgaagtggtgcgatctcggctcactgcaacctgtgcctcctgggttcaagcgattctcctgcctcagcctcctgagtagctagaattacaggcgtctgccactacacctggctaatttttgtatttttagtagagacagggtttcaccataatggccaggctggtctcaaactcctgacctcagatgatcgcccgcctcggcctccgaaagtgctgggattacaagcgtgagccaccgcgcccagcctttaattcatctttaaatgaattgtccccattttctaggagttattatcttttctaaaaataacataacttttttggattaaatttagatatcctatttatatcttcagcattgaatcaatattttattaaatatacattaagggagcttcagtgatactaaaagagtgtgatgctgttgtaaatttgccattgctttcctttttgtcaatattcaaggattgtcttggaccatgggccaagcctgaattgtaagaaggaatggtaaagcatggtaacccattaaagggtaaagaaattaaaaaaaaaaaattgtcagagatatactctttaaagggccagattttttttataagactttaaaaagaattgatgattcttattttacacaaagatttttagaggaaagaaaaagtatgcaaaagagaagatgctctttgaagctggccataaccctgctgcaagcaaaatcagacaaggatggaccagaaaaagagaacaatttctattctcacttatcgtgtatttgtaaaatcccaagtaaaacacgagcaaattgaatcaaacagtatattgatactatcggataaagctagcccaagattcaaggatgatttgaccttagggattatattagtgtcatttacactaaataaatctaaggaggaaaacaatacaaccatctcagttaatggtaaaaaatatattaaatgaaattaagtaactctttgtgatagactagttttaagaaaagaaagaaccttcctcaacctgataaagggtaattttctacctggggcgtgtagcaaacccaacgggtaaaatacttcccgtgaaaggaagaacaatactaagttcatttttagtgttctttttagtgctggagaccccagccaatggactaagagaagctgaagcgaaaaagttgtaaatatttgaagggaaggtcagaatgtgtactgtttgtttatgctctttgctaagcatgtaatctacctagaaaagccaagaaaatcgattgacaaactgagaaaactaataaatgagttcagtaagttggctctacacgtggtaaacgaggaaatccatacataggttcctgtacaccagcaatagccgtgtgagaagtactgtcactgtctgttacatctgataaaacctgcctattaatctttggcctgcttgtcagtttcttgtcccagacatgctttgagtcatgaggagagcactccaggagatgaggctttcagtttcctgcttatctcaacacgaaagtcaaatgttgtgaagggtggacacaaggctgatggtttcatgacagccccagagagcaaaattcattccccctgatgcccatctcaccctgctatagaaagtttcattttttggacagcatttcctgagagaatgtatcactgagttttctggagacctgaggtctaatccttagtaatctgcagaaataccaaaggatatactaaggaaaacagaaaaggcattcctctaaaaatagctagttttttttttaatgtaatagcttgcagtaaacaatggcaacaatacagaaaactgctttcctccctactctctttgctctcccctctgtgctgtttccttttccttggtaaccagtgttgttactgtatgtatcttcctaagattttctttccatttacaaaaatgcatatccattttttggtgctttgtacagatggcatcatgcattgtgcattgcagcttgcctttttcacctaacattttctctatctccctccttttcggctgctcaccctggggttcatttccccgcagctctgtctgttcccttggcagtcctctcccactgctctccaactcctgacaccttccattgtctctctttttctatttgccttcttgttcttaaggattcttaaatgttttaagcagcctctgttccccttcttagactaatgtttttaaatgggtaaaatacgtaagacttgtgaaggaaaacaattattttgaaatatagctattaacatttttagatatagtaatacgtttgttcttttattaacttattaaataatccaggggtgagtataacaactgccctaatttttagatgctgatgagcataaataatgctttgagttgcctgcagcaagtagtttgatgagaatatctgatttgtttttattacaaagtcacaggtgttgctaatactactgtgtatcctgcctactctcataagtaaagaaaaattcaaagttcggttagtgaaaataaaaatgtaatctttttcacatctaaggttatgaacctcttgaattttgtgaggccatgggcttctgaataagaacttctgcagttgaaacttggttcacactggaggacactgattgttttttgtagtccactcaagcagtggaattttctgttgcagaccccctttccttgggcctggaggggttatcctttaccccctttgctacttccagatcactctccctcccaccttccttaacatcaaatagaaaacatgatattcaatctcatgatacatcttgtagttttccatggaaccttgactgacttccttctcatttaatgaagattttgtcttatatggctcattttctctagtacttctttattctagttcttgatctcaacatccaggtgggagactcttccactaccttcctggcctcttaatatcttgacttcctgcaaagtttccaccctacctcagctatcatggtcataccccagttctgttatacaataataacaaaaaattataaccccttccataatttcagttctaccctgatcatcacttcccactttactggctcatgccttctagtgccaacaattcttttatctcactgagacttagaacccattgaccctattatctttgcactgttcctcaccatactctctccttatgtccttacccttctctttattcagtttaatttctgttgttggtcatgattgttcagttgcaaatattctcagtacacttgccctcacttgcttcattgcttaatagagaaaccccagtttctctattaagaaccgcagttggttaaatccaactgtgcctactctacacttgtactttttaaaaatgtggtttagaaaaatggatatcaactgggcacggtggctcatgcctgtaatcccagcactttgggaaggcccagacaggaggattacttgaacccaggagtttgagatcggagtggacaacatagtgaaacactgtgtctgcaaaaaaattaaaaagttatttgggcatggtggcatatgcccgtagttccagctacttgggaggctaaagtgggaggatcacttgagcctgatgaggtttaggttgcagtgagctgtcattgcaccactgtactccagtgggtgactgagcctgaccctgtctcaaaagaaaaaaaaaagaacatgtatttaccctcttaacaattattaagtatacatcacagtgttacaatattgttcattattttatacaacagatctctagaactttttttttgttctctgcagttacaagcttttaaaaattttatttttaggccaggcgcagtggctcatgcctgtaatcccagcactttggaaggctgaggcaggtggatcacctgaggttgggagtttgagaccaggctgaccaacatggagaaaccccgtctctactaaaaatacaaaattagccaggcatggtggtgcatgcatgtaatctcatctaccggggatgctgaggcaggagaattgcttgaacccaggaggcagaggttgcagtgagtcaagatggtgccattgcactccagcctgggtaacaagagcgaaactcaaaaaaaaaaaaaaaattaaattgacaaatgtacgtatttagggggtacataatgttgacataaatgtacatatttatggggtatgtagtgatgttttgatacatataatgcatgacaggcttgtccaactcatggctcatgggctacatgtggcccaggatagcttcgaatacagaccaacacaaattcctaaactttcttaaaacatgagattttttttgcaatttttttttttggtagctcatcagctatcattagtggattttcttgttgttgttttatttaatttttttatttaaaaaatacataatttttaatagaaatggggtctcaccatgttgtccaggccattcccaaactcctgagctcaagcagtctgcttgccttggcctcccaaagtgctggattacagatgtgagccaccgtgcctgccctgccgctagtgtattttatgtgtggtccaagacaatttttcttcttccatcgtggcccagggaagccaaaagattggatacccctactgtacagtgatcagatcaggataattagcatatccatcatcttaaacatttataatttctttttgttcggaacgtttgatattctccttctagctatttgaaactgtatattattgttcactatagccttcctaccgtaggataaaggataaagtactagaatttattcctcctgtcttgctgtaattttgtatcctttaacaaatttctccctgtccctccctttcctctacccttcctatcctctgttctgtgttttacttataagttttttagtttccacatgagtgagaacatgtggtgattaactttctgttcctggcttatttcatttaatataatgtcttccagttccatccatattgctgtgaatgagtggattttatttatgtattttctttttttttttttttttttaagtagagatggggtttcaccatgttggccagtctgatcttgaactcctgacttcaagtgatccattcctctcagcctgccaaagggctgggattacaggcatcagtcaccatactcagcccagattttattttttatgactgaggagtattccactgtgtatgtataccatattttctttatccattcctctgttattagatgtcccgtttgtctaacccatatctaggctgtttgaatagcagtaaacatggggatgcagatgtgccttcaacagaatgatttcctttcctctggataaattcctagtagtggaatgctggatcatatggtaattctgtttgtagttatttgaggaaactctgtactgttctgtcttgtggctgtactagtttgtattcccaccaataaagtgtaagtgttcccttttctcctgtccttgtcagcacttgttactttttaaattgaattgtttatctttttccccgtttgcccatttgcccatttttaattggattgtttatctttttcctgttgagatgtttgagttacttgtatattctggatattggccattctttttgataatagccgttttaactggggttagagttgtggttttgatttgcatttccctgatgattagtgctgttgagctttatttatttatttagacagaatcttgctctgttgcccaggctggaatgctgtggcctgatcactgtccactctaagctcaacctcctgggcttaggcaatcctcctacctcaacttcctgagtagctgggactacagatgtgtgccaatgggcccagctaatttttaagagttttttggagagattgggtctcgctatgttgcccaggcttgtctcaaattcctggccttcagcgatctttcagcatcagcctcccaaagtgctgggactacaggtgtgagccaccatgctctgcccttctttgtttttgttttgtgaaagagacaggatctccttgtcacccaggccagaatgcagtagtgcgatcctaactcattataaccttgaactcctggcctcaaggtatcctcccaccttggcctcccgaacgctgggattacaggcatgagcccctggtaatagcacctggcctatttcatttgttttttggccatttttcttcttttgagaaatgtgtctgttcagatcatttgcccattttttaattggatttgttttgctgttgagatgtttgagttacttgtatattctgtatattaatcccctgttggatgagtagtttgcaaatattttctcactttctgtagctcgtctcttcatgatgttaatgggttcttttgctgtgcagtagctttttagtttaatataatcccatttgtttatttttgcttttgatgcctgtgtttttgaggttttacccataaaatattttcccagaccagtgtcctaaaatgtttcccctatgttttcttacagtggtttttatcatttcaaatcttttttttttgagacggagtcttgctctgtcgctcaggctggagtgcagtggcacgatctcggctcactgcaacctccgcctcccaggttcaagcaattctcctgcctcagcctcccgagtagctgggattacaggcgtgcaccaccacgcccggctaatttttgtatttttagtggagacggggtttcaccatgttggtcaggctggtctcgagttcctgacctcatgatcctcctgcctccgcctcccaaagtgctgggattacaggcgtgagcgtgagccaccacgcctggctaaggatttataatagatttaaagcattctgatgggcaaagaaccagggaaaggaaagtcaaaggcagtactgtccaatatgacatgtaattttaaactttctagttgccacattaaaaaagtaaaaataatcgtgtgaaatcagttttgttttttcaattgagacaaggtctcaccacgttgcccaggctggtctcaagctacttgggctcaagcaatcctcccacagtgctgggattacaggtgtgagccaccgtgcctggccaaaatcagttttaatatatttctttaatctaatatatccctaacagtatcaccatgttggtcaagctggtctcgaactcttgacctggtgatccgcccgccttggcctcgcaaagtactgggattacaggcgtgagacaccatgcccggctctcatttcgaatcttacacttaggtctttgatttcttttgagttgatttttgtatagggtgagtgttgggcgtctgcttttattcttctgcatatggatatccatttttcccagcaccatttattgaagagactgtctttttcccaatgagtgtttttggcacttttgtgagaaatccgctggctgtagataggtagattaatttctgggttctctgttttgttccattagtgtatgtatctgtttttaatgctgcaccatgctgttttggttactacagccttgtagtatattttcaggtgttgtattgtgatacctccaactttttgctcagggttgctttggttattcgggggcttttgtggttctgtacaaattttaggatttgtttttccgtgaagaatgtcattggtattttgatagggattgcattggatctgtagattgctttgtgtagtatttctggcactttctcatcttgcctgactgaaactctgtactttagagcaactccctatttccctctcccttcagctcctggcaaccaccagtctaccattttactttctgtctctatgagtttgattatttaagatacctcatgtaagtggaattatgcagtacttgttgttttatgattggcgtatttcacttagcataaagtccccatggttcatccattttgtagcatatgacaggatttctttttttttttttttttttttttgagatggagtctcactctgtcacccaggcaggctggagtgcagtggcgcgatctgggctcactgcaacccccgcctcccaggttcaagtgattcttctgcctcagcctcctaagtagctgggattacaggcatgagccaccacgcctaatttttgtatttttggtagagacggggtttcactacgttggtcagcctggtcttgaactcctgacctcaggtgatcctcccgcctcggcctcccaaagtgctgggattacaggtgtgagccatcatgccaggtccaggatttctttagggctgaataatatccagttgtgtatatgtaccacatttgttgatccatttatctgttgagagacacaagttaattacacgttttggctattgtagtgaatagtgctgcagtggacaagagtatgtaaatatctcttcgagatcctgttttcaatttttttagatatatactgagaagtgggatttctggatcatctggtattccattttaaattttttgaggaacgtccatactgtttttcatagtgattgtactgttttatagtcccaccaacaatgcacaggagttctaattcctccacatccttgccaacacttggttttctgtttttttgttttttgtttttttttgatagaggtaattttaactggtgtgaggtgatacctcagtgtgatttgatgtgagttttgccgatgattagtgatgttgagtagcttttcatattttttttggccatttatgtatcttctttgtaaaaatgtctattcaagtccttagctcattttaaagttgtgttatttgtggtttttgttttgttactgagttgtaggagttttttttttattctggatattaaacccctatccaatacatgatttgcaaatattttctctcattctgtaggttgccttttcactcttccttggtttcattctggttttggttgattgcttgccttgctgcacagaagtttgtaagtttgatgtaattctgtgtctatttttgcctttgttgcctgtgctttttgttttgcagccaagaaatcattgccaaattcagtatcatgaagcttctctatgtttccttctagttttatggtttcaggtcttatgtttaggtctttaatcaatttttagttattttttatttatggtttaagataaggatccatcttcattctgttgcatgtggacatccagtttttccagcactatttgttgaagagattattctttccccattgcgtagtcttggctcatcatttgaccacatacacaggggtttatatctgggctgtctgttctgttccattggtttacatgtctgtatgctagtactattttgatcactgtagctttgtaacaagttttgaaatcagaaagtgtgaagcctacagttttgttcttaatcaaggttgttttggctatttggggtcctttgagattacttactgatttcaggatggctttttctcattttgcaaaaaatgacactgaaatttgatagagattgcattgaatcagtagattactttggatagtatgtacattttaacaatataaggtcttccagtccttgaacatgagatgtctttcccatttgtgtgtttaattttttcctcagttttttgtcatttttagtgtacaagtcttttgcctccttgacgtttatttttaagtattttattttagttttactttatttttttagaaacgggatctcgttctgtcacccaggttggagtgcagtggcgtgatcatggctcactgccacctcccactgctgggctcaagagatcctcctgcctcagccttccgcgtagctgggactacaggcctgcatcaccatgaccagctaacttttaaattttttgtacagatggggtcttgccatcttgcccaagctggtctcgaagtgctggaattacaggtgtgagccactgtgctggccttattcttaagtattattcattttgatgttattataaatggagttattttcttaatttcctttttgtgttgtttattgttaatgtatagaaatgcaacttatttttgtgtgttgactttgtatcctcctgctttgcttagtttattataatagttctaacagtttttttgtgaaacccttagggtttttcatgtataaaatcatgtcttctgtgaatggagataattttacttcttcctttccaatttggatgcctttttttcttgcctcctttttctgattgtactgtgttgagtagaagtggtgagagtggacttcctagtcttgttcctgatcttagagggaaagctttcagtttttcaccattgtaatgtttgctgtggactttttatgtatggtctttattatgttcaggtaatttccttctattccttcctagtttgttgagtgtttttatcatgaaaggtgttgaattttgtcagatgctttttctgcaccagttcagattgttacatgatttttgtccttcattcggttaatgtggtgtattacatttactgatttttgtgtgttgagccatccttgcatcctaggaataaggctccctcagtcatcgtgtatgattttaatatgcctttgaatttggtttggtaacattttttgagaatatgtgcatcaaagtttagaagtgtttcttcagtttttttggtgagactttgaggaggtttggtattaatttttctctaaacgtttggtagaattccccagtgaagctatctggtcctgggctttttttgttgttgggaagtttttaaaattactgagtcagtttccttactagttataggtttgttaagattttctgtttcttcgtgattcagtcctggcaggttgtgtgtttctaataattcatccatttcttctaggttgtctaaattgttggcatgtgatcgttcatagtagtctcttatccttttcatttctgtggcatttgttgtaatgtcccctctttcatttctgattttaattatttgagtcttgtttttttttcttaaatctggctaaggatttgtcaattttattgatcttatttaagatctttttaaatgtaggcatttactgctataaacttccctcttagcacggcttttctgtatcccttaagttttggaatgttctgttttcttcttcatttgtctcaagatgttttctaaactgccttgtgatttcttctttgagtcattagtttttcaaaagtgtgttaaatatttgtgaattttttagttttcctactgcttttgatttcccattgtggtcagaaaagatacttgctatgatttcagtcttcttaaatttgctaagacttgttctgtggcctaacatgtgatctgtcttggagaatgttgcatgtgtacttgagaaaatgtgtattcagctagtgttgggtgtagtgtttttttgtttgtttgtttttgagatggagtttccgctcttgttgcccaggctgcagtgcagtggtgggaactcagcccaccgcaatctgcgcctcctgggttcaagtgattctcctgcctcaccttcccgagtagctgggattataggcatgtgccaccacatctagctaattttgtatttttagtagagacagggtttctccaatttggtcaggctggtcccgaactcctgacctcaggtgatctgcccacttggcctcccaaagctgggattataggcgtgagccactgcgcccggccgggtatagtgttctttatgtgtccgttagttccagttactctccagtgttcaaattctgtgtctcctcattgatccgctctccggtggttctgtccattattgaaagtggggatactgaaatctcctgctgttactgggttactgtctgttttttctttcaattctgtcagtgtttgccttgttatatttgggtgctctggttctgcacttgcacctttacagctgcgcttggctggagaattaacttggctgattggccttaccactaattaccactaagttcaggagagtccttaaaactgcacagcagtagttcctagttcatttattctcccagtgtgacctaaatgatcatttagacctgctccttctcaatccttcaacgtcactttcaccgtctttagcacacaactttgcttttcattttgttgagaaaacagataccacaagaaaaatatctgcaaagctcctgccactactgcctgtgtctgtgcttcatgtattctcacatccctcaattattacggaatgaactgaccatgcttctagccagggccaaaacctgcactgtgctcactcagcccttgcctctacactctgcagggtcattctcctccacaacaacatactgttgtttctctcatcttaaaacacaacaaaacttctctgaactccatttttccttctaaccgttgttcatttcccaccccgaccccttttttccctaaaagaagtatctgcactttgtttccaatttttctcctcctgatatttcaggaggctttccctcccagcaccctgtttcttgcactgctcttgcgaggtcagctctgaccctacctttctcatccttgaattatttgacctagtaacagtatttgacactggtgattacttatttcctgctcgttgaaacactttgttcacttggcttccaggatagcatacaaagaaattccccatctcagtcttttgtcacagagtccctccagggctcagtccttagacctctgttttaactatgctcatttccttgttgatcttatttgacccactggctttgaaaccctctttgttttaaagtttgacggaagtccaaattttaaatctccagcctgagccgcttctttgaaatgcagacttatgttccacctggatgtctaataggcaaatgaaatgcagctttctctaaagggaacttattcttcctccagtaacttaatgggccatgcttagaatggctctttttgtccaagaaaattcaaaaccaaaaccaaatctattttcttctgctttaacatcagtctacagattatttttggtctaaagcatgagatagggctttttatttatttttaatcaggcggctagctagtttcttaacagtattgaataatatatttttaattgtttgaattgtcatctttattgttctgagaataatatcaaggatttaagtgaaattgccatctaatgtttgcattatagatttcatgcccctttaaaacatgtgttatatcaattgagagcacactcttataaagtacaatcaatgataatcaatggattttttaaaaaagaactaaataagttgcataagagcacagaaacaaactttaaatttagcatttaatagaccaggaacaacacaccagtaaagaaaggggtcactaattactgtttggatacttggattttagtttgaaaaataagtaaaatttacatagtaaaaagcaataaagtaaatttaacacggaaagtaacaatggagtatgaaatatatgaccaaactaatggaagtttctgtctaaaataaaagatctatttgtagggtaagtaattagattgggagtaaaaggcagaaatagtaaaatcatcacatgcacaaatgctgtctgtatttaatcccagttaaagacatgggaaataagataaccctaaggctataatgctcacctattaaactgacagaagtatgtaatatgaggaaatagcatgtcttgtttggtcagtgtattagtcgattctcacattgatacaaagaaataccaaagactgggtagtttataaagaaaagagaattaatggactcacagtaatgcaggctatacaggaggcatggctggagaggcctcaggaaacttacaatcatggcagaaggggaagaggaagcaggcctatcttcacatgacagcaggagagacagcaaagaggggaatgccacatgcttccagatctcttgagaactcactatcatgagtacagcaagggggaaatctgcccccccccataatccaatcatctcccagcaggccccacctctaacactcaggatcacagttcaacatgagatttgggtgggaacacagagccaagccatgtcagtcagtatcataaattggttcaaccatagaggaagagaatttgactaaatacatattttagggaaaagggaagtactgtgggctcagcggtttgatcttaaaatttctatgcagtgatggcatactatattcctaatctaactagggtttgtttcaagggaattagggataaggtgagtaagctagtaaacccaaggcaaaatttcttaatgctttttaaaatttaaaaaagaggcccattccgttagagcatacattgaatcaaatgtttcatgtaaaacaggatggaaatgaacttttctatttggctaagtggtgtaggcagaaaaacctataggctttctcttttcatcaacttcatgctgagtcctgtctcattttattatttacacaattgaaatataaaaaattgttcccaaatgatgccccccataccctaagtttagggggcagtagtgtaaagcagtgtccagacattggtcttagggctggagtggaaacagactcctagaggtgcacaagcacatggataattttacctgaatcaatttccaaatcctaaactttaaatgtctcttttttgaagcatttcttcctttgaaccagtgttcaagcggttcttccctttttattttttgatgtggagtttggctcttgtcacccaggttggagttgcaatagtgtgatctcggctcactgtaacctccgcctcctgggttcacgcgactctcctgcttcagcctcctgagtagctgggattacaggtgcctgcaccatgcccggcttatttttgtatttttagtagagatagggtttcatcatattggccaggctggtctcgaactcctgaccttaggcgattcacccacctcagtctcccaaagtgctgggattacagttgtgagccactgcgcccagttctgttttcaaattcctttccaccatggctttttccattattaaaaaaaatggcataactcttcctctgacccttctcttaccatgatgcacttgccttgtagtgggaaaacctcagggatgaaaagggtgtcaggacaattctaagacaccaatggaatagtgctggaagaattagatattcagttgcaaaagaatgcaattagacctttacctcataccataaacaaaaatcaactcaaaatgaatcaaaaacctaaatgtaagagctaaaaccataaaaatcttagaagaaaacataggtataaatcttggtgaccttggattaggcagtgatttcttcaatatgacaacaaagcacaagcaatcagaaaaaagtagataaattaaactttatcaaaattaaaaacctgtgtgcataaaaggacgctgtcgagtgagaaaacaagccatagaatgggagaaaatactgtaaaatatatttgataagcagcttgtgtctagaatacataaagaacacataactggctgggcgccgtggctcacacctgtaattccagcactttgggagactgaggtgggcggatcacttgaggtcaggagttcgagaccagcctggccaacatggtgaaacgccatctctgctagaaatacaaaaattagctgggtgtgatggtgggcacctataatcccagctgcttgggaggctgaggtaggagaattgcttgaacctggaaggcagaggttgcagtgagccaaaatcatgccactgcactccatcctgggtgacagagtgaaaactctgtcttagaaaaaaaaaacaaacaaacacgtaactaacttagaaaaccaaaaatctaatttaaaaacaggcaaaggattcagatagacattactccaaagaagatgtacaaatggctacataagctcatgaaaataatgtcgttagtcattagaaatataaatcaaaggctgggcacggtggctcacgcctgtaatcctagcactttgggaggccgaggagggcagatcatgaggtcaggagatcgagaccatcctggctaacacagcgaaaccccgtctccactaaaaatacaaaaaattagccgggcgtggtggcaggttcctgtagtcccagctactcaagaggctgaagcaggagaatggcgtgaacccaggaggcagagcttgcagtgagccgagatcttgccactgccactgcactccagcctggacgacagagcgagactctgtctccaaaaaaaaaaaaaaaaaaaaaaaaaaatatatatatatatatatatatatatatatatatatatatatatatatcaaaaccacaatgagattctgcttcttacccactaggatgtctataatcaaaaagatagataataacaaatgctggtaaggatatggagaaatgggaacctccagacactatttgtgggaatataaaatcgtgcagctggtctggaaacagattagcagttcctcaaaaagctaaatgttgagtttccatatgatccagcagttccactcctagatatatatccaaaagcattaaaaacatgttcacacaaaaatttgtgcatgaaagtttacagcagcattattcataataggaggaaacaacccaaatgtccaaccgataaatagataaacaaaatgtggtctgtctaggcaatggaatattactcacccatgaaaagaaatgaagtactcactcattttacaacatagatgaattttgaaaacattaatgcaggttgaaagaagtcagtcacaaaatatcgtatgttgtattattcttatttttatgaaaggtccggaaaaggtaagtccacagagaaagtagattagtgataaaaatgtactggaattagtgttgatggttgcacaactttgtgaatatgccgatagctactgaactgcacactttaaaagagtgaattttattatacgtcaattatatctccaaagaatggaataaagcctcaggggcccccaaagtggtgattccaaatattggttttagtgttaagaaaatgaatggccatagcctttggagaacaaatcctttcatggtttttcagttttccacttctaacaaaattgaaggatcaattccaatatttacaaataataaatgtgttagctactaaatcatttaaaatatttctggtggaaaacaactatgtaattttcaacagataactcagaagaaattttaaaagtcatgtgacccaactgacagaattccttttatttccatcacctgtttatatgagcaagccttctcagtgcttgctttttttttttttttgagacaaagtctcgctctgtttcccaggctggagtgcagtggtgcgatctcggctcactgcaagctccgcctcctgggttcaagcaattcttctgcctcagcctcttgagtagctgggactacaggcacgtgccaccatgcctggctaattttttgtatttttagtagagacggggtttcaccatgttggccaggctggtctcaatctcctcacctcgtgatgtccccgcctcggcctcccaaagtgctgggattacaggcgtgagccaccgcacccagccctcagtgctttcttgaaacacacgcacagaaaagtagaaattcactaagtgatgtctgattttagcaataattattcaaagagatacatgaactaatgaagaaaaaaaaaaagccctgtccatctcattaagagacgtacatttccagtaatttttctttccttctttacttccttcctccctccctccctccctccctcccttccttccttccttccttccctccctccctccctcttgctctgttgcccaggctggagtgcagtggtgcactattttggctcactgcaacctctgcccctgggttcaagcatttctcccatgtcagccttcccgagtagctgggactacagatgtgtgccaccatgcctggcttttttttttttgctagagatgggggtttcaccacgttggccaggctggtctcaaactcctgacctcaagtgatcgcctgctttggcctcccggaagtgctgggattataggcgtgagccactgttcccagcctccagtagaatttttacctttaatgttgttaattactgtcagatcttttttttttttttttttttttttagatggactcttactctgttgctaggctggagtgctgtggcatgatctctgctcactgcaacctccaactccctggttcaagcaattctcctacctcagcctcccgagtagctgggattacgggcacacgccaccatgcctagctaatttttgtatttttagtagagatgggtttcaccatgttagccaggatggtcttgatctcctgacattgtggtccgcttgcctcagcttcccagagtgctgggattacaggcatgagccagcatgcctggcctactgtcagatctttaatgtttgccatttaaatgaattgcatactgctaaaaattataatggtaattgaattcaaaataattttttaaacacttagaagcttctttatggtcaggaaatttaaaatgtttttcatttaaacatcagacaggctgggtgcagtggctcaaacctgtaatcccatcactttgggaggccaaggcaggaggattgcttgagtccaggagtttgaaaccaaccagggcaacatagggagaatctgtctctataaaacaaacaaacaaacagaacttcagacatgtatgactgagtgactaataagacttccaagcattagcaattactatatgcagggcaaatgtactggaaatatgaattcaaggaggaaaatatgctgtgaaaatttcactttaaaatggatcatgatgggtatcagatcacaattgtatttggattctgttgaagagatttaaggttgatattacagtgaccttgctaaattatattgctgttctgtgctctgtttccctatatataaatgggataataatagcacctatatcaaggagtaatttattattatgtctagtgcagcttcttggcaaatactctgttcagtgattcacattctgtttaatagcccactgctttgtttctttctggtaagtcttctgccttaatgcagtcttctctagctactatgtgtccttttttcatcctcctgatctatacccccccccaccccccgccaccccacacacacatggtggtgtggacaaggcaaaaaagaaagttagctggatttatgtttcggaatttcagggctttgtatttacagttgacttgttaggagaagaggaagaagaattaaaaagtatagcattgggccagaatatcattaagcagtaagatcacattgagttgtatagggaagggtacctgtatttttatttcatctgtactggagacaggatttctgatgacacgcttgctcactgacagtttttttttttttttgagatggagtttcgctgttgttgcccaggctggagtgcaatggcgtgatctcggctctctgcaacctctgcctcccggattcaagcgattctcctgtctcagcctcccgagtagctgggattacaggtgcatgccaccacgcctagctaatttttgtatttttagtagagacagggtttcatcatattgatcaggctggtctcaggtgatctgcctgcctcggcctcccaaagtgctgggattacaggtgagccactgcgccaggcctgacagatagtttttttagatggtgtaagacagtgtcaattatgtagtgtagttggtatattttctgttgttactgtaacaaattaccatacttttagtggtttatagagcacaaatttattatcttatggttctgcaggtcagaagtccaacacaggtctcactaggctaagatgcaggtgtctacagggccgtgttcctttcgggaagttctaaggaagtatggattctgtgcctcttacagcctctagaggctggctgcattcctggatcaggctccccttcctgttcaccttcacagtcagcaaggtgacatggctctgacctcctgtcatctctttcccaccgtacttgggagaagttctctgcttttaaggaccatgtgagtagattggtcccaacaagctcatccaggataatcgccccatctcaggttttggacccttagtcacacatctgcaaagtcccttttgccatttaaataacatattcataggttacagggattaggatgtgaatgtctgcaggggccattatcctgctaccacagttggtttttagtcagctacataattttgaactgttaattttatctattttttttttatgacagttgtggttagaggtgaggcttggattggtcctggcctgaatcttgttctgctgtgtagcagcactgtgacgttaggcaagtttcttctctgtacttgtttcttctttggtgaaatcaagatagtaatgcttgtctgtatgtactgaaataaagtaatagtttagggttctagatgggaggcaagagatttctaccaatctttttgtgtctgtctcaaataagcaaatatgtgatcacctaactcacaaggttgttgtgaagatcaaattaagtcatcaagttagagtgccttttgaaatgtataaaaagtatataacattttgttggtattaattttagaatggcttttaagatttttgtcaaaggtgagaacgttcagtacattctttgatacctgcctagcaactatttttaggtttctattcctttccagattttcagattcacatatttcctttattaaattatggtaaatgaaaagataatatgagaattaaaagtaatgacttctgtgattcgtatagtcactaggatttaaaattcaaatttatctatatctatatctatagatatagatatatagatatagatatagttttttttttttagatagagagtttcgctcttgtttcccaggatggagtgcaatggtgccatcttgactcaccgcacactccacctccttggttcaagcagttctcctgcctcagcctcccgagtagctgggattacaggcatgcaccaccacaactagctaattttgtatttttagtagagatggggtttctccatgttggtcaggctggtcttgaactcccgacctcaggtgatctgcctgcttctgcctcccaaagtgctgggattataggggtgagccaccactcctggcctatctagataatttttaatctttatttttttttttctgtagacttatttggagctatactatatgtgttgtagaagcaaaataaatactaagtctaccttgcattagtaagactgatttttcttaaatcctgagctacatttaaaatcttggttagtagacattttactcagatagtgattcatttataattggcttgtctaagtactcagtgtttgacaaaaatatcactatgttaagcaaaaaccatatttaaaaagtgatttgttttttttttttcctaacgctgtaacagtgaatagatctttttcccctaagcagcacaaagatgccattttgggaggttaaattactttctaaaagttgctgtgaaggagagaaggaaaagagatcaggttacacattctttgttcctgagcctaccactgcacacgttcagagaagcaatagtgaggctagagtatgcatttgccactatgtcttcaacccttccccatagtagggagggagggaattaggcagttttcctaacagggccccgaagagtaccattttaacttaaatactcttaaaagttgctacttattttttttaaggctttctttacttttttataatttagcatttcaagtaatccaaatagttatttctttgtatattcagaggtatttaaaaatattttctttgagagcttaaaggttatagtttaataatgcagttaaacatcaatttatctcaaattgatattgagttaaatttaaagagtattttaaattatattttgaggggaaaaaaataactttcttggcacaaaatggccatgaattagattgtgtgtttcagaaaggtagtggtaaaaagtccccaaagcagttacaatatttcttttgttctgtttccttgctactcttagataaatgaagagtttgaaaagaattttcacataaaaacgtcataaaatcccagtgccatattctgaatattaatttgactgttttatgtcgtatttttttcccagttggttttagttagaatatatgcttttttttaagcctttaaggaattaaacaattttggttattaaagtttaaatgtatttcataaatatgtatttataaatatgtgactggtcccttttctgaggggttaggaagtttaagcattatttgtaagctatttgtaaatccctgtcaaacattatttgtccattaagaaatactatttttttcttcacttttaggtcattttaagtattaataatgttcatcaatttacttactacccttctgaagaaagtcactataattagtaatcagaattatatcacataaatttaggcacatttatttatttatttatttatttatttatttatttatttttagtattttgagagtaggtgctgtattttcttttctttccttgtttcttcttttttgttttttgagacagaatctctctctgttgcccaggctggagtacagtggcatgatctcagttcactgcaacttccccctcctaggctctagcagtgcttccacctcagcctcccaagtagctgggaccagctcacgctaccactccagctaatttttgtattttttgtagagacagggttttgccatgtcaccgagactgagttactgtattttcttagcagaatattgtcccagtgagctttttccaaaagagaaaaggtacagccaataaaagtttgtggttgggtattgggagttggtgttgttctgttttgtcctgttcataaaagttttattctctttagctctcatgctttagttctaatttattcacagatttttgcccagtaacttgattttatacttggctttctatattgtggctccaatttttcttcccagtttatactcttatttttcctttctttttcttttcttttcttttttttttttttttgagacagtcttgctctgtcgcccaggctggagtgcagtggcgcgatctctgctcactgcagcctccgcctcccaagttcaagcaattctcctgcctcagcctccagagcagctgggattacaggcgcctgccaccaagcccggctaatttttttttttttttttgagacggagtcttgctctgttgtctgggctggagtgtagtggcccaatctcggttcactgcaacctccacctcctgggttcaagtgattctcctgcctcagcctcctgagtagctgggattacaggcgcccaccactatgtccagctaattttttgtatttttagtagagatggggtttcgcagtgttggttgggctggtcttggaactcctggcctcgtgattcgcccacttcggcctccctgagtgttgggattacaggcatgaactactgcgcccagccaatttttgtatttttagtagagacgaggtttcaccacgttggccagcctggtcttgaactcctgacctcaagtgatccgcccacctcagcctcccaaagtgctggggattacaggcgtgagccaccgtgcccggccagaatttgaactttaattcttcaaattgtatagcattttcaggtaccatcgagggcttttcttctgtacttctgtgtgttcaaatatggaccttgttccaaaaaggtccaaaaaggttgagttgtggttccctgtaatgtcaagaaatctgttaatgcatgagacccggaagatgtttgaaagtgactagtgagaattgggttggttgctgtaggatattgtcatttaaattattaagtgaatatatttatatatttaaaaattagatgtaggtaagcctcagaaatgggaaaatggagataaatcttaggagagatttttgaatcttttacttaagactgtgttcaaaactttgtctatttgctatttattattttgatatattaattgctagtgagattaagacatttttgacacatcctcttcatttaaggtcatggatgttttgtatcattcttatataagcatatttgtaagacttttagaggtattccttttttagtcctatttttttttactagggaattatgactcattttggcacttagcttttgtagcttactaccgtatgacattttatatctttgcaaaaaccaagtaattagaccattcatcacaatttccatacttaaaaaactaatactaagtttttacatgttatcaataaaagtagcattttaacaattatcctttccacattatttgataaatgctattggttttgtctgttatttttataaatatataatttgctttaattacttaaatgttccttgagccttagaacttaaatcctgatgagggttttactttttaaaatactgaagtttattatttatgcatgttttacagaaaaatgagtggcttttaaaagatcaaaattaaaggcttaaacatggaatctctaggacatataaaatatgagtagaactgtgtatttataagatgttaatgtaagacttcaggccttgtaatatcttaaaggaaccacttcactgtaagggagcagtttgtctttctacctttccaattgtattgagattttgcccagtatgtctttttacttaaacaccttggtgaaagctatccagcatcctgttttaaatctcctttgttgcacttaccataattactttcagatctgtttccattctcagaaactgaaactgtaagctcatgtgagtggggaatccgacttgttttattgcatgtgagctgagcactgtgccttgtgtcagtagtcagtggtgttcctttagtccttgttatgttaataaaaaagctttggtttttgcaagactttgtttttagagattctggaaaggaacatattaaccaaaaagaagagctgacttcaattttacttgtcttgaaaataactgactactaaagggatgtcagggaacattagtgaaaatggagaacttaaggagttaaagttttagctgtttttttcaaaggatattgtccttcaaaatctttaccttgcatttttgttactgtgatttaagatggttgtaattatcattgattgatgatacctatcaaaaggcaaccctaaccaaccatttctgctggattctgaatgccgagaaagaaaaactgagaaatttgtgaactattacaagtcgtctgtaaaatgagataataatatcaacttcacaaggtaatttaggctttcgtgaaaactagagtgtgaaaatgcttagtaatgtgctgggcacactgcaggtgctctacaaataactactgataactactttttttcatgagtaattgtacattttctttcttccttcctttcttccttccttccttccttccttccttccttccttcctttcttttcttttcttttcttttctttcttttctttctttctttttttgttttcttttgttttgagacaagatcttgctctgttgcccaagctggagtgaagtggtgtgatcttggatcactgcaacctctgcctcttgggctcaagtgatcctccctccttatcctcctgagtagctgggacaacaggcgcacatcgtcacacccagctaatttttgtatttttgtagagatggggcttcacttggtgttgaattcctgggctcaagcgatccacccacttcgacctcccagcgtgctgtgattacaagagtaattgtaaatttaaaatgaatttctttcccatcccaaaccagtatcaaaatgcaaatatagtaaattactttttaaaagagagatgtttaatggcagttgttggtagtcttttgagtctttaagtgggtatattatagaaaaacaacatatctctgcttggagggaagatttaactaaaaacaagaaaaagaatagtagatgaaccatgattctttaacatacaggttgcaaactagtgacctgtcagttggatttggcctgtaggcatgtttttggcttataatgtaattttttaaaaattagtggccaacaattaaaaattgggagagttttcaaaagaaaatgcagatttctgactcatcttgaaaaatggtaagatgggcagcacagggcctgtattcccaattgcagccctcagtggagctaagtaggctgttctccctgccatctgcccggctctcagttgccatcactcactgcatttggactctttcttcatatagtgagccgaggggggagtgatagtctcatgttcctatcaaaagagggaaacctaaaataaggccatttttgtttttgtttttgttttgtgagacggagtttcgctcttgttgcccaggctggagtgcaatgtgaaatcggctcaccgcaacctccgcctcccaggttcaagcgattcttctgcctcagtctcccaagtagctgggattacaggcttccgccaccatgcccagctaatttttgtattttttagtagagacgggatttcaccatgttggccaggttggtcttgaactcctgagctcaagtgatccacccgcctcggcctcccaaagtgctgggattacaggcatgagccaccacacctggccaggcgatttgtgttttaagaaaaacaagaaagcatgtaattctttgcgaaaataatgaacatttctatttatatctgtcaaaagtcctgtttcttaggagttaagacataattcatagcaattaatatatgtggagaagatacgtaatgaaaaactaactagaagaggaattcagacattgaaagggattattttaaagtgagaataaaattagtagtgccgctgtgaggaaaataatcttcacgtacttacgtatgatgagaaacttcctaagtgtctagagatggcaagaaactttgtatgttttgcatgacagtaattgtaaatatgagcttatctggaaatattgtttgcatagatgttaaaaatatgggcaggacaatgtgtactaaaatgctgaattctagtgaggctgacataagcttattttttaaattctttaatttttgtttttatatattttttgagacagggtctcattctgtcacccaggctggagtgcagtggtgctatcacgggctcactggagccttgacctccccacgctcaggtgatcctcccacctcagcctcctgagtagttggtggcgtgcgccaccatgcccaactgatagtttgtattttttgtaaagatgaggtttcactgtgttgctcaggctggtcttgaactcctgggcccactcaagccatccacccaccttggtctctgaaagttctgggattacgggtgtgagccactgtgcccagcctgatagaagcttagagattaatatcacctagttagctctgtttgtgtatggtatctgtgtgaattttgactgtttctcccctctcttctttagtcattacccctgtttttggttcattcctatcagtaaacaatctctggtagagacttggtaagaaaactcaaccattcccttaaaaaaagtcagcctctaccccttccttagccagatgcttcagggatggtctgcttgcaacacttcctgtccttcaccttctttcaactgtttaacctgccttattcttttttttgtgagacggagtcttgctctgtctcccaggctggagtgcagtggcgcatgttggctcactgcaagctctgcctcccgggttcacgccattctcctgcctcagactcccgagtagcttggactacaggcacccgccaccatgcccggctaattttttgtacttttttagtagagacggagtttcatcatgttagccaggatggtctcgatctcctgaccttgtgatctgcccccctccgccttccaaagtgctgggattacaggtgtgagccaccgccccccacccttgcctgattcttattctcttgtccaccacagtttgcattcctcaggccatttttgtctgcgtcgttgagggcctccattgtccagccccatctcctttactctctcagtagcatttggcacagctggctctcctgtgccaaactcttagccgctgtgacacaactctgcatatagccttccacctctttcagcacagtccagatggtggtgagggacgctccagatcagggctgaggatggtgtcttgttggcttctgcccttaccctgaatcccttaagccctgtgtacagtgagtatcataattctggccttatatactgtaccctacattttgggctaatttatgaaaggataaaaaataggacttggaaagtaaaaataacccatgttaaagaatctgaactacattagtactttttgcctctatactgcacatacaaatgcttgaatgactatgatgtaaaggaaagggagaagaaactaaaaatttgacgtgggatgtcacattcaaataagcagttttttcccctttagaacatttgcttataacctaggtcatttaaccagttgaggttcaagtagctctcagatcagctggtgcaagcttgagggagaaaaaaaaaaaaccatccttacagatacttctcattcattaacctcgaatgttagctttaatcagtttaggaatttgtatgcattttagtaactcaacaccaacttgtcagaagttagctgaattttagataatttctttcattccagccaaaaataataatcacagacatgtttaaaaaaaaaaaaggagttaattgggaggctgaggcaggaggattgcttgagcccaggagttggagacctgcgtggacaacgtagtgagactccatgtctccaaaaaagacaaagattagccaggcattgtgatacatggctgtggccctatctagggatctgcactctagcctgggcgacagagcaagacccggtctcaaaaaaaaaaaaaaaaaaaagaccctaagcctttttttactgcatatattcctatccattctaggaaaagtcagttgtcaaatcaaagtgaaaaattgttttctttaaagtgaagtcagatgggtagaataaaatatactgatgttactgccatagtcacaattctaaagcacaacataattgtaataatgtcacaagcttaccaaggttgctacatgaaacagaagaaaattaaatttggtgttatttatttttataaagagacagcatctcactttgttgcccaggctgatctcaaactcctggcttcaagcagtccttggcttccacagtgttggaattccaggcatgagccaccctgcctggccattattatctttaataacaatttacatcagccacatttttctttatggtttttacttttgatgtcaaacttagacatttttttccccattacagtagtgttttccagttcttttatagttttacattttatatttgaacgttttatttatctggaattagttttgttgcataacgtaaggatccgacttaattttttcccaaatcgttggcaaattctttcaccactctttattgatttgagatgttacttttattatattctcatatatatttggatctacttttggtcttttgtgacctatctcttgacagtggaatcacactgtttatatcagtatagctttgggtacattttaatacttggtaaagcaaatttttctgactttttcaaaagtcgaggatatttgtttatttttccaactgtctttagaaatgttttatctgattctactgaaaagtctgctaatattcattgactgattgatttgatttggagaggactaccatctttacagtatatagtttactaattaataaattcgcgtttcatctttcacaagtcttcttttttgactttcagtaaagttttgtagtttttctcatgtgttatatttttgggtgctattgtgaatgatactatttttccactatattttctaaccagttttgttaatacatacacagcttactaatttttattaaatcattcaacatatttaacttctttttctaataattttcagtttattctcataggggatttaaaatatatcatctttaaataataataactttgctaaatcagttttaatatattcacaattgggacttagtaatatatgggtttggttagtagttttgtatcacatagttttcttttattttgagacagagtcttgttctgtcgcccaggctgaagtgcagtggcgcgatcctggctcactgcaactccacctcgtgggttcaagtgattctcctgcctcagtctccctggtagctgggactacaggcacccaccaccacacccggctaatttttatatttttagcagagatggggtttcgccatctcctgatctcaaactcatgatctcaagtgatccacccacctaggcctcccaaagtgctgggattacaggcatgagccactgagcccagccacacatgattttctttatagaccctatttacaaatttatggtctgaggtactggggattaggactttaatatatgaatttaattcatttattaagtgcaagattggtgcaaggttggtgtttgatgatttcctcagtctttattttgtgaccaccagtgaataacccaagtatttgtgtttttaaacacctttatttggtcaagtatgtctcatgtctataaaaagttttgaatttattttagcttaatgtttgtaggtgttttttttttttttttttttttgctattctaattattttatttgtttgtgtgggtttagaatagcagaaatttattgtctcccaattctagaggctgtacttccaaaatcaagggatccaaaataggagtgtccgcagagccatgctccctttaaaggtaccagggaaggatctgcttctggcctccttcctaactcccggtagcctcaggcgttccttgggtttcagatggcagttttatccctgtctctccccacatgtctgtggtttcatatctagatgtctccctttttataaggatggtatagtcatataggattaggccctaccctgataatctcattttaacttgattacctctgtaaagaccctatttacaaatttatggtctgaggtactggtggttagaacttgaatatatgaatttaattcatttttattattttgaaatcatttcatacttagaaaagatgtaggaataccattgtgaatgcccataatcttcatacccacattcaccagtttttaacattttcccatatttgcattataattctctgtttctgtctcttcactcctacctgtacacacacacacacacacacacacacacttttaagagtgaggttgtatatattatgcccctttacccttactatttcagtttccttttttttttttttttttgagacggagtctcgctctgtcgcccagcctggagtgcagtggcaggatcttggctcactgcaacctccacctccccagttcaagcaattctcctgcctcagcctcccgagtagctaggactacaggcgcgtgccaccacgctgggctaattttttgtatttttagtagagacggggttttgccatgttagccaggatggtctcgatcttctgacctcatgatccacctgcctcggcctcccaaaatgctgggattacaggtatgagctactgtgcccagccttcagctttcattttctaaggacatggatattctgtgtaatcattcttcagttatcaaattcagggagtttaacattgaggcggcactttgatctgcagtctgtattccagttttgtcagttggcccaactgaggtgttttttttttttttttaaagcatttttcccttccagtggaggattcaatctggagtcacatattgcatttggttgtcctgcctctttaatctccttctctctgaagcagttccttagccacctgttgtgtttcatgacatcaacatttttgaagaacaccaggccagttattttctagaatattcctcactttgggcttggcattttctcattattagattcaggtgatgcatctctggccagaagtctacataaatgacgacgtgtccttctagggtatcagaagcatactatgtctgtcctacctgtcattggtcatgttaattttgattacctggtcaaggtgttttccagtttctcttctctataattactgttttccctcttgtaactagtaagcagtctgtggggagaaacttcaagaccacacaaatttcttattcctcataaaattcactgctcccctgcagatttaattggtcttgactatttatagttgtagaatggtgatttttccactttcatcactagttctacatttatcattctgaattctgtaagaacccttcttactcccttatgtatgtatttgatttatctatttagttgtcatcactatggagtgatagactccatttcgttcaatgagttatagtccttatggatttttttcatcagggtctcactcctgttgcccagactacagtgtggtggtgcgatcacagctctctacagccttcacctcccagactcagttgatcctcccatctcagcctcccaagtagctggaactacaggtgcacaccaccaaacctgacgaaatttttttttttaaagtataaatgggggtttcaccatgttggccaggcttgatactcctgggctcaagggatctgcctgtgtcggcctcccaaagtcctgggattacaggcatgagccactgtacctgaccagcccttatgttttctgaggttcatgttgtcccagattttgatagcgggagtctcttcattccggctctcgtgtcctttggatatggccttgtcattttttcttccctttaaaaaaaaataaagagcacttctttatgccatagtgatgttccaggcttctataggaccttctttgccccatccccagaatcagtcatgtctctaaggagccctggtttctgttagtgggattcaatatatagaaaccaagatctgggtcttaggtgttctcattgatactggggtgtcattggttctagccactttcaacaaatgtatctaggaaatagactattattttttaacatactatctttaaaatcatttttagtttatactaatacttctaattctaaaccaacccctcaggatttttttggcctttccccagtccatttcattctaatttcatttccagtttatttttaatttaaaaaaattgaagtataatttatggatttgtgtatttagtgaaatgcatagttcttttttgacttacttgtttatctgacacagaatctctctctctcatccaggctggagtgcagtgacatgatcatagctcattgtagccttgaacttctaggctcaagcggtcctcctgcctcagcctcctgagtagctggggttacagatgtatgccaccatgcctggcagatttttaaattttttgtgtagagacagagtcttgctatgttggctagtctggtcttgaattcctggcctcaagcaattctcctacctcagtctcccaaagagctgggattacaggcatatgccaccatgcccagtccccatctttcttatgtattccgtttaatctgttttgacagtgcatacgcttctgtaatctctatcaagatactgttctatagttgtggttttttttccttttgagacggagttgcactctgttgcccaggctggagtgcagtggcactgtcttggctcactgcaacctctgcctcctgaattcaagcagttttcctgctttagcctccctacaagctgggattacaggcgcacacctccatgcccggctaatttttgtatttttagtagagacggggtttcaccatgttggtcaggctggtcttgaattcttgacctcaggcaatccacccacctcagcagaactcatttgggcctgttgttttctgttttggaaggttactgcttactgatgcaatatctttaatagatataggcctatttggattatctatatcttcttgtgtgagttttggcatattgtgtcttttaaggaattgatccatgtcatctaaattatcaaatttttaatcatgtttgttcataatattcctttataatccttttaatgtacatttagaagggatctgtagtgatcttttttttcatttctgatactagctatttgtgtcatctttttaattaattggcttagctaaaggcttatcaattttatgatcttttcaaagaaccagcttttagtttttcttactgatttcctattttcagtatcattgatactattatatttttatttcttttattccacttactttggatttaatttgctctttgttttctattttccaaaggtggaactgtgagctttggtccattcaacttatttcatgtaacgtcaattcaccgaaagagttaagagatttgaagcaatggcctgagtttgaatcctagttctccactcattgacaaaccacttgtcctgtctgaaccctatctcccataaaatggaagaaggatattacttaagttatgagattgcttgaaattcagttacaatgtgggtgaaaactgattttaaactgtgaagtgctacagttttgatattatcacttccttaaatgtacaaagattatttctttacaatcaccattggaattttgcctcaatttatggtcaaactttgtctggttttcagtttccagaatttccatctctcacctgctacccaaatcaggatggctaccaaacctgcccatcttcagtaatctttcgtttctctgattcatcacaggttacttatagggatccagttatcttccctgaatgtttctcagtatttgaattgtaaattataatcctgtcttggaacaaaagaacttgaactcatattgagtcctgtgctcacctatctgttttgatcttcttttattatgagtcgttcattcattgtgaaaaatctcatttcagtgatagggaaggcaaaaaaaatcagtctcctgacttttttcctctcctgttttattaaaattataaaatatgcataacataaaatttaccatcttaaccattttaaagtatacaattccagttgcattaagtatatttacagtgtcatggaattatcactactatgtattttcagaactttttcatcatcccaaacaggcccccctcccttttttttttgagacagggtctcactctgtcacccaggctggagtgcagtggcacaatcatagctcactgcaacctccacttcccatgctcaagcgattctcccacctcagcttctcaagtagccgggactacaggtgcgtgccatcacacctagctaatttttgtatttttattttgccgagatgcggttttgccatgttgcccagtctggtcttgaattcctgggctcaagtgatcctcctgcctcagtcttccaaagtccggggattacaggagtaaggcaccacacccgacctctttttttttttttttttctcttttttctttttttaagagacagggtcttattctgtcgtctaggcctcagctcctggcctcaagcgatcctctcccctcagcctccccaagtattgggattgcaggtgtgagccaggacgcctacccgcaaacagaaactctttacccattaaacaataactctgtagtattccttccttcctgcccctggtaaccactatagtactttctgtctaatatgaatttgcctgttcgaggtgcctcatataggtggaattgcatatttgtgcctggcatatttcatttagcacattttttcaaggctcatccatatagcacgtatcagtacttcatttcttttagttgctgaatattattattattattatttttgagacagagtctcactctgtctcttaggctagagtgcagtagcatgatctcggctcactgcaacctccgcctcccgggttcaagcgattcttgtgtctcagcttcccgagtagctgagattacaggcgcccaccaccacgcccgactaatttttgtattattattattttttagtagagacagggtttcaccatgttggccaggctggtcttgaactactgacctcaggtgatccacccgcctcagtctcccaaagtgctgggattacaggcgtgagccaacacgcctggctgctgaatattattttattgtgtagagtaatgtattcattcgttggttgataaggcatttgggttattttcaccttttggctgttgttccagataatgctgctatgagcatatttgtacaggtttttgtgtggaaatatgtttttgtttctcttcggtatataggaaaagaattacagaatcaactctgtgcttaaccatttgaagaactggttttcttttccaaaatggctgcaccatttacagccctgccagcaggttataaaagttccagcttctctgcatccttggcaacatttgttattatttttttattatagccactcaggtgggtctgaagtattttgtcgtgttttttatttgtgtttccttgttactgatatcgttcagcatatttccatgtgcttattgctcatatgcatatgttctttggagaactgtctgagattctttgctcatttttaactgggttatttctctttttattgttgaatttcaatggttctttatatattccagatacaagtccttatcagttacatgatttacaaaaattttctaccattcccattccttgagttgtcttttcactttcttgatggtgccctttgaagcacaacatttgtgtgtgtgtgtgtgtgtatttttagtagagatggggttttgccatgttggtcgggcgggtcttaaactcctgatctcaggtgatccacccaccttgccggtgaaccaccacagcacccggcccgtttttggtttttttgtttgtttgttttttgagccagagtattgctctgttgccctggctggagtgccgtagtgccatcttggttcacggcaacatctggctcccgggttcaagtgattcttctgcctcagcctcccgagtagctgggattacaggtacacaccaccacaccctgctaatttttatatttttggtagagacagagttttgccatgttcctcaggctggtctcaaactcctgaattcaagtgatccacccgcctcagcctcccaaagtgctgggattacaggcgtgagccaccactcccggccagaagcacaatttttaatttttatgatgttcagtttatatttgtttttccctttgttgcttgtatttttgtgtgtcttaatatgtcttctaagtctgttttaatggatggattctccccttcctgcctctcatttatctgttgaagaattttgcctatttgacctgtagagtttcctatggtctggatttttctaattatgttcccatggtacagttcagcttctctctgtctctgtatttcctgcaaattggcagctacaccaagaggtgtgatcagattctgatgttcaagggcttttgtctatcttacaggcagtcagtatgctattatattaggagacacacaatgtgtggttgtgtctctgtgatattattttagtagctttgatgctgaatgctgattaggtcttcattggggtttgcaaatgtatgatagtctaattctgttatcatttgttagctgacaaacttttgtttaaattttattttaaaaattaataaaagcagggacaggaggatcgcttgagcccaggaattgaagaccaccctggtcaacatagtgagacatcatttgtacaaaaaattagaaaaattagccaggcgtggtggtgtcaacctgtagtcctggctgttcgggaggctgagatgagaggattgtttgagcccaggaatttgagggttgtggtaagctctgagcatgccactgctctccagggcaaaaaagaaaaaaaaaaaccctaaaaatagagcttttggggatatacagttctatgaattttaacacatctatagatataacaaactacaagtcattatacagagcagttcagtcaccggaaaacctcctgctatccctttgcagtcacacccctacttcaccccaactctggaaaccagcaacctgtttcctgtcactctagttttgtctttttgaagtaccctcttgagactgtgttatttagcattatgccttttgagggtcatccaggttgttgcatgtgtgaagagtgttgtccctttctgtggttgattatcattccattggatggatgtgccagttttttattcgttcacttttagaaggacttacgtgttgtgtccagtttttggcgatgatgaatagagctgctctatacattcatgtatacatttcttgcttgcacataggttacatttcaccagctaagtacctaggaatgggattaccagcatattcctacagtgctgtatgccttttagttctccagggaataggaaagacaagatacatgcttgttctctccttttactggcagtttttaaaaacagactgtttcttagagcattttcaggttcacagcaaaattgaagaagtacgaagagttcccatatccccccaatccacatgtacatagcctgccccactctcaacatcccccactagagtggcacattgtttccaattgatgaacctatgttgacatgtccttattacgcaaagtctttaggcttcattagggttcactcttggtgttgtacattatatgggttatattatatattaaatgcagagtgatgtctattcaccattatggtatcatagagaatagtttcactgccctataaatcctctgtgctttctgcctatttatcgctccctcctctcaacccctggcactgatctttttactgtcttcatagttttgctgtttccagaaatgtcatatagttggaattgtaacaattttaaaaataatgaatttggttccctatcttctctgaaggtgattttctttcctttttgttttttgaattgttatgaactcatttgttggggttcagtccattgtaattcttacacctgttaaagctcaaattgttcgtttttggccaagggcagcctcttctggtaggcttctgagtccttctaaagtgactcatagtctgtgatttgtcccctcactaccttataaaatgagactttccgggaacatcttttacaatttctgcctcacacctggaatatctccaagaagccttgggtttttttcagtgggaaatggtatttcaaaaccactgccaggactgttggggtgttctaatgcttattgctactgagttagtcttcgtttctaattctaagtggatagtgctgggaggtactaccctcggaatcctggttttcaaggacataggtgtggtagaatatttgataattactcgtttattttgtcacatattatgtctctgacagttacaaaacaacaatactaatatatccaccatgggttgaaaccagttaaaaccattctttgcatgcgctctccatttccccccattccctgtgcagttgtcttccatatatcaccagggcatgttgccattagaacgcacacccattatgcgcccttgtattctgttcctcttcgtccctgtgtagtcgacaggtaactatttagcgctcacctctattcctatgtcagtatccctctatctacatgggttctctcaaactcattttctagtagatatctctagaagggcttatgggaacaatattccctgagtttttgtatgttgataatatgtataatgtttatactcgaaagttctactggccataaaattcttggctttcattttccttccttgagtattttattttctggtataatatgttgctttggaaagtttgttgttaatgtagtttttttcccttataaattacttgatgtttttgcctagatgctcaagtttattttttccttaaaaatcctgcaattttactatatcttggtattgattattttggcccagtattttccagtatgcaatgtgtgccttaaatatgtagtttctaatttttttctggtgtcctggcatgtcatccaggctggcctctaattcctgggctcaagtgatcctctcgcctcagcttccccaatgctgagagtatgggctgcattagctcttttttcttaattttggcaaaaatttcttggattacagtttttagtgttgcttgttctcctgcttttgctttctccagggattcctgttatataagaaataggaacaatttttgttgctttctttagaatcctattatttcatcatttcgtttttggtttttagaattatcttccttcttactttcaatttctcgaaggcattatctgtaatattcattcttgtgttccttgggttttattcttcatttctcaaataaatttttaaatttctaattacttactgagtcatgttctcacatttctgagtttcttctgttctgatgttgtttttcatgctttatataattttcttaatgtttttagctcattttgaaatactaatagtaggttctaattttaatctcctttgtgtttctggccttctagcatgatgtatttgtctgtaaggaggatgttgttttgttgttttgttcccgattccttcactgtttttttttgtttgtttgtttttttgagacggagtcttactctgtcgcctgggctggagcgcagtggtgctatctcggctctctacaacctctgcctcctgagttcaggcaattcttctgcctcagcctcccgagtagctgggactataggtgcgcgccaccatgctcggctaatttttgtatttttagtagagacagggtttcaccatattggccaggcttgtcttgaactcctgacctcgtggtctgccgcctcggcctcccaaagtactgggattacaggcgtgagctaccatgcctagccccttccccattttcttataataacttctatgagatttggatctgaaaactttgccatgggtcagttttattggaagttcattttcctgaatgtttggaagaaagcctagtgactcaggatagcatttctaatttcacagagttatttttccgttatgaaacacagattgcctttgaggtctcctgtttctactactgcccctcacttttatgtgggcctcctctttcctttgtttctggagaaccttttcctgttcaattctgttttaattttcagcagttttttttctgtgtgagtgaggctgtttcctagcagggaggtctggttggtcattttcaagttcatcagggcttcatcagggcttgtccacttcaacccttacgctataggccctttgcaccatctgcatcttcaaatgtgcccactgttcgttccaatgaagacttgtttgttatttggcttgtagagggacatggaagaagcaaatcagtctttacctctctcaaggctggagatttgcaggcactggttttatctgtaactggagatgagagttcaggccaaacactggtttaaaaatctgtatatgaaatagcgataccctggaatctaggactgagatcctgtgcctcacacccacccacgcggccaagtgcctacctgtggcagtgacttcttagtgctcgtccacatctaggtcttctttagtcccaggctgatgggaacatttaattcctttgctccttgatgttagatgggatcaggtgactgatgctggccagtggactttgagggaggttgtgttacttctgagttggcatagtgaaaagcccatgaagatgctctgctctctttcttgcctaggatatccctggtcataggattcatttgatgcaggaacaaggtggtcagcctggctctttgaataactggaaatggcccctgcatacccgtgttggacatattacatgaggcagaaataaatttctgttgtgctaagccattgaaatgttggggttgttaccacagcatcacttagacctgtgctgtctaacatggcagccactaggctacatgtggccatgagcacttgaaatgtggctagtcctaattaagatgtgctgtaactttaaaataatactatatttggaaaaaaaggtgtaaaatatcttaataatttttatattacatattaacatcttgtattcattgggttaaataagatgtattgaaattattttcagctttctctttagtttttttcatgaagctgcttagaaaatttaaaattatacacgtggtcacatttgtggcattatccgcagcactgacccctaccttagtaattcagtacccctccctcattttgacaaaagctggtcagttgattgtcagagaaactgaatcagtgaaactccagatttgaagagagtacagaagaggagtacactacagatggggattaagcgaaagtcgacctactggatcaggagatacacttccttgtctttaatttctgtccatgtcctttttccacttgtttgcagagcactgacaattggagttatacacttcacctaggagactgaaggactcttttctaagaaatcgaatggcttcaggaaagagatcaacagagcccgatatttaaggctctccgtatctgcacaagcaggagttaccctgcagtaaagcctgctagttcacaagcctcacctacatgcagagagggtccagttggggttgacgaaccactctttatgggaacagcacccaagatacaccagacactggtggaaaattctaacaggaattaacttgttaagggaaagataataataatatgagtctatgtgcatattatcagtgatctgtttgcatattaaataattcagataatgaaagtacaagtgaaaaaatgagtctttgcgataaagctcttctccagccatccccatttctacaatatttttttccaatttttaaaatcaaggtaaaatatacataccccaaatttatcattttaaccatttttaagtatatagttcagtggtattaaatacattcataatgttgtgcaaccatcaccaccatccatctcccatactcttttcatctggtgaagctgaaaatatactcatcttgtaaagctgaaataacaactctcccttcttccctttccccatccttggcaaccatgattctactgatgtctctatgatcttgactactaagtacgtcatataagtggcatcatttagtatttttctttttggtggctggcttatttcacttagcataatgtcttcaaggtttatgttgtggcatgtctcagaatttccctcctccttaaggctgaacaatactccattgtatgcatataccacattttgcttatccattcattcatccatggatacttgggttactttcacattttagctgttgtgaataatgctgccattaacgtggatatgcaactaaaagagtactgtaaacaaatgccaacaaattggataacctggatgaaatggacagattcctagaaacacaaaacctactaagactaaataatgaagaaacagaatatcagaatagacctgtaactagtgaggagattgaatgagtaatcaaaaatctcctgacagaaaagaaaaaccctggacctgatggcttcactggtgaattctaccaaacatttaaggaaaaactaataccattcttcaagttttcaaaaacaaaaaaaactggagaaagagaaccctttccaactcattctatgaggccaacatcacactgacaccaaagttagacaaagatactacaaggaaactacagataatacttcttaggaacgttgatgccaaaatcttcaataaagtactagcagagtttcctctaatattttaagaagtttgctgaagtgtgaatagttctttgattaatattttttcgagacggagtctcaccgtgttgcccaggctggagtgtaatggcatgatctcagctcactgcaacctctgcttcccgggttcaaacgattctcctgcctcagcctcctaagtagctaggattacaggcacctgccaccatgcctggctaatttttgtacttttagtagagacagggtttccccatgttggccaagctggtctcgaactcctgacctcgtgatctgccctcctcggcctccaaaagtgctgggattacaggtgtgagccaccgtgtcccgccagctaataattttagggagcagatgaagaggtcttcagactgcttttagctcaggtttttttgttttaaaatttattaagtggaaagaaacatgttaactgaagattgaagtttgctgaagtatgaatagttcttcggttaataattttagggcgcagatgaagaggctttcagattgcttttgtctcaggattttttgctttaaaatttataaagtgaatggaaagaaacgttaactgaggattagtgctagtttttcttgacaggtcatttcctatagggagggcagtagtataagcaaaacaacaaaatattcaaaattctcaaataagtactatttattattgaaaaactcagataaatgtagaagttattttttctctctattgagcagcagttacatatgctagaatcatagtttgaatgattcagactgtgtacctgtgatctgacatacctggattggagttccatctctgccacccactttatttgactccatagagaaattactcaagccccttaagacagacactgaaataggatacagtttccaagaaggcaagattttttggatttttttgttgttgttcattgctgtatgctgaggtttagattagttcctgggacacagaactagcagtcagtaaatacgttgaatgaacccgaagaattcctgcctccgaattgttttggggatgaaatgcggtaatgcatgtaaagcattgggcatgcaagtgaagccagccacgtattaaacagtactcagctcttacctctgtatcttatattcttatttccgtgactgtatcctcacacatgaagaaatggctacttatttattattattattactattattattgctacttattttttaaagccacttacatctctggagatctctgtatgtgtgttaaaaataccatgttttgtaacaattggcttgtcttagaaaacttttcaattatacagaatttgagatctttacaacttgaattttcttttttttctttttgagtctcgctctgtctcccaggctggagtgcagtggtgcgatctcaggtcactgcagtctctgcctcctgggctcaagcgattctcctgcctcagcctcctgagtacaggcacgcgccaccatgcccaactaatttttgtatttttagtagagatggggtttcatcattttggccaggatggtctcgatctcctgacctcgtgatccgcccacttcggcctccccaagtgctaggattacaggcgtgagccaccgtgcccggccacaacttgaattttcatagcaaactagtttttattgtcaaattagaaatttatgcttgaagcctagtgcttcttttgcctatgcatctcatctaaaagtaatggcacttatcacgtcagcctcatggattgtggtagtggttgttatccttggaattaccggtagggtaacagtctccaggcataccatgggttcttcagttatgagtggcatagcttatgtacatgttaactgtgaataataaacgatttttccaacttactgcaatactcttatttatgtctgtaatgtgaattgtccagaggagaagttgtggtcaattgatgattaggctgatggtttctgctagctctggcaaaaggtgaatccagttgctttctagcacttttcctactaaccctgcttctcaccctgtacctaataccacatttttagtttagtttttgttttgttttgtttgagacagggtctaactttctgacacccagactggagtgcagtggtgtgatcatagctcgtctgcagcctccacctcccaggctcaagtggttctctcacctcagcctcctgaatagctgggactacaggattatgcccccatgcctggctgtttaaaaatttttgggtagagatggggttttgccacgttgccatggctggtctcaaactactgggtttaagcaatcctcttgccttggcctcccaaagtgttgggattacaggcatgagccactgcacccagaatcacctttttttagtttggaagatgacatctttttttttttttttcttagagaagctagagggtaccaaattaaagtctgtcagttttttctgtctccacctcaaagatcactgtatgacttcttttcttccttctcggctgtttcacacgaagttttccctttttctaaggctcagtccttatcgtctgagacctccctctcattatccatctctccatccttgactgtttctagttcgattgtaacactgatcaaatctccttcaagttcaaaacaaaccagcaaaaccttcccttgatactgccattacctcagagctatgtaccgtgctccttgccctccccccggacttctccggatgctagttgatgcctgtttagcacctgtcactgtttcatatacttcttactggccactgcctggttggcatctaccacttctctggaatcagcaaccccaatagcagatttaactgctggttccatggtttttgttacttgtccttttttgcagtgttttaaataataatcatcttttcacttatttttttaaagaaggtcatttaaaaaaatcatcctgcagtggaaaatttggaaaatatggaaaagtataaagaagacaattatcaactgtaataccagcagtacctattgttaagctctagggcatgtcatttccatcgctctctttttaaatgcattaaacagaaaaggatcacatggttattttgtgatctgattttttctatcttaatatattgtgagtatatttccaagtacttattctcgtgtggcataacatttgtagttacacgaagtggcggtgttgagactgccttggttcaaatcctggcttcagttactgctgcagtgtgacctgaaggaagttactcctctgggttttagtttcctcatcttgaaaatagttataacattcttactaacttctagggttgctgtaagtattaagtgagctaacacatagaaataattcttggcacttaataaacatcagctgttattaacaatattgtctgactgtactataatttacattatttttgtttttgcttgttctgccgtcattaagcgtgttgtaagaccatacgtgtcactaaatctgggtgcacaacatgattttttttaaatgtggatttttattagtaggattgctcagctagtgggtacatcatgctcattgctaagttgctctctagagaggctgcatttatacctcccaaggctgtacaggagaccattaacttcattacatttttccaaaaaactttatgctattgcccacattttgtgctgctcccttgctaaaagtgaataacaatatgatcatgttgttacctctctcttgccaaaacgttgacttgatgataaggggatcactgtgacatcatcattacccacagatgtttcttttttctcccccctccccctctcttctccttcctccctccttttgtttcttgagacgggttcttggctctgtgcaggctggagtgcagtgacacaatcatggctcactgcagtctggacctcccaggctcaagtggtcctctcacttcagcctcctgagtagctgggacagcaggcacgcaccaccacacccagctaatttttgtattttttgtagagaggggttttaccacgttcctaggctggtctcgaactgcatgttcccaggctggtctcgaactcgtgggctcaagcgatccacccacctcggcctcccaaattgctgggattacagacccgagccagcatgcctggcctcacagatatttcttgatctacattttattcattatttaggtccaactttagcatgtgtcatgtatttatatacaggttctaaatctttccatttgaaaaatactcatttttctatccaaaatgaattcaattttcctttttattctagtcccagtctgtgtatgagtaaaaccccaaggaccctgtatcctgattttactattttttgttaatggtttgaaacagctttattaagatataattcacataccatacaattatttaaagggcacacacttcaatggtttttagtatactcacggatctgtacaaccattatcacagtcatgggcaattggttcaggatttgggaagaaaacgtatggcattaggattaaaagtacaatgtttagagtctggctgatctgggtttaaatcccaaatctaccatgtattaactgtgtgactttgagaaggttacttaatcactatgagcttcagttttctttttttttcccgtttttatttttatttttatttttattttgaggcagagtcttactctgtcacccaggctggagtgcagtggcgcgatctcggctcactgcaacctctgcctcctgggttcaagtgattctttgcctcagcctcccaagtagctgggattacaggccaccatgcttggctaatttttgtatttttagtagagatggagtttcaccatgttggccaggctggtctcgaactcctgacctcaggtgatatgcccgcctcagcctcccagagtgctgggattatagatgcaagccactgtgccggcctgagcttcagttttcttatctgtaatatgggattactagtggtatctggctcataggcttattttaaggattaagcaagataataaatgtatagaatttagcacagtaaccggcacatagtaaatgtttgataaatggaactcggtaaatattattgccataattttgttcttaaatcaaccagcaagtgtttgatgctattattaggcaatgttattaaataatggaaggtgtttctaccagtgattcacagtgttttctgtatccagcaagcttttaatacagctgcttgtattattctcccgtataaacttctaattactctctgaaaatacagttggtttcctgttgatagagaacaataacagtagcttacacttagtgcttactgtctgcctggcactgttctaagtgccatacctatattaactcctttgatcctcattttacagattgggtacggaggaggttaaacaacttggtcaaaggattacaacagttaagtggtggagccaggattctaaccttggtattcagtctggctacagagcccatgctctttcttatctttatgttcttctctttacttcctaaagaatggtagatgcatttcaaacatcctgacatcttggctgctgaggattctgtatggaaaagcactatgaggtctttaatgcttggttggaaggagaactaaaatgagcagttgtgtgtgctgtgggcatgggccttagggcagctgtatatttgtcatctggatcagaccatacattggtgatcctgcttcacaaccatagaatccagaccctccatggggccatgaccagccacaaagtatcctccctgaccctccctgtggaatgctcgtgtgaacttgcactactccctccttgcatagtatcaaatcctgcggatccttggaaggccaccttaaattacttcccacctgtgaagcagtaaacgttagtgctcttcggttaatcatcatgtgtggtggtatgacatttgcagtatcatctgttaccattatttaaatttgaatatctttatgtcttggctcctcatgttgattacatgtttcttgcaggcagggaactatgtcttaaatgttttaaaatttgctttaatggcccctggaaatattaccaagggttgtgtgtgtgtgtgtgtgtgtgtgtgtgtgtttctttcagtctcacttgtctgtcgataatagaatatctctgaaattcaaacatacctagcctcacaaacttagtcccaaaggtacatgctgtgtttttgcaagaaggtgggcagtccctagttggctgttggattatgtgcattgtgttggggtagtagttgctgctaattgcctgtctgcagctcctcagaacctgttgttgcttccttttgaaaccttccttgattgccctagttgctgctcatcctgcatccaggcccctcccttaggcatgtgactcacggatttaaaagacagtgctgtacggtaattaactacctgcctctcatcacacagagatgagaacttaaatgtaggcttcccatctaaaactttcttccctgtgtgtttatccacccacggacatggagcagcgctgtcccacacctggccttttggaggaaatattgctagacttatttctcctgtttgaaatcactagttggcatattcgtgtacaagggatggattttacatgggtgctcttaattgaaaataattttattttctgtaacttctagaattttgttagtttattgatgcacacatattgggtgggtgacagttgggttttttatgaagataattttaagtttttagtaaataattaagtcaagtattacatgacagtttaattggactaaattctgacataacctatacatccttaaggtgaccggtggttatcattttctatgaaatgtaattagtttttcaggaaactttgtccacataaaggaattgattccacccttactacctgcttagcaatcctgaaaaatattgtaaatataatcttagagtatgcatcattaggaaataaatctattttgagaaataaattttaacgtacactattaataggacatttagaaatgtaattttctaaatatattagaaataataggacatttagaaatgacattctttttttttttttccttgctttttgtttgtttgtttgttttaagacagggactcactctgtttcctaggctggagtgcaatggcgtgatcattgctcactgcagcctcaacctcctgggctcaagcgatcctcccacctcagcctctgaaagtgctaggattacagggttagccaccagcacccagccaagaaatcccattctaatgtattagtatggttttatctattttagcagtgtaaaataaagtctttgtgaattatatatagtataattgaattgccaaaataaacatccttgccctcaaattgcttatgatattgtttctgaagcacagacataatcttttgaccttttaagcaaaaaattaatttttcatttaactttttttgtttgtgtgtgtgtgtgtgtgtgtgtgacagggtcttgccctgttgcccaggctagagtatagtgatgcaatgatggtttactgcagcctcaacttcccaggctcaagtgatcctcccacctcagcctcctgagtaattgggactgcaggcacgtgccaccatacttggctaaattaacatttttttgtggaaatatggtcttgctatgttgcccacactggtcttgaactcacgggctgaagtgatcctcctgcttcagtcacccaaagtactgggattacaggtgtgagccatcgtgcctggcctttcattcaacttgtaattcacaatttccagaaaaaaagttttaaaattactgatggaggaaagatctttgggacttgcttgtaaatatgttaatatttgatcttaataagctctgtcatactaacactgtttattaaactttgtggtagaattactacccataactaaagaatgaaatgcatatatttgcaaattgttaaaaatttataaatcgatagaaaagttgaatgaatagtgaacacccttgtgtctttcactaactcagtggctcacttgctaacgtttgcctcatttgctttctctgtttataaagacatatatactttttttattcccctgagccatttgaaagtaagctgcaaacatcttgacatttaacttctaaacattttagcacgtgtatcctaagagcaaggttgtcttcctgaagagttacattatcatacttaagagatatagtattaatacaatattatctaacatgtgatccctatttaaatttcatttattttcttccccagaacagttctttatagatgttttaatttttgatccagaaaccaagggaaaaaatatatctatatctatagagagctaaatagatctatatttgatccagaaaccaatcaaggaaacacacacacacacacacacacacacacacccgcttttggctgtcatatttctttagtttcctttactttaggataagccactaccccacctccatctaccacccggcagtggtcttttatgaaatctcatcatatttttccttttcttatataagcagtcccacaatttgctggttatatttcatgcctagattaaaataagaatattttggaatgaatatactatatagatggcattaattttccattatattacattaggagaagtaattttttttacatgttttttttccgctgtataatagtttagtatttgttttaatatacttctgttaaagatttgtgatactgtgtctttaaatttcaaaatagaattttgtaatttactcttaattttcttagtatgttgtattccaaaattatagaaagtgctataatagacatttatgtacattacataaagtaatagacatttatgtaatgtgggcatagatttaaattttttttaaattgttaaaatattaacatttaaccatgtctgctttagataggtttaatcttacaaggatctatctacttatctttctatctatttataatgtatatatccattttaaataataataacaatacatgaataaatctggtccaaacttctatcttgagaaatgtaacagcaattttgaactccttcatccctcaagacaattattcctcccttcccagaggtaaccatcctcctaaatttgatgtcattcccttagttttttcttaagttttaccacatttgtgttgtccctttaacatacttttttttttaagcttttcctgtttttgagctttatacatatggaattattctgtatatattcttcttgggcttgatttttttatttatattacaattttgagatgtcatttatgttgacattgttagccgaagttcattaatttttcactatttgatataatattccaaattactggaatatggaatattctatgaatataccacagtccattttactgctgcttgacacctcggtttcacctagtttttggtatggaaaaaatactgctttaaatattcttttgcgtggctcatggtagctaagtacaaaaggttctctaggttatatgcatagacctggattgttgagtcttgggtgtatacaccatcagctttactaggtatggcagaatgtcttcttttacacagttgtggaataagccagatgagttcaagaggagcaagtttgtgagaggatggacaagtgagttagtgagttacatttcatttgttttgagttttagcctatttagttagaaatgttaagtaggcatttgagatgtgtttacttttttagctccacccatctttgttttttcctaggttgactcattcaggtatgtcatctctcccttctccttaaagtggcctttaaagaaaaaagttgcaggccgggcacggtggtttacacctataatcccagcactttgggaggccaaagagggcggatcacaagatcaggagttcaagaccagcttggccaatatggtgaaaccgcatttctactaaaaataaaaaaattagccgagcgtggtgacacgtgcctgtaatcccagccacttgggaggctgaggcaggagaatcactggacctagggaggtggaggttgcagtgagccgaaatcgtgccactgcactctaccctgggtgacagagtgagactctgtctcaaggaaaaaattgcagtatcatggtacaacaattacttgatcgtaatagaagatgtgttcagtttttatatcttcagtctcaggccatccgtcatatgcagcctttttgtttttatagaccttgaaccacagaactacattaagctagtttgctgttttccagggatgacataaaggagaagtgggtagagggtgatgctgttattagcaagtgtgcattccaggtagcggttcacaaaggggaaaaaacgtaaaggaaagacgggtgcaagctaaaacaaataagccagtaagtaaaaaaccacaacactcttttgtgattatttagatctgaaacaaatagcagcatgtattaatagtccctgatgatttcactgtattgtagcataactctggtattcataatgtcaattctgaatttctttatgtgttgagagagtgtaatcatgctgattttagcagatctggtgaacccttagcaatctagaatcactctctgataattcctgaattaacagtagaaatttaactgttttatgtggtgaaattattctaggaagcttgttccatgggacatttacctattagctaataaaacaaatggtctattgataatttctcaaaagctctgtataaaaaaaaaatatatatacaataatttctctactggccgaattggatttacttggaaaaagaaagagggtgttatcaaaaaatttaaatgtcttgttaggttcgtaagttgtagaacaagaatgagaatgtgcaagtgtttttatgcttcattgttgggaaggataaattgcaaaagaacatagagctgggtgattttctggggttcagtctgttgcgggtgccacagattggcactcccctcggaattgccacaccttcacggagccagaacaggagggatacggagggaaagggccctttcccaacttcagactgagcacccagaagttgacctgggactgctgttttgtttctaggaaactagaaaccttggcagaattgaaatttcgtagtgattttttcttctttgctctccaaaaaataaacttgtatgtacacacatatgtatatacactcacacctacataaaagaaagataatttcaaagaaataatatatctcgtatagtccttgaacagttattttactattcaaagtaggttcttcaaaatttttaatttgaaataactaggtttacaggaaattgcaaaaaatagtaaggagaggtcccttgtgcctttcacctttcccttaatggtaacttcttactacccacagcacagcattaaactagaaattgacattggtacattttatgtgtttagtgctgtgctgtttaaacatatatgtagttgatttgtgaaccactgtggcatcaagacacaaatgctgccaccaccaagctctcccttgtgctgcacacacctgccccatggcagccagtaatctgcttttcatctctatgatgttgacatttcgaggatattaataaatggaatcacatagtatgtgaccttttaaaattagcttattttcacttggcgcaattccttgagatctatccaagttgtgtgaatcaacagttctttcctttttattgctgaataggattccatggtttgtttaaccattcaccttttgaaagataatctctttccctagtttttggcttttaacagtaaagcagctgtgaacattcatgttcagttttttgtgtggacataaatttttatttctttgggagaggtgctgttaaagaaaaaaaaattattcagtgacacttgttaaagcatgggaaggaagacattattcaggatcatccctgtaagtgtagggaccactacaatagtgtcttacagtgggtggggagagagcgtggcctcagtgctggatgtagcatggggaagtgggaatttgtagccaaggagctggttgagggccagtggatggaaaattctcaagaggaaatgtcaggtgtaaggggtttctgcctaaactgaccgtaacaggattctttcttgctgaagacaggccaaggtgatcagacatcagctggagggtggcagaagaagaagagggtaatcagacaccttgacgggaggtttgctaatctggcttagcagggttctttgctaaaacaggaatttacaaggaagtacacagataggcctgggagaaaagttcaggagcctggctcatttggtcaagcaaagaatctttgccagagcccaggggtgtgcagttggtggcttacctgtaagtagctgtgccattttacatgctcactggcagtgtatgagagatccagtttcttcacattcgtgtccacatttggtgttgtcactatttttttattttagctgtgccagtaggtgtgcagcatagtttggtttgcgtttccctgatgtctagtaatgttgaccatatcttttcatgcgcgtatttgccgtctatatatcctcttcaataaaatgtctttatatttcttgcccattttctagttgaaatttttttcaattgttgagctttgagatttctttatatatcctagatgaggcttttatcacatatattgttagcaaatatattttcctagcctgtacctcatttttttgccttcttaaacaggtcttttgtagagcaaacatttttaattttgttgaagttcagtttatcgtgtttttttttctttcatggattgtatttttggtgtcattccccattccccattccccactctccagccccagacggccacgaatctactctcggtctctgtgaaattgcctattctgaatatttcctataagtggaatcatatgtctggcttctttcacttagcatatattcaggcctcatccctgttgtatcatgaaccagttctttttatggcttcgtttatttttaaggttgaataatgttccactgcatggataagaccacattttgtttagccatttgtcagctgatcggcaattaaggttgttttcacttcttcgtctgcatcagtacagctgcatgtgtacccttcagccctgcaccttccttatacacgatgcacagatgtacgcatgcgagtacttgtgtgtacggttttgttttcttttttaaataatggaggattaacttattttatagtttttttcttcgatatttgggatgtctttttatgtctatataaaaagatatatctcattattttaaatgactatgtagtgtttaatgtgactgcttaattgatcctattctaataaacatttagatgacattgggtaacttcttgtttttcttttttatataacagtggcaccaggcacagtggtttatgcctataatcccagcactctgggaagccaaggcagaaggatcacttgagcccaggaatttgagacctgcctgggcaacatagagagaccttatttctacaaacgaacaaacaaacaaaaaattatccaggcttgttggcacttgcctgtagtcccagctactttggaggctgaggtgggaggatcacttgagcccagtaggtggaggctacagggaattaggattacaccactgcactccagcttgggtgacagagcaagaccctgtctcaaataaaaaaatagtgacactaatcatccttgtacaagtgtcttttttggtgcatagctcattttacctacttttggatttttctcttcaatgccatttgtcattaacttatttagaagtgtattgattacctcctataggccaggcactgtactgtgtatcagacactagggacacaagcactagtaaaatgctatggctatactcaagttttttgtaaagatgatatacctataagtaggtaatcatggttcactgtgataagtgcacaatgtgttattactagaatcctgtggaacgaactgtagcagaaggtaaggcaggttacgttaaatagattgaaaacagattatagcagtctgtgaatgcccttctaatgaatttggacttcattttgtacataattagaaatcattgaaaaaggccgggcgcggtggctcatacctgtaatcccagcactctgggaggcctaggcggttggatcacgaggtcaggaattcgagatgagcctggccaagatggtgaaaccctgtctctactaaaaatacaaaagttagctgagtgtgatggcacatgcctgtagtcccagctacttgggaggctgaggcaggagaattgcttgaacccgggaggcagaggttgtggtgagctgagttcgtgccattgcactccagcctgggcgacaagagcgaaactccgtctaaaaaaaaaaaaaaaaagaaatcattgaaaaaatgtaggcacacttaaattttttaactttagtaaatttttgtgctgtgactgttttagaacactttatcacctcccacaatcactgccttctacctcctcatctaggcaaccactgcttattttctgtctctaaatttgcttttcctaaacatttatgcgttggaaacatacagtatgcagtatttttacattggcttctttcatctagcgtgtctttgaggctcatgtatgctgtaatgtgtatcagtattttgtgcctttttactgcctaatgatattccattctgtggtgatgacaatttatgtgctcagcaattgatggatgtttggattgtttccagtttttggttattatgaacaaagctgctatgaacatctgtagataaatctttgtgtgggcacatatttctcttgggaaaaggaaattttggatcctgtgataagtttatatataactttaagaaattagggcatggtggctcacgcttataatcccagtgactcgggagactgaggcgggaggattgcttgagctcaagaggtcaaggctgaagtgagccatgattgggctactgcactctagcctggacaacagagtgagacctcacctctaaaagaacaaagaaaaaaaatttacagactattcctcaaagtgactgcatcattttacagtcctgtcagcaatgtatgcgggttccagcttctccagatgctcgacacttggtattgtcttttgattatggccattttaatggctgtatagtgtatctcattgtagttttaacttgcatcttcctaatgacagggtgtttataatcttttcatgaagcatagttatattttagagacatgagtccaatgaatagaggtaagaatggaggtgagctacatgaaagatgagagcctacgtcagacaatatgtgtagagatggggagacattttaaagatacgtgtatcagagctagaatgagcagcatttagtaactcctgagtataatagatgaagcagagggaggtggggcttgtgatcccaagattttaaacttcggcaattgggcactttttggctaacggtgctgccattagccaaaaagtgactgccggtacataaacagattttgtgctggtggttgatggcttttatattgatcttattctcttgatgtgccactggaataaacatttaatagagtgtttggaaacatgtatctagttcaaaagaaggatctgggctgaggtataaatttagggcagtttacattgtgtagggaacaactaaattcatggaagtaaatgatgtatctgttcctaagtcaccctatctgctgagttacttgtgacaaattgtttaaacagtaaaagaatttaatatgaaaagatacacgttaagatgattctaggattaattcattcaggcatgacagcatcaccaaggacccaggttctttctatcttttaatgctgctgctgttcttgatctgttgggttgtcctcatggtccagttcttgtttacacattcaaacccagaattgcatgcaaaaaggctgggagcatgtgtttttacctgggtcttttttcatcagccaagaaaacttttcctaaaagctccctagcaaacttactttcttgtcttcttggccagaattgcattaggaatgtgttaccagactacccactggcaaggggaatggaaattgtcacagttggttcagaccagagctttctagcccaagtatttttttctgttatctcttctggaagaagccttttccccttgccttttgagtctcttctgtagttcaggtaagttagattttctatgcaacccagttttgtatcattgagttgttactattcaatacttcacaacagcaaatacttgccaaaatcctacactgtgtcatgctggattctaggatacagaaatgaataagaaacttgtagtttgacatagatacaagcttaaacagaagagtgctatgatagatttgtacactaaagttcttttggactatggatttagtacaactgtttatatgtttggttttatgagtaaaggcatcttgagtttcaaaatcaaccttatattcaatttataaatgaagttttggaaatttagaacgcaacccattcatgagttgaccctccctttctagttaggtggttacatgtttattataggggtgcatggtatactatcctaaagtaactgttcatttgagttatttacagctaaaaccacattatgtttttctggagcataatgtttgtgttttctagttatcgtaccaaagtaaacagtaatatctttagcttaagaacccaactgaaatgtttgtaaaatatagattgttttgtaatttggctctttttttttaatggtcctatgaatgcaactatagtgtttgcagtatttgtacagtgcatggggtgctttttctgggtgctgagaagggaggagaaatgatagggaagaggggatttggagtagccgaaggaaaaaatgtgcaatcagtgttgttgattccaccgaattctaagaattccattacatcttgatatctggtacaagctcaaagttaatcttaaattttggcttagggcatggccgtacttgctggctacttgggaggctaaagcaggaggatccttagagcctggaaggtcaaggctgctgtgagccatgaccgtgccactgcactccagcctgagtgacagagtgagaccctgtctttaaaaagaaaaaaagaaaaaaaaaaaaaacagaaaaaaaacaaacaagtgtccaggagtggtggctcacgcctgtaatcctagcactttgggaggctgaggcgggcggatcatgaggtcaggagttcaagaccagcctggccaacatggtgaaaccgcatctctactaaaatacaaaaattagctgggcatggttaatcccagctactggggaggctgaggcaggagaatggcttgaacccaggaggcagaggttgcagtgagctgagatcgtgccactgtactccagcctgggtgacaagcaagactctgtatcaaaaaaaaaaaaaaaaaaaaaaaaaaaaaaaaaaaaaaaggtgttttggcctagattgagtaaaagaatatttacactattcttttctgtaaagcaaatcttactaataatagaaatcagtgggtgacattctgaaaccttatagataactgttatgatatccataatcagtgcttgtccttggattctgcatgggtagtgagctttaaagtatcttgttggtttaagatttaaccattttaataattttgaaaaccaagatggatgcatacattctgatgacaagaaaagatgttttgtaagggaaatgtggaattaaaatgaactttttgtgtttgtttgcaaataattattaatgttgaagaaattttgatgttagctctgagttatgaatgttagaatatatttagaaatgtttgattttcatttttccatgtcattaagaagcttgcatatgttttttaaagaattgccttctttttaatgtgttttctacaactaataggcttagaaatttcagacacaaaatctttgaaaaaatgacttgtacttacttagcgttttgttttgactaacacccctggtggttgttgaaccacaagttcatagtgttaaaagcctgtggtaaattacccagtaagctaagtgattaaagttgtttggaacattttgctcatgtacatcttatttttatgtgtatacatatttatagatctgtgctcataggactatagcactatattgcaaaggtcctaacctttattcacacaacttccagtgtgtacaatgtgacttgcagagctgtactgtggagcatatcctttcctgtgtcttttgtttacctctgagtaatgaagtcaaatcttacttgattttccttggctggtctattttattttattaagttctgggatacatgtgcgggactagctagtcttaaattcagtctttaggaaacgttttctgggctgggcacagtggctcatgcctgtaatctaagcactttgggaggccgaggcaggcggatcacttgaggtcaggagttcgaaatcaggctggccgacatgacgagaccctgtctctacaaaaaatataaaaattaacctggcatggtagtgttcgcctgtagtcccagctactcaggaggctgaggtgggaggattccttaagcccaggaattcgagaccagcctgggcaacacggcaaaaccccatgtctacaaaaaatataaaaattagctgggcatggttgtatgtacctgtagtcccagctactcgggaggctgaggccggaggattatttgagcccaggaggtggaggctgcagtgagctgtgattgtgccactatacgccagcctgggtaatggagccagagcctgtctcaaaaaagaaaaagaagaaaaggttttctgaagtttatgttaagtgtttgtacatgtgggaaaacagggaagaacagatcatctggggttttggacttttgaagatgggatgtttgaaagctcttttggttatgttattcgctattttttaaactttagatttagcctgaagcctaaaacttttagccaaggaaacaatgttttagtaaatggtgctgtaataaacaatagttggtaagtagtttacatgttaattttataatgatacattggaaatatctggcagaattagaatcaggctgtgtgtgtgtgtgtctgtgtgtgtgtgtgtgtgtgtgtgtgtaatcaggctggtctcgaactcctgacctcaagtgatccacccacctcagcctcccaaagtgctgggattacaggcatgagccactgcacctggccaggccatatatttttgaaacagacactttgatggactgtttttacttttatggggataaattcatttgaactttgtttaatacagtgattgcctgctctctctcccacacccttagggaagaatggtgtagttggcaaagaatggctttggaggaaaatctctttatgccatttctaaaatggaaatagtgcatttcttttcttgattagtaaaagggaaattaaagattatgagcatctcagaagaacactgaacaccaactctttatttttgccttccctcatttctctgagcgacagcctgagagttttatagtcatatgaggactctgaaaaatgttagagacctggctaagttgtaggtaactagtgcattgagaagactgaaaggctcctgaatgcagacaaagcattactaattgcattcagggtcaggctgtctttagccggaccatgaaagatacagcagcctgtctgctgagcggagactcttgtctttaagaaagactgctacctgatatgctagaccgtttcaggttgccctagtttacatgaatttagtcattatcgccaagactgctaaacctcagtgtgatacttctaaatggacttgaagacaaggtatttgaccttgcaatggggcataggcaacgttcatacagtttttaaaacacgaaacagaatactttgctatttgaagtttccgttaaaagattgaatgatttttaagatcgcaaagtaaacagcagacatacctttagaaatttttttatgacttgaacccaggaggcggaagttgcagtgatccgagatggcactactgcactccagcctgggcgacagagcaagaccttgtctcaaaaataataataataataatttaagctttaatagttctatcttttagatttatgaatgcttgccccttaaagggtaaggtgttaatagcagtactaatatacggtagtttagacctattccacaggcatagaccaaccagtgcaattaattcttcaacctcacaagtcctaatgttctaggtagaagtgtggctgaaattaaaactggttattagactttgtaatacaaaagtagaaaaaagtgatattagctaggtggtccaatatatttttgtctaagtaggaatctgaatattgtagaattgtacatttcggtgctgcttctagctattcctgttcttttttttttttcaaattgagatgagttttttttttttccatcaaagcttaagataacataggaattttatatggaagtactgttcccacagaactaactttacaaatgtaaagcttgggcagaggttgaggaaaatggtaaagtgatagatttcgtaaaaactgtagaaattttcattgactttactttgaaaatgtatagttgtacatgcgaaacgcttctagtattgcttctagatgtattattctgacaaagttccctaagtcttaaataagttctttttttttctaaacagacttatgaaaatatgcatcagtttaatactgtcttggaattcatgagatggaagcataggtcaaagctgtttggagaaaatcagaagtacagttttatctagccacatcttggaggtaaggaaaagaacataatttagaataatatgaaatttctcattttttaatagttgaaaataatccttctacactgcaactttatttgagccttcttcagtttctttgtaacaccacaactttatagtagcttctttagtttccttaatcatcttcctgacgagttcataagtaattctaatatatattcctcataaatgttgaacctcttcaggagtgaaaggtatttatttcttactaatcactttcataaatctccttttagaagataagcattaaatggtttatatgtttatttcttccccctaagtttgcaaagcagagttcagcatgcaagattaggccaggtgtgcctgtaatcccagcactttgggaggctgaggcaggtgggtcacatgaggccaggagttcgagaccagcctggccaacatggcgaaatctcgtctctactaaaaatgcagaaattagctgagcatgatggcctaagcctgtgatcccagccacctgggaggctgaggcatgagaattgcttgaacccagaatgcagaggttgtagtgagctgagatcatgccgctgtactccattctgggcaacagagtgagactctgtctcaaaaaaaaaaaaaaaaaaaaagattatattgaaaaatgaatgtttatgttattctgaaatttttacgctttttagaattcagaattttttttttttttaagacaggatcttgctttgtcacccaggctggactgcagtgagcatagtttcaactccctgggctcaagcgatccttctgcctcagtctcccacatagctgggactacaggcacacatcaccatgcccagctaatttattttttgtagaaacagggtctcattatccctctgtgttgctcaggctggtcttgaacccctggactcaagtgatcctcccacctcaacctcccaaagtgctgggattacaggcatgagctaccagacccagcccaggataagattttttaacatgttagaataatagatctttggaaatagaatttaaagaggtaggagctgccatcatgccagaaataggaggaaagaagccatcctaagacagtatgtacaggaaaatcaggcttactgttttaaaatccatttagagactaatgatcaggtaaaaggtttgaattatgtggggaatctacattttaagaaatagatagaatgtatggttttatgaagtggtctacgcttacacttctggaagtggcaggctttgcttgctgctactgttaatacttgcagcattcactcgcccttctcctgcccctgccaaaccgctggattagatcttctaaaaaataacgtaactctcgaattcttttgttaggtttcatattgtttgattggtagagttgtgatcgtttttttctttctcagttcttttggtttctatgattgtgtgctcttctgattctacttatttaattactccttgaccttttttccttcccctcctactcttaaataataatgaccttccccaaggttttatcttagaaattatcctgtttttttcttatgtctttcctagtctcatgatttccgcaattatctctaaaatgatctctctcaacttcctatctcagttgtggcattttctctaagcttcaggcccatattttcatctgtttacagatggctcagcttagtgcctcagacttcccattatctagcacatcattcatcatgagctctgcacccgctatttctccttctgttaatggacctctttgtcacccaggctcagagtctcagtgctgtttcggattcctcatcatttgcttcctacccttaggcacaagtgaagtcctgtcagttttacctctctaatgtatcacaaatgtttgaatcctctctttccgaatcccccttcaccatccaagtttaggtctttatgttacatctcactgaaaatattgcagggatctcccagcttgtgctgcttctcgctcctacttcattttacatgttgctgccagcttaaattatcttaagagataattttgcttgtattgtcggtgacactttgcctgtctgccagagtaaggacagattcctctaattttaaagatagtgtagctttgccttcatctgtccatttctttcaccctttaaacatttattaaacacctactgtatgccaggcactgtgttaggtcagaatgcaaaacattaaataaaaacaggttcctagctatactcaaaaaatagtctttctagggttggatgagcatgaaaacaattattgaagtgcaatctgagaagtgctatattataattgaaaagatatatttgattattccacactgtgtacatagatgataactataacatcactgatatgcccataattacatacagctataattttcaaaagaatttgaaaatacaggtgaccatgtcagaaaacaaaggtgtattggcatcacctggaaagactacaccaatgttatgagaggagagaattgtcaggcaggcttcacagaagagataatatttgagcagagtcttgatggatgaatagaagattgctgaatagaaattggaaagtgtaatactgtaaaatacatatgtgtttttgatgccatttcctggcattcaactcttaaaatccttgaaacctctgaagtgatgtctttttgtatgctaatgagttaactggtagatgacagccccctaggtagctttaggatgggggctggtcagcagaaagactaaggcaggattagagtcagaactttcagttcccgcccccaccaacccccaacatttagggaggggagaagggcgaaggttaagttgatcaccagtgacccgtggtttaattagttgtgcctacagaatgaacgttccataaaaatccaaaagaactgggttcagagagcttctggatagctgaacatgtgcaggctctggtgccctgtacatctctttatctgtcctttgtaacatcccctataataaacctgtaaacataaatgtttccttgaattctgtcagccgctctaagcaaactaatagaacctgaaaaaggggttgtgggtacctggatttatggctggttggtcagaagcacaggtaaaataacctgggcttgccattggcattggaagtgggggccgtcttgaggatggatccctcaacctgtgggatctgatgctgtctccaggtgggtagtgtcggaatttaattggaggttccagctggtgtctgatgcagaattgtctgcttgcttgttgatggggagaaaccctcacacatttggtaagaaaagtcttccctgttgattgttttggtgagagggcagaggaaaaatagtttgagtgttttccatactcacagaaggcaagggaattaatttcatgcagagcccagagcggggtggaggcagagcttgaaagtgtatagaatgtacagaagatagaataatttttgtatggcttgaatttagaataggagagagagtttgagggacaaggctggaaaggaccttatgaagaattttgaatgccatggcaaggagtctagactttattttgtgaaaaatgggcagtcattgaaaaattttaacatttaaagatattttggatcgtaattttttgttaaaattaatatgatggttgtgttagtcagttttcatgctgctgacaaagacatacccaagactgggcaatttgtaaaggaaagaggtttaatggactcatagttccatgtggctagagaggccttacaatcatggcagaaggtgaaaggcacatcttaggtggcagcaggcagagagaatgagagccaagtgaaaggggaaacctcttacaaaatcatcagatcttgtgagacgtattcactaccaagagaacagtataggggaaactgcccccatgattcaattatttcccactgggtccctcccacaacatgggggaattatgggagctacaattcaagaggagatttgggtggggacacagccaaaccatatcgttggtgatatgaatggtagtttggaaaaaggaaaaactaaaactagagagacaagttaggctattcttaactgtttcaagcaagaaataatgaagctgtcaacttaagatggaggtcaacttacccgtttaagcattggttgtttagaaaatgtttaattttcttctattcccctatgtactatactcttcagctggtgatttgaaatcgtccttccttttctctactctcttctcttggcatatttttggccctttctctcttgtggagtgcctgtgaactttaaaaaccccatctcaaatgccaattcatccctaaagttctttctaatctgtattgctttgactctaaatatatgtcttttcctagtctaaagcccccaaagcacttatttttattctacaggatattacttttttggtccctattaaactatgtggcagcaagtcacaaaggaggaatcagaaagtaacctgctccccacccttggtgtgtagtccagttagcaaggtatgtatataagtaatataagtaatgataaccaacattgccatgcaaaagtgaggaatgccacaggagtaaattgttgcttctagtcagagtcctgtaactgagaagcacaggtagaacataggaggttatgtgagctgagctttgaaagatgagtaaaatttagatgggtaaaggatatttctggaaaagtgcatggatagaaaatgaatgtttttgtaggaatgtggtgaaggtcttagaaagggcaggaagtatgatgtgaagaaagctcttttagtgaaattactctagcagtgacatataaactatacatcattagagaaatgaagtgaggaggtagggagccgagtgaggagattgtggcactagttaggcataagctgatcagaattcaatcagggtggtgattgtggaaatagaaaagaaagactcaatgataaaggtattgcggcagaagaagggacaccgatgtgtgactagatgttggaaagagatgatgccgcctgaattttgagcctggatggtggggataatgttggcctcattagtagccaaggtaagttggatcctacttttctaaatgtagagaaacattaaaatttatgttttactgtactgttggtctcttaatttgtttatgtgcaacaagtttttttggcattatttttccagccttaacatattcaaagggagattttatgaaaaaagcaaagtatgacctcttttacaaaagcagtttttaaggaaataaactgtattctgttcatagttacctcttttgctatcatgttaaatgctatgtaagatttagtaaaacttaagaatgtttaaagtatttctacaggtataattcagacaccattaccaaaggatggtatcttgttttaatagaattaccgcttaaggaatggggacctgtgaaaaattcattcagtagaattcgatggttccatattaacagataggcattattatggtactgtccattagagaaatattgtacagtaaggcagtaagttaattatataaaactggcttttaaaatgcatttattaaaattcttatcaactgttaactgatgactgatttagaactttgcaatatttagaaacagtctaatactctctgttgaaaataatcactaattgttttataattataattatacatgtgtaaaactggaagacattacattattgaggaaggaaggcatttgtgttttgtttgttttttaagtcaggctttgtgttgaactattattttttatttatttatttatttagatggagtttcactcttgttgcccaggctggagtgcaatggcacaatcttggctcactgcaacttctgtctcctgggttcaagtggttctcctgcctcagcctcccgagaggctgggattacaggcacccgccaccacgctcagctaattttgtatttttagtagagatgaggtttcgccatgttggccaggctggtcttgaacacctgacctcaggtgatctgcccacctcagcctcccaaagtgagccactgtgcccagtgcagcatactctgtttacaagcacaagcagtgtagccagaggacttcagtttgaatcttgactttaccacttagtttgtgttcccttgaaagaagagcctgagaaaaagacttactggctgataggttatttgggagatgaaccaaaaagcagaagtgagagaatgggaaaagtgagacagagaagggagtgaagtttcattaagtgggtgatccagttccccctgcgggcagctgggcttcagccctgtgggtgtcttctgaatgtacctcactgttgtcccaccaaaggacagggagcctgagacatgcatgcaccaactttcacctgttgttaattgaaggttgctccgtgagctttaactccggcaggtctgtgcttgtgcctccatgctgttgagcagtctcccttaggtttgcaaagtctccgaggaacaaaacagagcagtgcctccactcccacttgagtcaggtgctgtgcatgccacatagacctgcccaccagagccacagtgcggagaggggtgagctgcagagcaccacgaaggtctgctgtggtctgccccttttaccagtgagactccctcatgccccattagatctactctgtcactgaccctgcagattggtggctgattatgatcactaaaagaaatatctaacaggtgcagtggctcacgcctgtaatcccagcactttgggaggctgaggcgagtggatcatgaggtcaggagatcgagaccatcctggctaacatggtgaaaccccgtctctactaaaaatacaaaaaattagccgggtgtgatggcgggcgcctgtagtcccagctactcgggaggctgaggcaggagaatggcgtggactcgggaggtggagcttgcagtgagccaagatcgtgccactgcactccagcctgggtgacagagcgagactccgtctcaaaaaaaaaaaaattatatatatatagatatatgtatatatctctgaaacaagagggttaaaatccctaccactgcagctggtcctgagctcttatttccatccttgacattcatatgagaatgctctaagagccctcagttgtgctggcagtagggtgttctctgggtagggaaggcaagcccgcatctggagtgttggttctgcaccctccttgttagctggcatttggcagtggcagtagttaggtcacccttcataagaaggagcccatgctgttgggcctatgtagagccttcctctctgtcactccacaggctccattgacgggcctggtactccagccttgggaagaagctggctgacagcactgacaagccatcctgtctgtccttggggtgtagttgaatgcctcttctgtgggaggtgccttgtgttgggcattcacataagataaagattggcactttgtgttccctgccttagggccgtcagcgtgcctcttctccaggcttctggtctcttatttcctttttggacccttttaatacaaaaattagccgggcatggtggtacatgcctgtaatcctagctactcgggaggctgaggcaggagaatggcatgaaccctggaggtggaggttgcagtgagccaagattgcgccactgcacttcagcctgggcgacgaagcaagactctgtcccccgccgcccacacacacacaaaaaaaattaaccacacacccacttgcttctgtagagaaacctagaactcctggtctcagaaatgtcatccaggtctcgctttcaggctttttgattattctgcaactccagaaaaagaggctgtttagtcccactctcttccattcagactgtctcctcttaagttttaaagatactattattttttcttaatttaagcttagcggatttacttctggttttgatccctctccagtttgggtgctttaattttatttatttatttatttagaggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaacttgcagctccatatggtatagtggggagagcatgccacaaggttttcaggtaatatgaggttttctcctcatattctcttactacacttcaattcctaactttatcttccagcctaataatttctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttagggaacgtctcattgccccttttgtttttctttttcctcattgcctctttttaaaatgatcttttttttatttttaaaagattatatattggccaggcacggtggctcatgcctgtaatgccaacactctgggaggccaaggtgggaggattgcttgaggccaggagttcgagaccccatctctatttaaaaatacacacacacgtgtgtatgtgtgtgtataaagattatgtaagcagcctattaataagttcctatataaaattttaaacactatgcaccaaagccttttagtccctcttccccacccttcaccccattgccctcctcaccaccctccttgccctccatcccactgccatcttggggacctctgtttcttaggttattggtctgtttgtgtattccattccctgttgagttaatttttgtattaatatctttatagaaaatgatacttttttttttttttgagatagagtctccatctgtcgcccaagttggagtacagtggtgccatcttggctcactgcacccttcgccccccgggttcaagcaattctcctgcctcagcctcccaagtagctgggactacaggcgcctgccaccacacctggctaaagttttgtagttttagtagagatggggcttcatcatgttggtcaggctggtcttgaactcccgacctcaaggccgaactgccttggcctcccaaagtgctgggattacaggcgtgagccaccacgcctggtccatacagttattcttgattttcagatttattcttataaaattatgcctaatgagaatatccctctcataaagttagtgtgaagattaaggaatttaacatatgaagtatgtagaacagtgcctggcctatagagctctaagtgttaactattatttaatattattatgcttgaatatttataattatttttggtaggcctccttgtacttcgtattatttatttgttctttatttttgtgcttagacttcctagggatattgaactttctagataatttcatgggtcttttcaaagagccagcattttggttttataaattaactccacttttttgttatatatttaataatttttgcttttaacatactaccttttcttcctgcctttggtacccattcttccatctcggttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagccccccctctataatagttttcttccacttccctattctcattgcctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgttctttaggaaaaatcgtaattggtaagataaaccaaatataaaactatatagtaatgctgtttttcagtcttactgatctcactctattccttatctttaccatgcttttctgactttgtgcttttgcctctggatttcccagtctggaatgcctctctcacatcctagtatgttgaaatctgtccattattcaagtgtgagcttagatgccaacactttgatgaaggcttatctgatcccattgcctagaattaatcttctcttcccatgtctttggatttgaactgcagcttctgtgctctgttactagtcattccattttcgatagtctaccagtaacttctgtgccttagatccacatttacactggcttgtcaggattggtcagtgaatcaaataggtagtaagtataagcttctagaactacactctccgatatggttgtcattagccacttgtattttgactactgagtagccacatatggttagtggctactttattgagtaacatagagactttcatgattgcagaaagttattttgagcagtatctagaacaatgcctggcaaataatagacaccagggaatgttgttcctaggtatcacatcctcatagtagacactcagtaaatattagtttaactttcctttcctcatctgaattttattagcgtttacctgtgccatttaaaaagtaacagtttatggcagctaacacagtgtatgaacaataaatatattttgggtgagtaagtaaatactacgaagcatccagaaagcatcttgctctcttttggggtggggagagtaggggagtggaagttaaaaaaaattcactactcaggccgggtgcagtggctcatgcctgtaatcccagcactttggaaggccgaggtgggtggatcacttgaggtcaggagtttgagaccagcctggccaatatggtgaaaccccatctctactaaaaatacaaaaattagccaggcatggtggtgcatgccagtaattccagctccttgggaggctgaggcaggagaatggcttgaacctgggaagcggaggttgcagtgagctgagatagcgccaccgcactccagcctgggtgacagagcggactccatttcaaaaaaaaaaaaacagttcattgctcaataagtgaatatttccaggatgcttaaattaaacagggtagactaagcagctaaataaaggtggtcttatctactgcttttcaaatttagtgtacgcgcatgtcacctgggggtcttgttagaagattctaattcagcacggtctgggattctgcatttctagccagcttgcaagctagccagctctgcccagtgagggtgtaattcactagattggctacttaaacccattttaacatttcctagtctttagaactagtcctttaatttagctcaaagttttgttgttgttgttgttgttttgagacagggtcttgctctgttgcccaggctggagtgcagtggcatgatcatgactcaccacagccttgaactcctgggctcaagtgatcctcctgcctcagcctcctaaagtgctgagatggattacaggcatgagccaccacacctggcctaaagttctcctttttgaggtgataatttttaaagacagcccttatatgttcaggaaatataagcctgtttttacataaagtaggtgcattgttcagtaccaatatgagaaagaattatgaatacagctttatattattagatttcttatgtcataatataaaaaaccggtaaacttagcgctgaactattcatgatagttgaaagttttaagctaattcaaaatatgaaataaaccagaaatattttggaaagaagaggttttaagtatattcaggtcctccattttatgatgtgagtctaaatttctgttctctgatgtctagaaatcacaaaaggatggtgattttgggaacgaagttcttgagctagcactgtcagtagtaactggccgttactgtaagatctagagatatatttttagatgccattatacttacaaagaactgttagagtgcattttatggttttatggttggtttaattccccaaatatattgcccttagcaagttattactattttttatttcttaaatttatttattgaacatttttattcctttgtttagaaatgtgctagacagtggcaattacattgctgcaagataagtaaaaaaatcagctgactaagctttataagaggaggaatcatgtctcttttatttaccgttggatagtcactacatggcacataaccaagtcatcattaagtcatttttgagtgaacattgctcaagatctgcaaagcagctgtgatgtgtgcggggtgtactggaagttgaacgggactcctcaagcagcctaatgagttgggattgaggattgcatacacaagggaactcgcagatcaagtcctgaagagaacattgtagttactctggcaaagaacaacgaagacacaaaagctgtgcagagtaatggaagcctggaaggagtgcctgtgaagggagagcggctgcactgactttggtagagttggagcatcgtaagggtatggaggagaggggaggagagtagtagaggtctcagcagttgtcagatgacaaaaagtcttgcgttactaattttatcgtatgaaatgaggatattttttaggtttttaagcagagagaatggcaaggtcatttggttttagaagttagtccgagctaggcatggtgacagatgcctgtactggacaagctgaggcaggaggatggcttgagcccaggagctggaagctgcagtgagcagtgatcacatcactgcagtccagcctgggcaacagagcaagaccttgcctttaaaaaagaaaagtctgaaatacccctcacaactgttaaaaaaaaaaaaaagttctttcaagcacacgtggagtgttttatgaaagtgaccatttactaggctatacagcaagttcttatacatttcaaataaaatcaaccatgttttctggcgagaaagcatgtaggaagtgaataacaaactgtacacattgggaaatttaaaaacacacttctgtaaatcccacagattaaatataaaataatcaatttagtgaacacctagaacaaaacaatagagaaaataacagcctgagcaaaatagtgagaccctgcgtctacaaaaaaaaataaaaattagcccggcacagtggtgtccccctgtagcccctactcagaaagctgagatgggaggattacttgagcctgcaaagttgagtctgcagtgagccatgataacaccattacactctagcctggactacagagcgcaagaccttatttcaaagaaaaagaaacttaggacatattaaaacgtgtgtgaaaccctgaagccttaaatattcatatttgaaaagaagattttaatactaataagctaatctaagttagggaaagagcatggcagtaaattcaagtgaagtaaaatagagaatacagataaaagctaacaattctagagttcttactctattccaagcaccgttccatgttctttacaaaggttatctcatttaatcttcacaaagccatatgaggagggtattgttattatgtgcactttacacaagaggaaacttaggcacagagagaaacttatccaagcctctagctaataaatgtgatagaattggggcttgaaatgatgaattttttaaaaaaagatacattgaagaggattaacagagctgaaagttgttttttatgaaaggctaataaactatttgaaagattgatcaagaaaaaatataaagtacaaataatactgaggatataaaaggaagatacagaagaaagtcttaaaaataaaatatcttgaatcactttataccaataaattttacaatttaaacgtcaattttctagaaaattataacaatgaaaattgacacagagtaaatagaaaacctggatatttctgtaactgttagagaaattggatttgtaattaaaagaaccacccactttcatatattcagagataagcctttggcccagatgatctttttttctaagaaaaaaaaaaacaggcctcttcagagacttcatttattatatgaagaattagtgaaaactttgtcccaccattttaggctatttttacattagaaaaaatactgcacatttatgaaaatttactaggggcaaatttcaacttatctgtaaaatagtaatgccaactgtggagatggcactgtaaaccaaaaggcacaatgactaaagaaactactgaaaatttaacaattatctcttcattatccttccttattggggaacctgccccgatagtcatgtaggttcttttctattttccgtaagtgttggctggttagagaaataaagggacagagtacaaaagagagaaattttaaagctgggcgtccgggggagacatcacatgtcggtagattccgtgatgccccacaagccgtgaaaccagcaattttttattagtgattttcaaaaggggagggagtgtgcaaataggtgtgggtcacagagatcacgtgcttcacaaggtaatagaatatcacaaggcaaatggaggcagggcgagatcacaggaccacaggacggggcgaaattaaaattgctaatgaagtttcgggcaccattgtcattgataacatcttatcaggagacagggtttgagagcaaccagtctgaccaaaatttattaggcgggaatttccttgtcctaataagcctgggagcgctatgggagactagggcttatttcatccctacagtctcgaccatagaagacggccacacccaaggggaccatttcagaggcccaccctcaggggcacattctctttcccagggatgttccttgctgagaaaaagaattcagcaatatttctcctatttgcttttgaaagaagagcaatatggctctgttccgcccggctcaccggcggtcagagtttaaggttctctctcttattccctgaacattgctgttaccctgttcttttttcaaggtgcccagatttcatattgttcaaacacacgtgctctacaatttgtgcagttaacgcaattattacagggtcctgaggtgacatacatcctcctcagctgacaggattaagagattaaagtaaagacaagcataggaaatcacaagggtattgattgaggaagtgataagtgtccatgaaatcttcacaatttgtgtttagagactgcagtaaagacaggcataagaaattacaaaagtattaatttggggaactaataaatgtccatgaaatcttcacaatccatgttcttctgccatggctttagccagtccctccgtttggggtccctgacttcccgcaacacttcctgctccaagatttgctatgatgagttttccaaatgttaacgacctggaaaagctcattgtctttaagacgtatcccttctgagtcttgtgatttggtggtttcttcatccaaaacgtatcatcctctataaaactccctgatcctcagatttaacttttcagtttctttttccaagttctcatcagtggtttaatggctgtatctgagcacctaaaaggtaaagactcttccaagctgttgagactccctccaggcaggggaatgactatctgggtctgagattatgtcattaagttctttttttttctttttctttttttttttttttctttttgagacagagtctccctctgttgcccaggctgggatgcagtggtgcaacctccactccctgcaacctcagctgcttgggttcaagcagttctcctcagcctcccaagtagctgggattacaggcacctgcctccacgcccagctaattattgtatttttagtagagacagggtttcacatcaggtctcgaactcctgacatcaggtgatcaacctgctgggattacaggcgtgagccaccacaccctgcgtcgctaagttttttaaccagagaggcttcaggtttcagacacacagaagcataattctggccatacaaaaacctcagtttcttctgtcttccacccaatcaaagtctccttcaaaactttaagtaagtttctatttgccacttcaggacacacctgcactgaactagacactgacttagaaacttggtttgatttggcaaattttctgttaaaatgctccatacttttcttatgcctattagagttatttctgacctactgtatttactttcagaattttctgaagctataatctttcaggaaatagtactattttttgaaatagtatttctattttttgaaaatagtatttctattttttgaaatagtacttttcaaaaaagtactatttgaagaactcttgagtatttactttctgtaaaggaagttcacatgtggcagctttctcctgagtatctaatttgcaattgcctaactgctcagtgacatccactactgtctgttctttgtgtttggcattagctttgagaccagctttctttttcattatgcttttttggtgcagctgtcgtctaatacttgttgaatttggtctgtttcctggtagaatggaggaaacaaagtcttgctcattatcactgctgctgtcattatgagtgctggaagaacaattgctagaagattcatattgcttttcaaactggctaggattgttgatatctgatgttttaatggctttactgcataactatttcttttccagaatggccactttgcccttcctttagcagttgaaaatctggatgcctctcaccgtactggagttttgggaatttgtgcttcaaaaaactcagatgcttcataacaaaaattgctgcaaaaagactttctttcagtaatatcatagactttattggttttgaaattttatatttaattcccagcttcttgtgacataaaggataaccacagagtttgacaatagaatgttcattcactacatcgttgtagtgagcaggtgtaatgaacttccccttttagaagcatcttcttgtttcaaagtacttgtctgtttagtacctgtggcatttcgagaatggtgggagccctggccctctgcagcccagggcagtcagccatgggagagagtagtctgcgggtctggaccagctccagagtctcgccccgaggcaccatctccctacctggcccacgttatcttaagggtgaattcttttaaactgtccatgtcgtaggtatgtccagatttacacatgccattccagagaatagcaaattaaggaaagttcctcagtttattgtgactagtataactttggtaccaaaaccaagcatggctaatatgaaataaattatagaccagtcttgcttgtgtaaaatctaacaagataggagcaaaagaagtccagtattatgtttaaatattttatatgtatatatctcatgtctacaatgctgactgtaatacagttctgacagagttagcatgaaactccacaggtttaagggtgcagttcccaacgagactgcccttgctgcgagtacaagttaaaagtttggtggtccccagaccacctgttattccgattaactggctgcaaatctgggggttcccatgaatcccctcaagtttgataatttataaattaactgactgaacttgggaaagtggtatacttaagttacactttaattatgaagaatacagatcaggaccagccaaatgagatacagggtactgggagggttcctaacatggagcttctgtgctctcttctcctgggatcagggtatgtcaccctcttgacacatcagtatgctcaccaatgaggaagcctacctgagctatggtgtgtgtagattttatatgtaggtgtaatggaataattggccatgtgattgaactcaaactttcagtgttctctcctttcttccttagaggcttggctagctcaaaccccatccttctacacatggtggcctttctggtgagcagaccccattctgagtcatcttgttagcataatctcccccattctgagtcaattgttagcataatctcaggaatgatccatgaggctcgtgagtaacaaaggcattcctactaccaaggaaattccatgaattagaggttctctcccaagaactagggtcaaagactgaatacattatttattatacaataatgacaaattgaaattatcccaggaatgcaagataagtgtgttaattatcattgctgcataacagtttatcccaaaacttaatgacatgaaaccctaatttacaagaattcaggagtagcctagctggatgtggttctaatctttatgtttcacaaggttgcagtcaggaagtcagcaggggctacagtcatctgaaagcctgactcggggagaatacacttccatgtggcatactcacatggtggttggcaggaggcctcagttcttcaccctatgggccttcccataggctcgagtatcctcacactgtgacagctggctttctccagatctagtgatccaaaaaaaaaaaaaaaacaaggagaaagctgcagtgccttttaagacctagtcattactttattcgtttctttttttttttaaattaaattgagatggggtcttgctatgttgaccaggctggtctcaaactcctggtctcaagcagtcctcctgcctgttcctcccaaagtgctgttattacaggcagaagcctgtagtttttcctgtatcctgtttgttagaagaagtcactcagtttaacctatactcaaaggaattagtttccacctcttaaaaagaagagtatgaaagagtttgtggacatatttaaaaaccaccacagatggtttattcagtaaagttcttaatatgaattagtattaatttattaattcatttgcacattttgaaggagaaaaactctgtgctcatatcactagatgaagcaaaagcacttgatgaaatttaactccatgatgaaacctctcagcaaactaggaagggaacttccttaatgtgataaagactttcattaaatttataattaatttaggaacagttgacataccttatattgaagctttctgtacgtaatatgattcatctatttgttaaacttattattttgttcttcagtattttaaaattgtgtttatatcagtgttttacatttggaattgcaaaatgatatagtgaaagatgaagactggaagtcctagctagagcaattaggcaagagaaggaaataaagggcatctaaattggaaaggaggaagtcgaattgccacgatcatatatatatgtggaaaaccctaaaaacttcaccataaaacttttagaactgataaatgaatttagtaaggttgcagagtacaaaatcaatatacaaaaattagtagtgtttctatacaccaataatgaactagcagaaaaagaagagagtaatccatttacaaaagctaccaaaaaatgaaatacatttgaccaaggaggtgaaagatctctacaaggaaaactataaaacactgatgaaggaaattgaagcgggcacaaaatatggaaagacatccatattcaaggatttgaagaattaatactgtgaaaatgaccatactaccaaaagcaagctatagattcaatgcaatccctatcaaaataccagtgacagtcttcatagaaatagaaaaaaaatcctaaaattaatataggaccataaaggactgcaaatgccaaagcggttctgagccaaaaggacaaagctagaggcatcacactaccagacttcaagatatactgcaaagctgtagtaactgaaacagcatggtactagcataaaaccagacagtagaccaattgaacagaatagagaacctagaaataaatccacatatttatagccagctggcaaaggcgccaagaacatgctttggggaaaagacagtcttcaataaatggtgctgggaaaactggatatacatatgcagagtgaaactgtacccctgtctttcaccatatacaaaaataaactcaaaatggattaaagacttaaatgtaagacaaaggcaccaaagacaaagtgaatcatctattttcttttattattattattttttgaagtatagagatggggtctcactacattgcccaggctggtctcaaactcctgggctcaagtgatcctcctgccttggcctctcaaagtgctggggttataggtgtgagccattagcgcccagctaaatactgtattttcagcccatgtttgcctgcaatatgaagagattgctatacttattgaaaagaagagaccggaagtggtggttcatgcctgtaatcccagcactttggaaggctgaggcaggtggatcacctgaggtcaggagttcgagaccagcctggccaacgccatctctactaaaaatataaaaattaaccaggcttgctggcatgcgcctgtagtcccagctactcgggaggctgaggcaggagaatctcttgaacctgggaggcggaggttgcagtgagccaagattgcgccactgcactccagcctgggcgacagagtgagactcgtctcaaaaaacaaaaagaacttgcatataaattgacccatgcagttccaacctgtattgttcaaaaaaaccaaaacctcccttagacctagaatcccacttctgcaaatccagcctacagttttatcagcccaaacaacaacaaaagcatctcttcaagtttatttattgccgcattgcttatactaaattattggaaatgatctaaaatgtccatcaacatggttgtgcactgtggcatgcacctgtagttgggactgctcgggaggccgaagcagtgcaatctgattgcacctgtgaatagctcctgcactccagcctggaccagcatggcaagaccctatctctaagaagaaaatgttcatcaacgagaatgagcaaatatgaccataagatatttataggataaaacactagataacaatgaaaatgaattaagaagaactacaagtatctatcatggaaatacttcacagtgttatgtgaacaaaattaaagcattatatatataaaaacagtaaagtttttatatatctgtagaaagtttaacaatatgtaaggcaatgctatatgttacttaacaatcctttctttgaaataaaaggcaagttgatgtgtgtttaaactagaaatcccaggaaaaaatcagaaaggtacctgggcttaaagaaaaatgctaaacggggctgggcgccatgactcacacctgtaattccagcagtttgggaggccgaagctggtggatcacccgagatcaagagttcgagaccatcctagccaacatggcaaaaccctgtctctactaaaaatacaaaaattggccaagtgtggtggcatgtgcctgtagtcccagctactcgggaggctgaggcaggagaattgcttgaacctgggaggcggaggttgcagtgacccgagattgtgccattgcactacagcctgggcaacagaatgagactccatatcaaaaaaaaaaaaaaagatgctaaaaggaaagcagggacaagtaaatgtcaaatccatttcatgccatagaacttttttttttttttttttgaggcggagtctcgctctgccgcccaggctggagtgcagtggcatgatctcggctcactgcaagctccacctcccgggttcatgccattctcctgcctcagcctccccagtagctgggactacaggcgcccgccaccacgcccggctaatgttttgtatttttagtagagacagggtttcaccatgttagccaggatggtctcaatctcctgaccttgtgatccgccatccttggcctcccaaagtgctgggattacaggcgtgagccaccgcgcctggcctagaacttcttacaacaccctaaaccagtacatttcaacctgaaaagatgttgtaacgcagaataaagaaaataaagtacagatatttcattcccaaggcggggaactcttctaggttcccaagttcttgagcttcacgtgcatacagcaggaatctgtcatcttgagggagttctttcttaaacctatgggtttgtaagattttagttttctatgctgtccttttttggtcatgcttgtcagggaagaattgttaaaaatctattttaacaccctctgcccttattcagggcagttagagacttaaattttacgtacacatactacctttgaaccttcagtgtgttgtttatgtactgaaagattgcagttgaatttagatcatgctttgaagttccctttgtcagaccacattgtttgtacccaaagaaagacttcattttctttttgtctgtaattatttccatacttatttaacttggtataacatgtggtactgtaaaagcataacccaagccattgtttgccttaagcaacattttagacattttagatttggggatgtggtgtttacttatacaagcctttcttaagcccttttaatttatatctcaaacttgaggatatccatgaaaacagcggaaactttttcctcaccggatcttgacacaagtcagggatggaagtgagcaaaaggaagtggtgtggtttttatatcatttcagttgtgttgagatagggaaatgggatagtttatccactgtactgctcttttgggaaagtctggtttgtatataaaagtgaaaggaattggcataatgttttaatttcttctgctccattcagtcattccctcaataaatatttatttagtatcgactctgtgccaggcactgttccaggtgctaaaaatataaagtgagtgaaacagactaaccctcctggcctcatggagcatatattctagagcaggtggcaggcaataaaatacagaaaaattatatcaaattatatagcatgacaaatgctaaagagaaagaaacagccagaaaggagaggagtgctaggcatggggatgggattacagttttaaatagggtgggcaggaagcctgtaaataagaaagggattttgagtaagtgcttggaaggggcaaggcagcagtcccggggaagaccattacaggcatagggatctgcacgtgccagggtcctgcagcaggactgtgagcggcaggtgcaaggaacacctattaggctggaacggagggagggtggaccactggagactttagctttttgtctgagtgagttggagcaccgttggagggatctgaatggggtgtgatgtggtttaacatgctttctcttaggatcactctggctgctgtgttgcaaatccatagtgggcacaggtggaagcaggaggccagttaggaggtgccttcagcaatccaggcaaaggggttagtggcttggtccagagcgagcagtggaggtagtaggaagtgtgtgggttctggacagattctgcaggtacaaccagtggatttgatgacaggaaatggaatgcaagaaggaaagagggagttgtcaagaatgacttgagattttaggcctggttacatcagtgtagcgatattctaaaaataaaaaaaaaaagattttagacctgggacttttaagattttacaccaagtaaagaggctgtcaacggaggtgggaaagacttaggatctagcaaatttgggagggaagaggcaaggaaagataaatagtgacaaattgtatagttgctgataacattgttaagtcaatatttatactatttgagctgcctttttttttttttccccctctgagacagtctcgctttgtcgcccaggctggaatgcagtggcacagtctcagctcactgcaacctctacctcccaggttcaagcagttctcctacctcggcctcaagtagctgggattacaggcacccaccaccaggcctggctaatttctgtatttttagtagagatggggtttcactatgttagccaggctggtcttgaactccccgcctcaagtgatctgcctgcctcagcctcccaaagtgctgggattacagacgagagccactgtgcgggccttagctgtcttaaaaatagcacttatagcagcctgtgttttcttttcagatgttatcaagtatcttttctggtaagacatttatttgcctttattcagaattgctaattttatgctaatctaacccagaatactcaagtgtgcctttccctttaatcctcatattagctatattagctagaatatttttggttgtaacagaaaaattgactctctctgacctaaaaaatggaatttattggctcttaagagttccaaagtaattgaggcttcagacaaggttgcttgagtggctcatcgatgtctcccgggatctggcttctttcagtctcctggctctgccttctggttctccttctgggcccaacatagctgccagcagtttctgggactgccttattcatattgagtctgagagagtgactttgtcactgcagggtcagtcaaagtcctgagactattagaccagctcgcccctgaactttttgtggcagggaagatagaatatgcttagtgtaagagcctctactcctgagatcttaggggaaatctttgtaccctgaattaaaaaaaatttttaaatagttacataagtggaaatgattgatttttaaaaattgcttttgcattgtacaagcaccatggttaacaaaacaattcctttttaaagcagtcaggtgggaagggaaaaaaagtaaaattgtattcatacattagtttgatcaagataatttttcttcttagagatttaatagtgttgccacttgaccagctggaactacaaaggaaccattagatagtaatgaagtatgatacccttttcagcactccttctcacctttttactttacatctccagttttgcctcgcacaaggtctcttcttcctctgtggatcctctacctacatgtgtctacctgctaattagacaggcacatgcacactagttttctttatccccaaaattcagtttgcaaatgggaccgaagagctccctgttcccctcatgacaccgacacgacaaaaaaaagttattccactaattcccttgatggtcggtttaggagtttctgcctccactattgctctcggtactggaataacaggcatttcaacctctgtcacgaccttccgtagcctgtctaatgacttctctgctagcatcacagacatatcacaaactttatcagtcctccaggccctagttgactcttcagctgcagttgtcctccaaggacaactccgaggccttgacttactcactgctgaaaaaggaggactctgtatattcttaaatgaagagtgttgtttttacctaaatcaatctggcctagtgtatgacaacataaaaaaactcaaggatagagcccaaaaacttgccaaccaagcaagtaattatgctgaatccccttgggcactctctaattggatgtcctgggtctcccaattctgtcctttaatacccatttttctacttcttttattgggaccttgtagtttctcaattcatccaaaaccgtatccaggccatcaccagtcattctatacgacaaatgtttcttctaacaatcccacaatatcaccccttaccacaagatctcccttcagcttaatctctcccactctaggttcccacgccgcccctaatcccgcttgaagcagccctgagaaacaccgcccattctctctccataccaccccccaaaaattttcgccgccccaacacttcaacactattttgttttatttttcctattaatataagaaggcgggaatgtcaggcctctgagcccaagccgagccatcgtatcccctgtgacttgcacatatacgcccagatggcctgaagtaactgaagaatcacaaaagaatgaatatgccctgccccaccttaactgatgacattccaccacaaaagaagtgtaaatggccggtccatgccttaactgatgacattccaccacaaaagaagtgaaaatggccagtccttgccttaactgatgatattccaccacaaaagaagtgaaaatggccagtccttgccttaagtgatgacattaccttgtgaaagtccttttcctggctcatcctggctcaaaaagctcccccactgagcaccttgcgacccccactctgcccgccagagaacaactcctctttgactgtaattttcctttatctacccaaatcctataaaacggccccaccctcatctcccttcgctgactctcttttaggactcagcccgcctgcacccaggtgattaaaagcttttattgctcacacaaagcctgtttagtggtctcttcacacagacgcacatgaaactaggcaagaatcagtgtttctctacaaattgagttgacaaaaagaaattatcttcccctgcccccacaaaaaaagaaccagtatttctcaacaaggagagtactgttagcatttggttctttattttgaaggattgtccctgcacattgcattttctatcctggtccctggtcaaactgtatgtcctgtcatatcccagacattattccaaccaaaaagtcacctacatatttttagatcctcttaggagggggtggtaacccagccactgctgatgcctgaggggagtgcaaagctgggtttttgaggagctgggactgagatcctgagtagtaggcaccactgggcctaaaaggattccatggggttggttctgggagtgtggaaggaagcagagagtgtagattgctgctgccaattgaatgccagtggcattcaggcaactgacaggaacagcgaaccaaattgggaaaaagaaagtcccttctcccctcttccagctttctctagttccccagttggcagagcctctccaggaaccagctggtgaaggacatattgtcagcagcatcccagctccagcatcagaaagcagaatctatagatagaagagggagctttttttttttttttttggctgaaaagcgatagtgtaaaaagggacacagtactttctgttttttaatctcattactttcctgccagcgccttaacatgcagtaacaagtggaatttgggctttgtcagcagcaaacctgccacttactggttgtgttaagttgggcaagtttctttctttttttttttttttttttttttttttgagatggagtctcgcactgtcacctgagctggagtgcagtggtgtgatcttggctcactgcaatttctacctcctgggttcaagtgattcttctgcctcagcctcctgagtagctgggtttgcaggtgcctgccaccacgcctggctaattttttgtatttttagtagagacagggttttactatgttggccaggctggtctcgaacgcctgacctcgtgagccaccatgcccggccaactcaggcaagtttctttgcgcttcatttttttttttttcagagttatgaagatgaaaaaagatcttacagggttcagtaaaaaataacttccagtttcctgtttaacatatgtgctcatggtatacccgacaaaacactgcactttggattagaaaacctgggtgttagtttgtcatatatactagctacatggaattcagcaagttatttatctccttgaacctatcttttctctgtaagtaggaatgattttacttactgtaaggatcacagagatgggataatgcacgtaaaactaatttgtaagttataaaaatgacagtgacaatgggatgctaagcaggtaccattaaataccaccacatatctgagtttctctgatttaatctgcacaaaatacctagatcatctgttttaggctagactctgaactctttaccaccacattaaactgtttttttctctattcaatttaccagtaaaggttgagcatccctaatccaaaaatctgaaatctgaaatgctgtaaaacctgaagtttttgagtgttgacatgacgctcaaaggaaatgctcattaggtgttttggatttgagttgctgaaccagtaagtatagatagtgcaaatattacaaatttaaaaatccaaaatccaaaacacttctggtcccaagcatttctaataaggagtagtcaacttgtacccattgtatgcctatggggtgaccagaccctctccctttccagacagttctgcaataactgattcacttcgcctgtttttggtcatttctgcgtgttctagaggagaaacagaagagtgacacctaggtctcttaaatagacagctgacagacattacgaatctcttcgaagtacagatatgccaaagattgctgtgtagtacaatctagttgtaattgtgagacttttgttgttgttgttgaatacagttaaacaaaaaagctttggagaaactaggttagggaatttgtagtacaaggttgaatgatgttttgaaaacagattatctatttgaaaaatgtttcagaaacctggaagcatttcttctgcatctaatgttgaggtcctggtgaagggtataaaacacacagcatcaactatatataatgctatactagattgtcttgattctgtggtcctggaagagtttatacttgtgttggggaaactatcttggcatagaaggaaagtgaaggttttgagtggggcagggacagttgagcagaaatacaaaggttaaatgtgggcttgttttgattgttaattaataattgagcatgggggaaaggtagagttggaaagtaatttcaggggtggcgatgaaattggtaacttcaaagtggtggagacatgacagtggaagttttatacagtggaacttccccatccctgttttaggtcttcacttagttgcatggttggctctctttgctcctggcccacgggcattattgtaaaactttctaaaacaccctgttatgaatgtcttacccatagcaagatctgacagcgtggacaccaaggcaggcatttcggtaagatttctgtgtattacctcagatacactcagacaactctttaagcaagttattttcttcagggtttatgtttagatttgcgggatattgttttctacactgatgtaaataactgcgagtggtgttgctccagttgtacaagtgtgtattcctctaaggattgatggggaggagtgtagagaacgggaaggaatggatgagttgcttgttaagggaaaagatgatattcttatgctaatccaggccctggataaggagcagagcagccatgcgaacaatggccttggagccaggaagtctgcagtgagtctattccttctcagaaagcttgtcagacccggcgcctggagctgcctggcggggagggacccctggaaaggagagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaaaagaaacagtaccagtctgtgtatatagcaaggggaagtaaatttatttagatgcccatttcgtctaactattcaatagcttttaaatggcagcatgattaaaaaattttgattatgcagcatgtcaaatatctgcatctccttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagatcgcctgaggtccaggagttcaagaccagcctggccaacatggtgaaaccctgtctatactgaaaatagaaaaattagctggacgtggtggtgcgtacctgtagtcccagctactccgaggctgaagcaggagaattgcttgaacccaggaggtgaaggttgcagtgagcagaggttgcaccactgcagtccagcctgggctacagagcaagactctgtctcaaaaaaaaaaaaaaaaaaggctggacgttgtggctcacacctgtaatctcagcactttgggaggcagaggcgggaggatcacctgaggttgggagttcgagaccagcctgaccaacatggagaaactccatctctactaataatacaaaaattagctgggcgtgatggcgcatgcctgtaatctcagctactcgggatgctgaggcgggagaatcgcttgaaccctggaggcagaggttgcggtgagctgagatggcgccattgcactgcagcctgggcaacaagagtgaaactctgtctcaaaaaaaaaaaaagaattgttgaaaaataaggttaatattttgctatgtgattgtagaaacagttaatatgagacaaaggagaagtgctcagttattaataattacatctgtttgttgaaatgtttactgagatgtaatattactaactcttttgagttagtaatatccccattttgtggtgaaggaaaccgagacctggatagcttaagtaattccccaaaatcacacagcaaataaatactggagctgatttttaaaaattatttatatttattattttatcagtgaataccacatcagtgtatgtggtgttaacgcctttattaatgcagtttttagacgaatggtgttctggggccctcccctcttttcactctcttggaaggccatctccagagtcatagctgaatattaccgttcttttagcataaccgatttgtatgttcagccccaaatgtgtcctttaagtttcagaaccaaatgcccgttagacattccctttgggtaatctcagatctctaaatttgaacctttgatctcttcactcctgtcaaaatcactcattcccatttcaataactgttcatgccacagatgtgggaatcttctttgacgcctcactttcccttaccctacatttaatccattgctaagtaccactgagttttgttttgttttgttttgagacaaggtctcgctctgttgcccaggctggagtgcagtggcataatcaaagttcactgcagccttgaactcctgggctgaagagatcctcccacctcagcctccctagtgtctgggactacaggtatgcaccaccatgcccagctaatttttttaagttttttgtacagatgaggtcttgcagtgtttcccaggctggtgttaactccagacctcaagtgattctcccacctcagccttccaaagtgctgagattacaggtgtgagccacgtacccagccaaaaattatttttgaagtatagcatgagtccatccactataccactgccaccctattctttttttttttaattcatccatctgcacacggattctgccctaatcttaaccaccattgtcattctcctaaatttccacaatattctgcttactcatctgtttgcttttgctattatcccctccagtccattacgtagaagtcagatgatgcccacttaggcttaaatcccaagtccttcatatgcccttgcctgatctggtctttgtcttctctgcctcttcaccctcatctcccactacactatctcttattctcaacatttcagacattgttctctctttgcttttctctccctcaagatctttgcccacggtgttccctgtgcttagaacttcccgtctttctttgcctgactgactctatttttcagatctcaacttaaaggtcacttctcagcattgcttccctttccgcttcatctagattagaggggggtcactgcccctattccttcaggacctggcacttttcttcctttgcacttatcatgagttatgattgtgtatcatttgtgttttcttgtttggtgtcttgagtatcttaattgttttgtttaaggactctgaacttcatgaaggctgggcctgtttggctctgaacagtgtattcttggtatctaatacagaatcatgcatagcacagacacttaataaacatttagggaataaattaataattcaacggcaagaacactgtttccataggactccagcattggaagggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagatggttgtcctgtttgattacagcagcatttcccttcattctcagactgcatgcatgtcttaggagttgtcatcaataccaatacgtattgagctcgtagtcagggaagatttgatggctgttctccatacaagttatcacagctttttttgtctataaaaatttcttgcagattgaattgttatggatagcacctgttagtgacttcctttgccaggttggcaagtgtgttgtaaacatggatgagaggaggaaacttctatttagcacctactatgtaccaggctctcctaaatagtttaaaatgtgtatttacattatataatatatataaaatcaggcagggaagtataggatagttgttaacatgtagaatctggaatcagacctccttgattttaattatgactctgccacttaacctgttgtgtgatctttgataagttccttaaagtctacttgcctgtttcttcatctgtaaaattaaaataataatttaacctttaaataagttggttgatggtttgataacttaatatatgcaaagcatttatgactactggcacatagaggttaatatgtgttagctattattttatatgagttccttaagtttaaaaatatttaaatttatttaattttttattttaaaaattattttaaatatgtgtttgctgttatctcatttggttctcaaaataactgtcagttaataaatatcattccagatttgtttgtttgttaagatggggtcttgctgtgttgccaaggctggagtgcagtggctcttaactgttgtgatcacagtgcattgtagcctggaatttctgggctcaagtgatcctgtttgagcccaggattacagctgagattacaggcggtcaccaccacagttggcctcattccagttttaaagatgaggaaactaattcagagaggttaagttaaaggcagatccagaatttgaacttatgccagggtagcagggtcgtggatgtttttgcggaaggaactcacacacagtcctttcctctgaaagggaaagcacttagagtctcacggccagccagctctgcagggtgccttggttgtggctctaatgagacaaggccacatattagctttaaataaaccaatgaggaaacagtgacaatgaaagatgtaacaaggcatagcggtcagtctcctgcccaagactgtgagttccttgcagcaggaacaaccatactcatatttgtatttctggtacctaacactgggtcggtaatacgtactccagatgcaggccagttgcagtggttcacacctgtaatctcagcactctgggaggaggccaaggccacaggattgcttgaggccaggagtttgagaccagcccaggcaacatagcgagacccaccgcccccacccctattaaattaaaaaaaaaaaaaaagatgttgttggtgaataagtgagtaaattaataagtgaaaatttggggaggggtggagacctagcaagggaggcaggaccaaagccagggtttctggcatggtatccactggagagtggtagccagtggaggagcaagaaagaaaggtgtgggtttgatttagacaggtggagtgtgattctagtagaaatatttagtgggaaaattgaaatgaggaagagagattaggattggaaatacactggaaacttctcttgaattggaaacctggaacatatatccttagaatgacagttgaattatttcaagaagttttcaaagaaatgctgttaaatcatgtggcagacattattctatagttattttagactttacatctttttctctcagcattatgtaatgggaaacaattttatattacagaaataagagattgcagggatttttagaactaagctacatataacatacacgtgtaaatgatacctcactgtaaaccttctttgcctcagtactgtgaataactttggaaagctaattaaagtgaaaattcttacttagatattataaagtagaaagctcaggttattaatgtagaaatcacaccagggtcattgtgtcataaataagcaagatctttgtcattcaggaatagttcaagctgaaagtcaataaaatcaaaccacatgaaacaatgggatgggggtaaagtagaatgatatatatcttgatactaattagccttttcccccgttatttatttaacaattttactttgaggcatttaaaagttcactgtctatattaataatcaccaaaccttaattggagagattatgtttcatgtcatccatattagaagttcagtttcatcttaataaagtcaaatttgcaatattttaggaaataatttctttaagatactgcttttttccctccgctcccctcccctcctctcctctttttttatgagattgtgtctcactctgtcacccaggctggagtgcagtggcgcagtctcagcttactgcaagcttcgcttactgggttcaagccattctcctgcctcagcctcctgagtagttgggactacaggcgcctgccaccacacctggctaattttttttgtatttttagtagagacggggtttcactatgttagcctggatggtctcgatctcctgacctcatgatctgcccacctcagcctctcaaagtgctgggattacaggcgtgagtcactgcacccgaccttcttttttttttttttttttttttttttgagatggagtctcgctctgtcgtgtaggctggagtgcagtggcacaatctgcaatcttggctcactgcaacctctgcctcctgggttcaagtgattctcctgcctcagcctcctgagtagctgggattacaggcacccaccaccatgcctggctaatttttgtatttttagtagagatggggtttcaccatgctggccaggctggtcttgaactcctgacttcacttcaggtgatctgcccaccttggcctcccaaagtgctgggattacaggtgtgagccactgcacctggctcctttttcttttttttcctttaatgatgaagcaccctctttaattaaatatgtgtaattttcgcctggcatggtgactcacacctgtaatcctagcactttgggaggctgaggctggcggatcacctgaggtcaggagtttgagactagcccggccaagatggtgaaaccccatctctactaaaaatacaaaaattagccgagtgtggtggtgcacacctgtaatcccagctactcagaaggctgaggcaggagaatcacttgaacccaggaggtggaggttgcagtgagtcgagatggtgccattgcactccagcctgggcgaccgagcaaaactctgtctcaaataaaataaaataaaatgaattaatatgtgtaattttctaggtcggcttcctcttctatctatagaataaattatttattagaaagacttagggtgttttcattatatctactagaatttgcaagaatgttgatggttacccttatgttttaaatttaacttttcctgtttaagtcttaatatagttgggaattttcatgttattaataaaataattagaacagccagaaaggactattgagattgtttaatatacttcccttgttgtacatatggctaatctgaggtcaggagaggttgcagcctattaactaaattatttgaagtttgaaattatagtgcctaaaaaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacataggcgtaatgatacacagcattaggtcttgtgaggattaaatgagataaagtatgtaaagccacctcagttagtagctgaaagacagggtaataggtagtccaggctgagcttcaaaattcctctctcctttaaaatacaataaggagcaagtgtaaataataattgaaaaatcattttattggccaggcacagtggctcacacctgtaatcccagcgctttgggaggccgaggtgggcggatcatgaggtcaggagttcaagaccagcctgggcaacatggcaaaacctcatctttaccaaaaaatacaaaaattagccgggggcctgtaatcccagctactcgggaggctgaggcaggagaatcacttgaaccccgggaggtggaagctgcagtgagctgagatcgcaccaatgcactctagcctgggcgacagagcaagactcttgtccctgccccaaccaaaaaatttcattttattgttgttaaaagactttagaaagataactgacacttgtctgtgctgaatactaaaatttcttcatagagcactgacagtttgtttatgaccaataaagtaattttgctactatgtgttcacagcttagaactcccaaacaggaagttattgtgatgactcttaggaccagatggcctgtatttgcacataagctttttcctgtatggtttaagtaggataatattttaagctgaaaagacagtactgttttgcaagaggattttagataaaacttactggatgtcttcgttctcaagttttttacttcacaggttgctttttcctaatgttttgatcacagtgatctggattaatatctgctgttaagaagaaacatgattaacaccataaagcttttgatattttcatcttttttttttttttttgagacagagtctcgctctgtcaccgaggctggagtacagtggcgccatctcggctcactgcaagctccgcctcccgggttcacgccattctcttgcctcagcctcccgagtagctgggattacaggcgcccaccatcacgcccagctaattttttgtatttttagtagagacggggtttcaccgtgttagccaggatggtctcgatctcctgacctcgtgatccacccacttcggcctcccaaagtgctggcattacaggcgtgagccactgtgcctggctgatattttcatcttaaagcacaaacatagaatgaaatctatagcttctttttattttgccttagtattataacaatatccttagtattacaacaatatccttagtattaccatgctaagaatacagagccttcagcaaaagccacttttacttgtgaaacaccaaattatttagtacaatacctttacttcaatatctgttacatgccttgttgatcagcatcaaccaaagctgctatagttttgaagatgagttaaattcatagtaatattatatttgctacctcacttccaggtaatctccattttggcataaatttttttaaaatctgtttagatcacacgtaggcaatatgatacaaaattctcagtcttcgccccagttcacattgttctataataaacttttattaggtggaataagttggtaattagttactacgtaaaagcaaaagatcttattaagaattacatttctctgataaagagtgaaatttgttacatttcctttcaaaaaattattttgatagttgcttcaaataacacacaaatgtttgctcttaaagctaaaaccaatgtagaaaagttatttctgagagatcattaggaaggattgtagaatggtattaatggaaataacttctgactttagctctagctttatcttgttttgaattatgtctcaggaaaataaacttatctgtaccttggtttccttgatgtaaaatagaaataataatgcttatcctagatataaacaagaatgttttgaccatcaactgttagggtatagatttaagtgctttacattgagataaagttacttaggtttgaacagaaaaatgagtcatctgatattaacagctgatagatacttagttcttattttttaagacttggtcacaaattttacaacaggatatattaatgttggatagatatgtagtcccttttttggattttgtcacaaatttcagaaatggattttagttttaagtaactaataatgacttcaatagagatttatttttaacataggtggtagatgtttgctgtacattcagttattgagtagtgtcaaggctgacatgtctgtaattttcttgacatttcccttgtggttcccaagtggttactattatctgcatttgaggcaggtaaaacggggaaagggtcagcactggcctcaactagacctgataccaggaaagcaaaagtgtcacagattttgtcttaagtcttaatcattcctaatagcaagagctactggaaaacagagaaacaggattgtcacaattgtcttaatctatatccattgcctagggctgggtgtgttgttcccccaaacaaaatcagagtttggttagctgggaaaagggggaaaataggtatcaattggacaattaaaaggatctgggagagatttaattttttccatcaattagaatgttttcctctacaaataattaaaaaaaaattaaaagagcttaaacatgacattttgggctaggtgatttttatttttttaaaaaaaagtttgaacaataaagagcatgtagtaacacacaggaagtctgtatataaggggactgtagttggttatgtggctcatcaagacccaagttctttgtcttttcaactgtgacatctctaaatgtcaggttagccacagtgtcacagtgtggctgctgagagactagacatcacatgcagatgaggtaagcttgagttgacaatgctcagttaaagaagagggaaatctgtttgtgtctctttttaattgataaatctttccccattcactcacttcctctccccaacagacttccttctaatcttagtggccaaaattcattatatgctcttgtgttaaatcactggcaaggggaatggaactaaaattgttggattagaccaacgattatctctgctgagagtagagggctgcgcttccctgaatcacgtggaggaggggcagacccttaatgtgtgtgtacatgtgcacatgcctgttgccagcaagggaaggaggagaagaataagagtatctgttgctgggtaccacatttgttgacctgacatcatacatatgctaaaatgctcatgttgctatgaaattttcagttccttttcaaagggttctataccccagagttgcatccatttagtacatgcagctactaatccaggacttctggctggtgggaagccctctccttcgggtccaggtgcctcttcatggtccagcagtgtgtggctaaaagcaattatcagtgcacagtatatccagtatccagtgataaagatgaagtgggataagtactatataaaacttccattcagaggaagaaaaattggaaacaacctcagtattcactgctccatagcatgtagattaatgatgcttaacctgtttgtcagcctccagttttattttctgggaggatttgccttgtctctggtgttccttggctagtgtttctgtcttcatggtcacatctgagctggaattagtggaggatgatctttgtggagactgaacagctttagcggcctgctttctgttagtatggaggtctgattactggaaattgtcctatggattgaaaactcacagcctgactgagtcagcctgggatatctttggaagtacagttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtctttctccgtcgaagactgtaagctttaatagatatgggactgtgttttgtttactcttctagtcacccagggcttaaaacagtggctaccaccgtgtactcactcagtacattttggtttaatggatgaatacagttaaagtgaaaaaagcaagttgcaaagctgctttcttagccatatatttttacactgaccaacccagtaacaacaagcacctgtaacaacccagttgtagtatctgattgtcttttttcactaaggatctagaactccttggagaaatcactgagttcaagttcggcagggaaagagcaaggtgatcttggtattttggccagaaagcaaggaaaagttcaaaggattcagtgaccagtttgaattgaatactaattgtagtggattcaaacaaatcaaatatgtttaaatccacgtgtttgtaataacacttaagaaaaaaactagttagggctgagggctgtgacttacacctgtacatgccaacacttgggaggccaaggcaggaggatcacttgagcctcaagagtttgagaacatccacggctaaactgagagtccctttaaaaaaaaaatagtttgagaccagcctgggcaacatagagctggtctctacaaaaaaaaaattttaattagctgagtgtggtgatgtgtgcctgtattcctggctgaggtgggcgggagaatcacttgagcccgggagcttgaggctgcagtgaaccaatgatgacgccactgcactctagtctgggcagcagagcaagactctgtctcaaaaaaagaaaacaaaactagttggttactgttaaaagatgctaatgaagtcattaattttgaaaactggtaaatagagggagaaatcaaacattaatcttgcctttctaacatgaactgtgccacctgtatccaattagtaggtgagggaaagcatctcatagatgtattccaagtcataaaaaagagaaatgataggattagatacattattttatactatgccgattgaattagtgaatctagaccttaaaaacagagataagcaggcatttggttccctcctgcccacaacatacagagcagctgcatttcagcgctcaatagacacatgtgacttgtggctaccatattggacagcacagctctcgagctaattaccatttacaaaatccatagagaacaagaggacatgttaaatgatgccaggaggatgtgatcagaaattccagactgtggtaaatactatactagtaaataccggacaagttacccaatgtctacaagtaaatctcaaggacaggaagaggcagaagaaactggtagattaagagacttggagacaaccagcttatttggatcctgattcaaggaaactactaaagtaatttgtaatatttatgatacaattggaaattagaaagcaatttataacatttataatataattggaaatttgaacattgccttgatgtttgatgatattggtaaggataaggaattactattaatttttttaggtgtgataactgtgttttttttttaagttcttttagagatacacattgaaatatttacagataaatggacatatctggtattagcttcataattatatgaaagggggagggagtgaaacaagaagggccatgaattcatcattataaaagctgggctgtatgggtatgtgtgggttcattgtacagttttctctacttttataaaaggtttctggccaggtgcagtggctcaggagttcgagaccagcctggccaacatggtgaaaccctgtctctactaaaaatacgaaaattagccgggcatggtggcatgtgcctgtagtcacagctactcgggaggctgaggtgggaggatcgcttgaaccagggaggtggaggttgcagtgagccgagattgggccactgaactccagcctgggcaacagagtgagaccctgtctcaaaaaaataaaaagttttctggaagaatacttcatttcaaacatatatatgtaaatgaatagaaaaaggacaagaagcatatacatcaaacggataatggtggttatgtttaaggagtgggaaggggattagatgggcccaaagaggactttttggtttacttgtggggctcaatttttttttggatgctatgagaatatattgttgttttatttgagtattttaaaaactacttttaggaaaaaaaaaaaaaaagacccaacacggtggctcatgtcatgtctataatcccagcacattgggaggctgagacgggcggatcacctgaggtcaggagttcgagaccagcctggccaacatggagaaaccccgtctctactaaaaatacaaaaaattagccaggtgtggtggcacatgcctgtaatcccagctactcgggaggctgaggcaggagaatcgcttgaacctgggaggcggaggttgccgtgagctgtcatgccactgtactccagcctgggcaacaggagcgaaaacgccatctcaaaaaacaaacaaaaaaaccatcaaaaactacttataggaaaaatacttatttcaagcatatgtctaagtagagagaataatataatgaaactccatgaacttgtcactcagttttgacagtatcaactgatgaccaaggctgtttcctctctacccccatgcacttctccctcacccacgtcacccttggattatcgtgggtaattttgaaataatatttcagttaagtataagacaccttggctgggcacgttagctcatgcctgtaatcacagcattttgggaggctgaggcaggcagatcacttgaggtcaggagttcaagaccagcctgccagcactttgggaggccgaggtgggcggatcatgaggtcaggagatagagaccatcctggctaacacggtgaaaccccgtctctactacaaatacaaaaaattagccgggcgtggtggcgggcgcctgtagtcccagctactcaggaggctgaggcaggagaatggtgtgaacccgggaggcggagcttgtagtgagccgagatcacgccactgcactctagcctgggcgacagagcgagactccgtctcaaaaaaaaaaaaaaaaaaaaagaccagcctggccaacatggtgaaacaccgtctctactaaaaatacaaaaattagccgggcgtggtggcaggcgcctgtatcccagctacttgggaggctgaggcaggataactgcttcaacccaggaggcagaggttgcagcgagtggagatcgtgccattgtactccagcctgggcaacagagtgagactccatttcaaaacaaaaaaaacaaaaagcaaaattcctcaaaggccacatactgtgatcataatgcaataaaaggagttcaacagtgtaaactttgtttgagcgtatgacttttttttttttttttctatttgagacgagtcttgctctgtggcccaggctggagtgcagtggcacaatctcagctcactgcaacctccatctcctgggttcaagcgattctcctgcctcagcctgctgagtagctgggataacaggtagacaccaccacactcggctaatttttgtatttttagtagggtttcgccatgttggccaggctggtttgaactcctgagctcaggtgatccacccacctcggcctcccaaggtgctggggttacaggcctgaaccaccattccctgccagcctgctgggttcttaagcgatccttccgcctcagccacccaagtacctggaactacaggtgtgctccaccacacgcagctaattttttaaattttttgtagagaccaggtctcagcatgtttcccaggctggtcttgaactcctgagctcaagcatcctaccttcctggacctccgtaagtgctaggattacaggcatgagccaccatgcctggcaaacacatgatttttttttttttttttttttttttttttttttttttgagatggagtctcactctgttgaccaggctggagtgcattggtgtgatcttgtctcactacatcctccacctccctggttcaagtgattcctttgtctcagcctcctgagtagctggattacaggctcacagcaccatgcccagctaatttgttgtatttttagtagagacaagagtttcaccatgttggccagactggtctcaaactcctgacctcaggcagtccacccgcctcggcctcccaaggtgctgggactacaggcgtgagccaccgcgcctggccaagcatatgatttttaatgcaataactatattcatgtttctagaagcttttttttgccattcagtgacattatggatgacactgcatgtcagtatgtgtcggacatgtgtcagcatgtgtcggaatgtatcaacccatttttgataatgggttcagaaccaagtttgattaatgttaactgatttatgcagtttttatgttcaactgaaatacatctaactataattttttattggccttccaaaagtgtcataaaataagcctaatcattcacatatcctatcagatgtgaaaagcccatttctatgctttctggccctgccgcaaaatcttttcttttcttctccctttgattttcctcctagaccaacgtagtatgacagaactttgtttggtgatggaaatttctatatcagtaatttgcaaactatagcccacaaactaaatccagcgcattgctgcattttgtgctgctcatgagtgaagaatggtgtttttgcatttttaagtgattgaagaaaaatcaagggaatatttaatgacacatgaaaattatatggaattcaaattttattatccataagtaattttattggaacacactcatgttcatttttttacatgttgtctggctgattttgcattgtgtcggcagaattgaatagttgtgacagagaccttggggcccacaaaaccaatacctgttttctatatctctgctgtcttgtgtgatagctactagccaaatgtggcttttgagcacttgagttgtgactagtgtgggtgagaaactgatttttaattttacttcattttaattcgtctacattttaagtcacatgtggctagtggctaccatatgggacagcacagttgtagacatgccaccttttccctagttcttgcttccttgtacttgactttccttctgctgatgtcttcctggtttctatttaattaatgatgcagactgttgttgcagaattcattaggctaccattgctgattatctcatatgtatagtgcatcagtagcccattggtctcaccaaccgtttgccatctgagttctgttgtagacattctatcttaaggttgcggcagagggcatttatttgctgtagaaaaaggaagccaataaattattgggaaaatatgaaaaattacttagccaggaataaaaatctagtaaaatcattgatgccaaaaattgctgttgatgacaaggacctgtaaatgtgcctgtgtatggtcatgtgtctcttgtaactgtttgtctctttgtatgtatatgttttcattttttcctgagatgttatacttaaacatgtaagctattaaatattttgtgtgtgtttgttttgaaatataacctatacccccagtccaccccagggctcgtagtttattctttgtaaatacacgggacttgtgggtggcgagagattgacatgttcagaactgacagaaggccatgtgccaagtaaagtgatgatggtgaggcctgcaggacccagatcctgttgggccctgggagcacacagtggaggttggattttattctgagtgcattgtggagccattgattggttttatataggagtgacagatttgtgtttataaaatgtctctggctgctctgtggaaaatggattgcagggaccaagagcagaagcagagggaacagttggagacttcttaccttagtagaggcatgatgtgatgggccttggtgacaacagcggagttggagaaaaatgaaaacaattgacatacattttggaggttgagccaaaagactttggtaagaccaggtttgaggcaaatcaagagttcatttaagacaagtcagtcaggagatgtctaagcaggtcatggctagagggggtacatccaggaaccatcaacagagtgggcgctgtcccctagggagagcacagagaggctctttcctgttacttttctttgtattcaatatctgcttggtgaaatcttgcaagtttttaagatgtagcttagatttcattacttttgacacctaagatcagtttgagtttgacacctaggatgagccttttcctttgtttacatgtaaacacctccgtattttgtcacttttttttttttttttttttgagatggattttcgctcttgtcgcccaggctgaagtgcaatggcttgatctctgttcactgcaacctccacctcccaggtcaagtgattgtcctgcctcagccacctgaatactgggattacaggcgccttgccaccacgcccagctaattttttaatatttttagtagagacggggtttcaccatgttgaccaggctggtcttgaactcctgacctcaggtgatgtgcccactttggcctcccaaagtgctgggattacaggcgtgagccaccgcgcctggcctttgtattttgtcacttttcacattgtatttatttgcttttgtgcttattccccctctgctttccaccaagtttctcaaggccacatatgtggttttgatgccacatctttgcgtttctagcatttaataccttgcctgcacataatagacccctactaagtattctgttgaatatttggcaataacataagctccagatacaactactgtaattgagttttttgtctcatgaattcaaatagtattctaggaagtttcatataactttgagttttttcatgtatcagtgatcttttagtgttctgatctttgttattagtaacatcttcatttgtatactattttacatgtagttaagcactttagtaaatattcatttgatctacctataacctcttgatttgaattaggcaggaattattatccccattttctatagatagctgaggttcagagagtaacttatctgtgcccgtaactgcgacttgaacccttcacttcttgctgttatctcaagtgatatttctgccacactaaactgctttttctgtgtcactagatttttgaaaaatcagttgctgtgatatattatatactgtttgttttccagagctgaattgatacgtgtcttctgttaatgtaataggattttaaagctggtcaggttccctcacctgtcctctagtcctgtagccttatagagtaaatgaagcctggaaaggtgacatggcttgcccaagaccatccagctaggtaaagcggggtaggcccatggcaaaacagaatcccagtctcctcatttcctgctcagtggatttcttcccttcctgtacctcctgcttcccccaccccatcttttacagttgatgtttctaacataaaggaggtctttccgctttgtagcaatcagatccaacggaagccttgacattatattacggaatttatttctgaaaggagagtggtgtggggggcgcggggatgagtaatatatgtatgtacacaaacttccagctttttttttttttttttaagtgttttctctcctggccgggcacggtggctcatgcctgtaatcccagcactttgggagactgaggcaagtggatcacttgaggtcaggagtttgagaccagcctggccaacatggtgaaaccctgtctctaccaacaaaatacaaaaaaattagctaggcgttgtgtggggtgcctgtaatcccagctactcgggagtctgaggcaggagaattgcttgaacctgggaggcggaggttgcagtgagtcgagattgcaccagtgcactccagcttgggtgacagagtgagactctatctcaaataaaaatgttctctatactcattcagtagcaaattcttttactaaatattcggtataagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagactctagtgtaagaacatagttctatttctgtgagctaactgctgcccttctataaccttcagtttctgccagcatcgtctgcattcaaaccaatgacctcgaggtgaaaatctccagataacatgattggtccccatgctctcatgatttccttacttaagcaattaaaggccaaagcaagatgcttagtaactccttttccacatagaggcacaaataaaggaaagctggtcacaagttttgaaccaaagagttaaaagaagaatcataacttgtctctatttaatgattggaaactctcacagacttctgtgaagtctctcccccttttgtacctttcttacaagtgatgactatatacttttacctggcaggggagagaccacggtcacgaaggtggttttcccagggcgaggcttattcattgcactccagatgtgctgacccctgcgatttccccaaatgtgggaaactcaactgcataattgtggtggtgggggactgcgttcatgcttttccctggttaaattaaaaaatttttaagttattttaaaaatataaaaaacaagatttgactgtattctgccttgcgccactcttgtttgtctttcactagtgcaaaaattgtgatatagctgtcttcatgtaccccgcaatacctggtgcagtaattctgtgcataataatgtatgtctgtttgttgtatgaatgaaatttatatttctaaagaaacatgctagctacaattattgtgataagaaagcttaacaactttttctcattgaaaattgtcacgaaacaatgagcttttcagaaatgatttacttacaaattccatatttgaatgcaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcatgtaagtattttatgcagcccttcttaagagttaggagaatagagttgcatttagtgctattttaagaattattaaacttgtctgcggtttttttttcattcatatatagtatctttccagaaagccaaaaagccttttgttttgtatattagaacattattccattaaatgattgataggtgagttactatattagaattatgttataatgcagcttttaaaataagatcaaagggatctagtatttaacatctgagtttttaatgatcttttaatcttaaatttattgatgctcattttagaaaacttagaggttaccaaaaaagaaatcagaaaactcactgacaacctcctacttctttttaatttaaaaaaaaattttttttttaactatagacaggatcttgctatgttgcccaggctggtctcaaactcctgggctcaagcagtccttccacctcagcctcccaaagtgctgggattactagggtgagctgccacacctggcctcctacttcttaattagttgaaatattttgcagatatatataaatcatattgtgttaattaattttatgcttttttcttacctgtgaatttaccaatccaaatctgatttataaaatgattttaatttttctagtgtatttcgtgttagctgcacaacatgtttatatatgatcatgtaattctagtccatatttgttggaaacattgacatattgacttaataagaccaaaaaaaattgcctgaacaactcaacctcatcagtcaattaattgtctccttgttatagaggcaataatgaatgtcatgttttatacttttaataattgtatgttccctgaatggaccagatagaaagcatgaaactttacacgtaaactcttgaacctgcatgacggtcatcgtgtcttaggtttgctgcttgtcccctggtggtggtgggctctgcgtggctgactgtgactagttgttcatttttaccttggtgagagtttgccagcagggaactgctctctgctatgtcaccaaataatgttttgctaaacttcttgtctgtagtacctgcctgatgtaatgggctgtctgttagtagcttagtaacccagagtaaaactgaatcatccattttaacagaattctgccccacacttaacattttctcctaacagaaaaccaagaattctgcaaaattcttctaagtagaagcagcacaattcctgatattaacaataaataggagtacagaaaaagcttttagaaatttctcccatacctgttaaagtctatatgaatatattaaggggaaactccaggatgctaacactaaaataagaatttcattatatatgtatgtaaatttattgaaaatttattcaaaagtcctctccctgttttcccatcatattcagtaaaaggtgccttttagtccccttttttttggtcattaagcctatttgtatgtttcagagaaaagtttgtttttatctattatcatatacaatatggaagtactgaaaaaatgggtaaaaagagacaaagttattttaaagtatgttttcaaaacatgacataaaattttataaatcagctttctgtgatcacatgactgattagcaaagagaagtcacataactcctatgtggaggacttgtttaattgaaatccttttcttcttgacaaagggttgtcactggccttttagatcttggctcagacataactttcatttgtcttaaaacctctggcgttgccaataaatcacgtgtgaatgcaattctaagtcacaaaacaaagtattaaaggccatctgtacctgttcacattcagactcaaatttcgttagtactttctatgtgaatttatgttttgttttgttttgtttttttctgttttagaactaatggacattgctttgccatcatagaagaagatgaccagggagaaaccacattagcttcagggtgtatgaaatatgaaggatctgattttcagtgcaaagtaagatataatttgggacccatgagacaaagaagggaggggccatatgaaagcatcgatttcccccaggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgttccacggtactgcagcctgggccacagagcaagaccctgtctcaaaaaaaaaaaaaaaaaaattcttttttctttttttaaattttaaccgtctttggctactgattacaattttcaatgagaaaaagtttctaaactttcttatcacaataattgcagctaacgtttctttaaaaataaaaattttattcaagtaatatgattatggtaatttaagttccaggttattttaccttaaaaaaagttttaaatcatcctaggttgtcatgactgcaaaaaaattatattgtcacacttatttgtagattataaaatttactgagaagacttttaagatagtggcagtaacctttgtatcactctgagacaacttagaaatgttaaagatatactgcaaactctagggtaaccactaaagttgaaaaaaaaatgttaaggccttgtaaggaggtgtcagtggagctctttaaaagcagcagcaaaggaatcaggatggtaatagtttatgagcatcctgatggctctgggttataaacctgatctcttcaaaattctgcatagtgattttgtcccaggagatccttccagtgtttctgaaaaccagctccagatagaattgtttgtgcataatttaagtctcagctatgttagaaaattgttcctattatttggaaattctcaggatggaggccgggcgcggtggctcacgcctgtaatcccagcactttgggaagccgaggcgggtggatcacgaggtctggagatcaagaccatccggctaacatggtgaaactccgtctctactaaaaatacaaaaaattagctggacgtggtggcgggtgcctgtcgtcccagctactcgggaggctgaggcaggagaatggcatgaacccgggaggtggagcttgcagtgagctgagatcgcaccactgcactccagcctgggcaacagagcgagactctgtctcaaaaaaaaaaaagaaaagaaattctcaggatggatagaaaccttaaaggttatgtttcaacctctcagctaatgtttggaatcacccttgttgcaaatgactgcaaatctatcttcctttctgactctttggaccatagagaacaaacctaatctctctttaagatgacagccctttactaagtaaaaaaagtgcttcatcctactagtctttgcccagtgaaaataattgtccataatgacctcaactgctccttatatgatcagctttagagttattcagtctccacttcctcagtgtaatatgcagaattgagtgtgatatgaccaaggaaaaaagtagagaataaatagccctgttccctttttctaaacatagtcttgtgttagatatttggcagtcatgccatattcttgaaccattgagccttctgtccgctgaagtccctatgctactcactcatgctgctgctaagccacatctcctccactcttcattggtgctgttggtttcttcacacaaataagtagatgggaatggaatgaggttttcctatacagttgttacatacttgtctttatgaattttatcgtataagcattaatcctttgctctaatttgttgggatttaaaggatgctaatttcgttgttccagttttaggctatttgcgtatttatcaagcacacatactatacattttttaatcacttaaaaaattgaagaaagagctatggttagggtactgagcccagcagtaataaccagtgttcaacaggcccctagtgtaggcctgtcctaagctgaattcaccattataagttagttgttaaacttgacaagctgttcaaatctatatactatatatgtgaaccttcggacaaggtgctctgctctcgttttctcatccatgaaggaattactatgaggatcaaatgagatacatgtaaatagtttagcacaattagcacatagtaagggcttaatagatgttagctttgaccatattgattctttaatagagcagtcttcatgctgttacccatatccctgggtacactcagactgtgttatacaagggtaacgggcacgttgatagttttaagggaatcagtttttggatcctaaacttcagtaggtcctgttgctgaatatttctctgcctgagaacagaacttctcaagcagttctctttcccttagtcacttttcatagtcaacccctcctagtttacaaatagaaggcctgaggtgtaaaacttcaaggttccaaacggtgttgtaattcgaagtaaaggcatcagtgtaggctatgtcgggatatcaaataagtgtttacatgacagatggttttcaattgtttgctttcaaccaagttgctggatcattgaaaataattttcgatgataggatctttatggcacttttagcatatgctttggaaggactttaaacaattatgggctgatcgtggtggcacggtggccccagcctgtaatcccagcactttgggaggccgaggcgagcagatcatctgaggtcaggacttagagaccagcctgatcaacatggcgacaccccgtctctactgataatacaaaacttagtcaggcgtggtggtgcgtgcctttaatcccagctacttgggaggctgagacaggagaattgcttgaacacaggaggtggaggttgcagtgagccaaaatcatgccattgcactccagcctaggcagcaagagtgaaactccatccaaaaaaaaaaaaattatgggacaatggtataatagtctccttccgtgatcatcatcttgcttatgtgaatacattgtcttgatgatgacaaaaggaaaaataagaataagattaatgatgaatcttctcactctagcagtaatttttattcatgaattcgtgaactgatttgtttcaaaagtcccatccatatcattaagaaatgcctggccaggtgcagtggctcatgcctgtaatcccagcacttttggaggccgaggcgggcagatcgcttgagctcacaagtttgagaccagcctgggcaacacggcagaaccccatctctacaaaaattagctgggcctggtggctcacgcctgtaattctagcactttgggaggccaaggcaggtggatcacctgaggtcaggagtttcagactagcctggccaacatggtgaaaccccgtctctactagaaatacaaaaattagccgggcgtggtggcacactcctgtaatcccagctacttgggaggctgaggcaggagaatcgtttgaacccaggagttggaggttgcagtgagccgagatagcaccactgcactctagcctgggtaacagagcgagactccgtctcaaaaaagaaaagaaaaaaaaaaaaaaaagctgaggtgggaggatgacttgagcctgggaggcagaggttgtagtgagctgagatcatgcaactccactctagtgtgcggagtgatagctagatcttctatcataaaaaaaaagaaaaagaaaaaatgccctttccaataacattttcttaagtttgtatttaatgaagattgtaacatatatattgttttgatcaattttatgctaataatgattatgataaactagaataattttctaagacttaaagacatacagttataggaaataaaagaatttttatgtacttatctttgatgtggacagttatatattactttaggacgtaattatcatgggagatattgaaaggaaataagagttcaaggagaaataagagttctagtgtaaaatttctcattgctaaaagaagcatttgttcatttattctttaaaatgatgataatgggtatcaaattgcaatgctatttagattctactgaatgcattaaaaaatgatgtaacacttctatttcaaaatgaggtaacaattctatgtcaaagtgtcattatgtacagtaagccagaaattattaatatattgcagccatttaaatttatggtgaaaatttttaagtgtcacctgaaaaatacgtgaaggatacgttgcttttaagaattgggttacgccagcaagcattttgaccagcacttatctaactttctgtatttcttggtaaacgtcacccaagcacagcactcacccaagcacagctctgtcatgctcatcctaaccctttccccagtgtcttcacgcactgccatgtgtggcacagaacagatgtgagtgcctctcaccaggcctcgcgttcttccactccccaggctgcattggtaaattgtgcttattctgtttcctcctataggacaaattatttttcagaaacctcactgccattccttgtaacttggcgtcagttccttcctcatatactgtctccagcctgagcacactgaataagtttatttaagtcagaatcacttaattcatcagtgccaagtaaatttgtttcccacaaaaattcatattccccacataagtctagaaatacaaaattgacttgggcagagggtacgggtggagagtgcaggaaaaggaaaggctgtgtcacccaaattcataatctcgacaaacccaatttttgcctacccagatacatagttaacctgagtaagacagacgtgagatgaggcaggtgttgcttattcttagtgaagccacaatgggtctttagggacttagaagttttttggcttagtctagaatctcatctgggattcatgtcaagcaagaggaagggaagttaatttattgaatatttgttatatgtgtatagtatcctggggattcagtatattctaccttgtttccccccaactactctatagagcagatttttttaaagacagggtattgctccatcacccaggctggagtgcagtggtgcaatcacagctcactgcagcctcaacctcctgggttcaagtgatcctcccacctcagcctcctgagtagctgggaccacaggcgtgtaccaccacacctggctgatttaaaaatttttttagagatggggtctcactattttgcccagcctgatctcagactcctccgctcaagccattctgccacttcagcttcccaaagtgctaggattacaggtgtgagccactgttcccagttcatctttttttaacctgtattttttagcacactaaagcctagagataaattacttgctcaagttcacaaagtgaacaactggcaaagctaggattcaaactgtttgattccaaaacccttgtattttctgtaatactatgctccttaatctgttggcagagtctatttttggcttctttttaaaaattattatttttagagatagggtctcactacattgctcaggctggacttgaactcctaggttcaagtgatcctcatgcctcagcctcccaagtagccaccacacccagtttaaagtctactttctttcccttttaaagaaaagggacgtatataacacatatatatataacatatatataaacatatatacatgtttatatgaaatgtttatataaaaatataacattccattatctattgtagtttccaacactccatctttctaaagtctttaaattacacctgtctttcagccatctctcttacaagggctttcatcttcctgggatataattcacctaggttagaatataggaactcataaggaatacaaacgcatcgtaagatctcttcgtacatttgggatgtcgtttcccacttagtagtgtttgagctaccttcgtcatccctgtcagcatccttcatagagaagaaaaaacaagacaggagttgaagaattgttcgtttttctccttatcatccactgtcatgtcagcagtacatctgttgcttggagaaaccccatgctgccaaagaaaccctttcttggtttttctttgcacttttctcttctgcaaggccaagctcattttagctttcctggaaccgtttttggatgcttgacacttctttcattcatcgttagttatatgattttcatttcctcctccatgtgttttctctgaatctgggattatttcagactctccagtttaaccctaacttttttctctctctccttatgatcatttaaaagtaaaaattgtttaaaagttattaataaaacttcatttaaaatataaaatatgtatttggacatttccaaatgctcttgaccatcttcccaacagaatctgaagtcacaggctcatgtttacctttttaaagtcatagctgattatactgaggcttttccttaatttccgcttacattcttgttacttgtgtagtgacaaacagttctttgctattcacatgttggtcagaatggcagttctccccaggctgcagcattcaacttgtcagatattgtgttgttaatccaataaaacatcacatgcaagtgctgctgcgcttccagtgactgtgtccttctctgtgctagctttctgctctcttagggacagtctccttgctggctggtggtctgtaatcagctctcaagaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgttttcgatctgtcccaagaaacccactgtgttataattcttttttttttttttgcgttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaacccaagtacatacagcaatttagcatataataaaggaaacacttcagattactgaggaaaagacgttcgcatacctccttgtttttattataattcctcaccctcaacaatggggtaccacagttgagaaatcgtgttttgggtctttctagataatagacttggaatcttctgttagggaggtgatgcgaaagtcatatgattattcagagtaggagatggggtcgagaggagagctccacatctgaggtagccatcatcccaaatggcccccagtgattctcactgcctggggttcctccccttggggccagtcccctcccataacacatcagggctgatctgtgtgacaaataggatatggcaaaagtgacttccaagtctacgttataaacagctttgcagctttcaccatggtctctgggatcactcactctgggggaagccaggcatcatgctatgtggacactcaactctgagagaggcccacacagggaggaactgaggcctcttgccaatacccagcctgcagcctgtcggccttggaagtgagccaccttggaagtgactgcaagctcctgtcaagctttcacatgagtgcagtctcagctgacatctgaccctgagctacccaatcaagtcactcctgaatgcatgatccacagaaacagtgagataacaattgctgttttaagccactcagtttgggagtgatttgctaacacagtattggataatccagtgtccgactttctgaaaattgactttcaagcagtcttcttggtgttattgtcaccctcaactttacttccagacataaccacaatggccagttccgaagttcttgggggaactccatagtataaactggttgcttcttggttttctcaatttctaacctaagaatcagactttttgggtgtgcaaagtcactgctcattcatctgcttcatgaattccaacagtgtttactgttattttatctccttttctccttgcctgttagataaagaagtttaaaactctttattgctgttttagtggactagtaaaagcaagcaagtatgctcaatcggttattttaagctcaaagtccctttgtcaaataactgaatctttgccagtaagacaggtgataatatctcaaggtgattttaatttatattttcatattaaaatactttttttatacattggtttctttattacacaagggcactgtaatgtatatattattttatttatttatttatttagaaatagagtctcactctgtctcccaggtggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggaattacaggcgtgagccaccgcacctggcctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcagagctacctacacttttcactgtggtgtgtcttgagactgcctgcagtgccttcagccacatagtaaagaaccctatcagccaggtgtgtgctctctaagcaatgggtaggatgtttcttaaggaaatctgttcagcccaagagataaaacctaaaaatactgctgttagggcccagtgaaatggtccaggcagattatcttacagtgaagcttgtaatcagtaaaccctacccatatactaacagcttgccaatcaaggtgtcaggctgtgaaggatactgatctctgagaaaccagaaacaagtgaggtgagccttgtgattgcccaccttcttctccctgaacagagtttcgggttgggcatcacagggggaacccaggtgtagccagtagcctgtctcagttcgaagagttgtgaggaagctaccaagcctagggaaagagcacctgaaatgattgagaaaacagtgtttggtgctcacacaaggctgggagtaggatctgttcacaccagctgtgagagttgaaaaccccataattcataggttttggttgaaggactcaggaggattttgcctcagtggtggggaataattagccctagactaaacatggctctggtctcaccctaaaagcaagccccaaacagatcacaccatttctaagtcactgtatcctagaacaaactcaacagtatttataggaatataaaaatatctggcatccaacaaggtaaaattcacaatatctgccatccaataaatgaatactatgaataaatgaatacatatataaatatggtccataatgagggaagaaatgaagcaatcaaaaccactgacccagaactgatatagaccttagaattagcaattacattaaaatagttattataactgtattttttatgtacaaaagttaaatcaagacatggcagattttgtaaaagaccaaaatgaaactttaggaaatgaaatctataatatctcagatgaaataatatactagatgaaattagtgacagactgtagaagaaaagatgagtgaacatgaagacataggaatgaatagagaatagtgagctgtgggacaacttcagatggcctaatatagatataattggagttcccagaagagaggagggacgaaaaacatacagaaataatgatcaaatgttttcaaatttatctattattattatttttatttatttatttatttatttattttgagacagagtctcgctctgtcgcccaggctggagtgcagtggcacgatctccgctcaatgcaagctccacctcccgggtttacgccattctcttgcttcagccttccgagtagctgggactacaggcacctgccaccatgcctaagtttttgtatttttagtagagacggggtttcatcgtgttagccagatggtctcgatctcctgacctcatgatccgcccgccttggcctcccaaagtgctgggattacaggcatgagccaccgtgcccggcctattatttttatttttgagacaaggtcttgctctgtcacccaggctggagtgcagtggtgcaatctcagctctctgcatactccacctgctgggttcaagcgattctcgtgcttcagcttcccaagtagctgggattacaggcgtgtaccaccaagcctggctaatttttgtatttttagtagagatggggtttcaccatgttggccaggctggtctcgaactcctggcctcaagtgatccacctgcctcggcttcccaaagtgttgggactataggcgtgagccactgcactcagctttttcaaatttaatgaaaaccatgaatccagatatctgaaagctcagcaaaccctgagtataagaaacatgaagaaaactacattaaggcacatgataattgtattgctcaaaaccgataataaagaaatgttaaatgaaacaagaaggaaaaaaggcagagtatctacagaggcacaaagttaaggatgacagcagaccttctgttggaaacagtgcagtcaagaagatagcgaaccaacatctttaaagtgcccaaagaaaaacatcacagactttgaattctatagccagagaaaatatccttcaaaaatgaaggtaatgtgaagatttccagtcatacagaaaacttgaaagaaccccgcccccttagacctacccaacaagaaatgtgaagggaagttcttcgggtggaaagacaggccaggtgaagataagaatccacataaaagaatgaagatccggaaatggggatctaagtgaccctggcacaaactaacaatatcttttaagatgaacaaaaaagactactcatctgagactcaggccatggacactcaagtgagtgacctataacacttcacagaacatacaatcagacatcaggaactggtcatgtaggcttttttatagttctaaactaaatactacatagaactttgtgactgccctgtttatttagctttagaacttcatgtgctagttcagtctgtgaagattcattattgatcagatatatacaatctgtaatttggaatattcattcatatttagttgaactttaacaagtcacaagttgttctccatagcaaaccgtaaaagaataaaattaaagttaaagagaggtctgtccgtcagcatattaaggtttgtctgttttgtttgcctcattaatattttgtttcccttttttctgatgtgatcgttttcctccaatttagatacgtctgcaatttattcttcagtctcatttacattcatgacccatgatcctcaaaacctataccttctctaaaaccttatctggaaccatggcctccctccactgtggacgaggcatcattctgtaccatacgccagttcctggttgtttcctctggcatcttcttttgtagctcctttaatccttcagactgcttagatcctatgatctgcccccataacacttactaattttatcttgcatttttttacattggcaagtattcgtttacttactcatgcatatttgccaaaagtctgcatttccattcaacaggaatctcattggtaacagagattacttaaccattaatattgatgatcaactggctggctgtttaaattgccactttcctattgaattttgaagggtgcccatggtgaatcttgtgtgtccctcatgcttggcacacagtggatacttactcactcttgttgatgtttgccagccaccttggcccagaatttctgcttgggaaatagtatcacggatgcatttgtcagatgaaaagcctgcttctggctttataatggaccctttatcctcattgtctttaggggactcctggtcctagagtagttaaatagtaagaattgaatgatttttttaagttgcagtgattacagcaaaaaaaaaaaaattgccaagtaatgttttatttaataagaaagaaacattttctgaatacctaaaaaagaagctgccaatcagcttttaaagtgattaaaaataagaaaaaatgccctatatgtacacatatttttatcactttcagcactctccatgtatttaattccaagttttaggtccaagttttcatttgataccatattccttctgcctgaagaatttctttaacctcttggagtgcaggtctgctggctgtaagtcctctcagcttttgtctgcagtcttttgacttcattttcccaaggtattttcactggctatagaattctggatgggctcaagtttgtttcccttaaagctgtcactcattatcttccacttgcatgccttctgacatacattttatctttgatgtattatatgtaatttttttcatggcatcctttaatgttttccctttatcttttaaacagctacaatacatttagaagcgtgtgtgtgtgtttcttttttggtatttactctgctttgggtttcactgagcttagtgaatctatggtttgctatctttcattattattgcaaaattatctactattttttttaaaacactttgtccttttggctgggcgcggtggctcacgcctgtaatcccagcactttgggaggccgaggcgggcggatcacgaggccaggagatcgagaccatactggctaacatggtgaaactccgtctctaccaaaaatacaaaaaaagaaattagccaggcgtggtggcgggcgcctgtagtcccagctactcgggaggctgaggcaggaggatggcgtgaatccgggaggcggagcttgcagtgagccgacatcgcgccactgcactccagcctgggcgacagagtgagactccgtctcaaaaaaaaaaaaaaaaaaaaaaaaaaaaaaaaaaaaaaacactttgtccttttatctgtctcttctgtttttgagactccaattatacatattttagattatttggtgttgtgccacagctctttaattcttcagtttttctcacttgttttttctctttgtattttagttcaggtaacttctatttacctattttcaaatgcacagatttttttttttcttcacctgtgtccatctgagctgtgtattgttgagctcatcaaacattcttcatctttaatagcatgttttccctttctcacattcctgtctgacttcatttttctgctgagactctccatctgtgtattctgttaccaccttcaccagttgccttccccttttaatcacagttctgtgaaaggccctcctgacagcttcagcacaagtgctgtctgacacttggcctcttgattgcctgccctcttggcagtgagtgattattccttgctttttaatgggtctcataagtttatttggatgttgtacatcatgttaagaatagcagagattgtcacaatgagatatcaacctcaccccaattaaaatggccattatcaaaaagaaaacaaatgctggggagggtatggagaaaggggaaccctagcacactgctggtggaaatgtaaattggcacagctactatggagaacagtgtggaggtccctcaaaaaactaaaatcagaactaccatatgatcttgcaatcccactatttggtatatatccaaaaggaaatcagtatattgaaggcctgttcattcccctgtgtttaagcactattcataatggccaagatgtggaatcaaccgtgtccatcagcaggtgaatggataaagaaaatgtggtccatacagtggaatattactcaaccagaaaattaatgaaatcctgttattttcagcaacgtgaatggaactggagttcattaatgttaagtgaaataagccagtcatagacaaatattacatgttctcaatcatacgtgggagctaaaaaggttgatttcatagaggtggtaagtagaataacataccagaggttagaaaggagggagggaggttggatgaagatggatggatgaagagaggttgattaaggggcacaaaaatacaattactaatagaaggaataagttctagtatttgatagtacagtagggaaattatagttagtaatttattgtgtatttcaaagtagctagtctttaagagaagaattgtaatattcccaacacaaagatacagcctgggcaacatggtgaaaccacatctctacaaaaaaatacaaaaattagctgggcatggtggtgcacatctgtggtcccagctgctggggaggctgaggtgggaggattgcttgagcccaggaggcggaggttgcagtgagccaagatcatgccactgcactctagcccaagcgacagaacaaggccctgcctcttcttccccacccaaagaaaaacaaaagataaatatttgaggtgatggctatcccagttactctgatttgttcattttacatcgtatacatgcataagatatcacatgtaccccccaaaatatgtacaactattatacatcagttttaaaaagaacaacagacattgaaataaagacatactcctgaaaatgggcatacctcctcttaggctgttgataggcaggaggtgttcagtctagtacgagtcgatttgggttagggttttgttcagtgtttgggcctgtgccttcaatgcctcacaagtttcaaattccttcagtgatgggctgctgttcatttgcttcgagttggggtttaggtgcagaaggaagggtttttctctgagttcctacctcccctgtagctttcagctcttaccacgtcattgcacctctgtgggagtcactgtctatgttcttgttcctcccacagaggtcatctgctgttgcgtgttattcacattagaggacagttggaaagtgaggggggcgtgcctgttgtccttaggtaggttctgtgttgctagaccttaagggtgcagcttcctcagggctcttgcacctcctcccacagaggtagctgactgccctgtggtcctcctgtaggatcctatgcccacaaggagagaggaaggtgtcatcttctcctcttcctcagcatcagaggatcttagcctggtcagagcacagggagcatttcctctacatccccaagaggcagagggactttgctgcttctcctccctccaaagtaatggatctttgcctgtgctctggggcagggggaagagggtgtgcaagaaagaaaacaacagtcatgttatacagcgagggccttgtgtagatagagtttatgtagtcataataatgcaagcactgaatgttgagctaaacaaataatataactgtaaggaggatgtgaggatggaagtatttctgttttgggaagccgcagggtgttaaatgatcagttaaattgtcatattccccagtgtaaggtcaatagttaaagcctaagactgaaaaacttaaaatgtcaatgtaaggatgctatttagaaataatgagggccagctgtggtggctcacacctgtaatcccagcaatttgggaggctgaggtgggtggatcacttgaggccagaagttcgagaccagcgtggccaactagcggaaccttaactctactaaaaatacaaaaattagcctggtatggtggtgtgtgcctgcagtcccagctacttggggttcccaagaattgatcaaaccaggaaggcgggggttgcagtgagctgagatcacaccactgtactctagcctgggcgacaagagtgagaccctatctcaaaaaaaaaaaagaaaaaaaagaaaaaagaattaggtaaatattaaataagcttcaaaaagtcacaattctttattctaagaagtggaaactggataggaggaggagaggagacaaagtatggctttttcattaccaagccatggagaactgtatgacattcaaaggtaggcgaataaagatgcttgataaaattaaatattaagttctataaatataaaatttgatacatttaaaactgaattctaaaagtttataacacaagggtagggataaaggtgtagggaaaataggcattctcatatgttggtggagggattccaactggttcaccctttaaggaggtcagtagggcactccatcaaagttccaaattcagtaattcctactacagatatggtagaaaattgtatttcacacttgaatgcaataagactagaaaccatccaaatattaccagtaggtggccgggcgcagtggcacacatctgtaatcccagcactttgggaggctgaagcaggtggatcatttgaggttaggagttcaagaccagcctggccaacatggtgaaaccccatctctactaaaaaaaaatacaaaaattagccaggtgtggtggtgggtgcctgtaatcccagctactcgggaggctgaggcagggaggattgcttaaacccgggaggcaaagcttgcagtgagctgagattgcgccattgcactccagcctggaggacagagtaagactccatctcaaaataaataaagaaaaataaaaataaagattaccaataggtgaatggttagcagctatacagtggaatactatctagccattaaagaaaaaggtgacactttgtgtacttacgtggaatgataccccaggtaagaagcaagatgcagaacggcatcagtgtctctccagattaccagagaaaccagaagtagttttgtttctaaggaaacagggaaataattctcttctaaggaagtgaacttgatagcttagggatagagctgggaggaggatttttttttgccatatacccttttgtgtcttttggattttaaactatttgagtcaattacccatataaagttttaaaaataaaattataatggttaagtacattgggctatttatatggaaaatactttaatttgtttcttagtttccattatatattatacattctgaatggaccatatgactaaatgagagaatcaatatgttaaaaccaggccaggcacagtgggtcacacctgtaatctcagcagtttgggaggccaaagcaggaggattgctttgaacccaggctggtctcatctcgaactcctgtggtcaaatcaacttcctatcccaggagtttgagaccagcctaggcaacatggtgaaacctcatctctatgaaaaatacaaaaattagccaggcgtagtggaacataccagtagtcccagccacttgggaggctgaggtgggaggatcacttaagcccaggaggttgaagcttcagtgagctgagatcgtgccactacactctagcctgggtgacagagtgagaccctgtctcaaaaaaaaaaaaaaaaaaaaaattaaaccttgagaacatatttcttgacattaggattggaaggttgtcttaagagacaaaagcatgtcaaaaagagtaaagatgaagtaatttgtctacactaaaatttaaaaactgacataaaaatgccataaagagaatgctgtgataatcatggactgagaagattgttgaaacacaattgtcaacatttggtatacagattatataatgaacgcctacaaatcaatgaggagaagagttcagggaacacttcaattgaataatgtgcaataaacacaaatagattgatcaggcatagtgtctcacgcctgtaatcccagcactttgggaggccaacatggcagatcgcttgagctcaggagttcgagaccatcctgggcaacatagcaaaaccccatctctactaaaaatacaaaaaaagattagctgggcatggtggcacgtacctgtagtcccagctactcaggaggctgaggtgggaggatcgcttgagcctgggtggcagaggttgcagtgaactgagatcgtaccactgcattccagcctgggcaacagagctagattctatctcaaaaaataagtatttgttaaaaatatgagtaggcagttcacagaaaaaaaaaagctgaactgtggaaaaaaattcaattttgctagtaaccagaggaaagcatattaaaagaaggcattgtttcatatctatcaagttggcaaaagtctgaaaatatgacttcgaggtttgggttggaatgtaaggaaatgtatattgtgattatttgaagtcgtatttttttatagctaggatgacacttcacatctgattttgatagtgtctttttacatgccaatacactatagacatctttctgttttaacatgatacatagaactctgaactccatttctagatgtatttaacaggatatattatccaatgataagactaatttggataggattctttctgagggaaggataatggtatagagaacctcaaggtttttcttagggttttatagtttttcatttttaatgtagattgttttctgcttttttaaaagacattattgcaagagcatctcaagcagacgtcgttacaatcgtgatttggaacaggatgaagcatttattccagttggagaatcactaaaagaccttattgaccagtcacaaagttctggtagtgggtctggactacctttattggtaagttaaacgttcctatagacatgaatggtgtgttgatttagaatgtgtcctcatgatggtggacagtataattattgcagatcagggaacaataatggacacatttttttctccttatttagaaagaggtatgcagtattgcaaggtgaaattagttaaaaataagaaatatgaaccaagaaaaatagaatagtcaagtaagatagagctataaaccaggttataggaaccaagtcctacagagaaaggcaggggaagttagatcacgaagtcctatatgaaaggcaagagttagctcacaagttttgctctaagcattttaccagccaacttaaagaggaatcaggtataagattccttgcatctgtaagtttaaactgattgattgagggaactgtaactatttcagattctgaaataaaaaagaagtttcaacagatattcttagagaggatgcttctctcaatatactactaccaaaacacatagttcaataaaaaataattttaaagggaattacaaataaattccaacaaatttggatggattcttggtatcagggaaaaaaaaataatcccagcaggttcatttatatatggaaatactcagttttgggttgaaggaactcttatttgagaggacctgtattatgaacactagatatccagataggtttaagtttttaattgtattagttgaaagaaactgatctcttcttattttattttattttactttattttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccaccctgatctctaattttgaaattcatcttattaaataactctaattgaattggaaaggtaaaagtaaaactgccttcataggcagacaacatgattgtttacgtagaaaatcccaagaatggtacaataaaactactgcagccagtaaatgactttatcaggttgcagaatacagagtcattgtacaaataccattgaatttataggctctagcaacaaacaattaggtaattataaaaacagtatttaaaatagcatcaaaaaccatgaaatatttagaataagcctaacaatttatgcaagacctgcacactgaaaattataaaacattgctgaaagaaattaataaagccctaaataagtggagatgtttataaatctgaggactcagtattaagatttcagttttcctcaaattggtgtgtaatttcattcgaatccaaatgaaaatcagagcaaacttttatagcaattgatgtatattctaacatttatatggaaatgcaaaggactagaagagccaaaacaattttgaagtagaagaacaaagaggaatcactacctgatttctggacttaccgtaaaactcaataatgatctcaatttggtactggcataaggatagatgtattgatgaatggaacagattatggagtttagaaaggaacatgcacttaatatggttaattgattaaaaaaaaaaaaacaaaaagatgcccaagtaattcaattggaaaaaggcagtccatttaacagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatctgatacagggtttttgtgcaaaatatataaagaccttttgcaactcaataataagataacccaatttttttaaaaaatggacaaaagatttgaacagacacttccccaaagaagatataagaatggcaaacaagcacatgaaaagatgctcagcatcagcagggatatacaaattaaacacagtaagatactactgcacatccactagtatagctaagactgataatattaagtggtgccaaagatgtagatcaactagaaatctcatacattgctggttggaatgcaaaatggtatggctattttgaaaaatagtttgacaattgcctggaaagttaagggcatactttccgtacaatgaagcaatccttctgctaattatttacccaagagatatgaaaacttgtccacaccagaggcctgaatgtgaatgtttatagcagttttatttataatagacataaactggaaacaaccccaaagctcatgaattgctaaatgaataaacaaatgctggtacattcatacagtggaatattactcatcagtaaaaaggaacaacttctaacacatgtagcagcaacagtgggtgaatttcaaaagtactttatgctacatgaaagaagccagacacaaaaggctacacaaaagtgattctcctgcctcagcctcccaagtagctgggattaaggcatgcaccaccatgcccagctaatttttgtatttttttttaagtagagacagggtttcaccatgttggccaggctggtcttgaactcctgacctcaggtgatccacccgcctcggcctcccaaagtgttgggattacaggcgtgagccaccacgcctggccaaaaagtgagaatttttttacgttattaaaatattctgtatcttaattgtggtattggtgattacatgatatagatttgtccaaggcttgttgaacttttctcaaaaagggtacattttatataaattatacctcaataatcttgacttaaaaacttacaggctgaggcaggcagatcacttgaggtcaggtgttcgagaccagtctggccaacatggtgaaaccctgtctctactaaaaatacaaaaattagctggacgtggtggcagatgcctgtaatcccagctgctcgggaggctgaggcaggaaattgttttaactggggaggcagaagttgcagtgagctgagattggccgccgcactccagcctgagcaacggagcgagactctgtctcaaaaaaacagaacaaaatttacaaaaggattctataataaatgatacataaagtcactttagctttgcactaaatctagtccattttagaagcatttccaacttggagcataatgttctttttaatttagaatgatcactaatgcttctgaaaatgaaagataacaatccatgtacatcttttatttaacaaatattaaagtacttctgatattgtcccaaataaatacttatattctgtgagcaggggatggaattcaagcaaatatatatgtaaataagaataaagttatgattgtgttaagcgcagcaactgagaggttttgtgtgctatgaaggtgtttaagtgagaaaatagcactctaagtaaagggaactggatattcaaaaaaacccagcgacaggaataagcttgagtgaattctaaaagttgagataagtcaaacgaggtttgtgggtgggtggtcaaagcaaataatgggaccaggccagatcaggcagggtcttatagatgggatttttaagatctttaactgttatttggactttgctgcataataaaccaccccaaaacttagtgatgtgaagcaacaaacattatttctcattctgtgagtctgtggggcagttcatttgttggacttgcttagctagagctaggtggtgtagttcacacccttggccgacagttcatgctgccattattttttggtcacagggttcccaaagcagcaggaagggggcaagccccagtccacaaacatttgtcaggtctttgcttgcatcacgttcgctgttgttcttttatccaaagcaagtcatgtggcctaagccctgagtctgtggaccaagactacccacgactgtgtgcactgggagggtaattattatgaccatttttgcaaacagccagccacttgaataacctgtttatgatttcagaatacattgtacattgtttcatactttaaagtacattatggccgggcatggtggctcacgcctgtaatcccagcattatgggaggccgggggtggggtggatcacctgaggtcaggagttcaagaccagcctggtcaacgtggctaaaccccatctctactaaaaatacaaaaaaattagctgggcatggtggcgggtgtctgtaatcccagctacttgggaggctgaggcaggagaatcacttgaatctaaaaggtgaaggttgcagtgagccgagatcgcgccactgcactccatcctgggtgacagagcgagactccatctcaaaaaaaaaaaagtacattataagtttttaactggagttggttgggtacaccatgctttttgatgagatggactacccctttgccagtcttaatgggtttctttcatcaagagctcaaaccttttacttttttctataaaggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtgggtacacactgattcagtcaatttcatttttgacaaggctagtgaggtacaggtggaagcctccatatgtgctttgaaaatgtgtgagttcaactatatacatttggctaaaggaaacctagtagaatacacggtttgaataaaacatagtccggaatgccaaccaagatctttctttactaaccagctgaagaaacagcagtgagtttcaaatggaaaataatactagtttattggacttactcccatagtaatgaaaacccagtcttttatagataacttaagcagtgatttagggtaacattaacatatgtgccttttccctttcataagctcaacagcccaacatgcagtttcattgtacgttctgtgtttaatgtgtgtttccccccatctccacatttacacaatagcaaagtaatttaggtgtgagctggtcagtcaggtacataagccgatctggctatcctgagttttcttttcccttcacctcttgttttcctccctttaatttggagagcccatagcatgttgccaagcaggcaattgtattagtttcctagggctgctgtatcaattaccacaaactgggtggcttcaacctccaaaacgtattcactcagttttcgaggctagaagtttaaaaccaaggtgttggcagagctgttgtgtctctgaatactctagaggaggagccttccttgcctcctctggctactggttggtggccaggaatttttggtgttccttggcttagtatagacaacactctagtctccatttctgtcatcaggtggccttctccctgggtgcctgggtccacatttccaccttacaacatcaccagccattgaattcgggcccacgctaatcctgtatgagtcatcttaacttgattacatctgcaaagaccctctttccaaataaggtcacgtttatagatgacatggattttagacatgaattttgtcggggagcactgttcagctcagtacatagcactcactgacctttttctggagggaagagggtaggagagaaaggaaaagagcaggactgtgggcctggcagtcaacgagccagactgaaaaggcagctgtgatgagtcactgatgggcaaatgggagttggcttaattaggagctaactcttagttgaacattcttaattttataaaagtgtccactttttgctttgaaattgagagccttttctactagagaatcatgtaggttgataatattctccaggttatttgtataatatgtcatctttttcttttctttccttttcttttcttttttttttttttgagacggagtctcattctgtcgctcaggctggagtgcagtggcgccatcttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagatatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacaggtgagtggttctttgccccactgttttgaaattattttaatttccaaaagatatttccctatttgtattcaagataatggaattctaaaaatgtgcatatgcttgtttttagttacataaatgtatagttgggggggattttgttctttttacaaaaattgtgtcctacttctcctatacataattcttgatatatatatatttttttggtgtttttttttgtttgttttttgttttttgttttttgttttttttaaagacagtgtctcactcagttgcccaggctggaatatagtagtgtgatcttagctcactgcaacctcgacctcatgggctcaagcaatcctcccacctcagcctcctgagtagctgggactacaggcatgcactgccacacctagctaatgtttttattttttgcggagatggggtctcactgtgttgcctaggctggtctcaaactcctaggctcagctgatcctcccaaagtgctgggattacaggtgtgtgccatatagtcttagccatccttccatttcagctgatgtaaatctacttcattctttttaacagatgcagagttttccatatgtggaggtactgtagtttattcttaagacccaactgatgaacattaaaggtgtcttcagttgattatgaaaaggttttttaatgaacattgttgtattttaaccatatattatatatttgatccttgtgcacttgtacaagcatttcttcatgatggattcctagagaagggcctgctgaggcagtgagtttatacatattaaactatggtatgttgcatattatttctttcagcagtgtgcctcagtttacacacccgtaagcagtagagataaggatgtcatttttctgtcaccacttgatagtgtcagtattttaaaacaaatgcaagtgttagaaattacaaatttttaggaaacctttgaaaccattttaatcttgtaattctagaatggagtggctgctttacatttcagaattcattttaggctgtaatataaaagtaccagtctttaaaacaactgtaagagacatttaaatctgttacagtgttctgagtcagtgtagtatttgttggctcagatatttatcagatgctataggaaaatacaacgcattatattgatcactgctttagagtaattattactaattgtcagtatgatcatgtaaacattgctaacaacagaactctgttgatgggacccataaagaagaaaatgtaatcctatgtcacaaagccttagtgtatcatatgagagtggtaaaagcaagcgattcctcttgtattttcatattcaccacttctcagacataattatctactactttatcttttttttttccttttcttttctttttttttttttttttgagagagattctcactctgttgcccaggctggagtgcagtggcatggtctcggctcactgcagtctccgcctcccaggttcaagtaattttcgtgcttcagcctcccaagtagctggaattatagtcatgtgccaccaaccctggttaacttttgtattttatagagacagtgttttaccatgttggccaggctgatcttgaacacctgacctcaggtgatgcgcccgccttggcctcccaaagtgctgagattacaggcatgagcaaccgtgcctggcttaactttatcttatattcagtgttgtcctctttcttagacaccagacttatttagtgacaaaacctgacctgaacggatgtgaggtgtgtattgcccttatccagttgaggaggactatcggacttagtgttttgctgtagacacagtactgagtactgagttggattaagagtgctgccccaaccctgctgaggatgtcatgtagtatgtagcatgtatttaaagaaaaatctgaaaaatgctaaattccacaatgcatctggccccaaggagaaaaagaagcttttataaaataggacaaaaatacaagataaactattttatttttggccctcaacttggaccttggctttcttttgtttcagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggaggtgggagtttgagtagtttctgattatgttgatttactcatcattttaaaaataacagctccagttatataactttttagtttttaatttttgtgggcacatagtaggtgtatatattattggataaggagttattttgatacaggcatgccatgtgtaataatcacatcttggagaattggatatctgtcccttcagacatttatcctttgtttcaccaaccagttatactccttgagttatttttaagtgtacaattaaattattactaactgtagtcctccccgttgtgctataaaataccaaatacttattcattcttctattttgtctctacttattaaacatccccccccatctgctgctacccttcccaacctctggtaaccatccttctgttctccatgagttcagttgttttgatttttagatctcacaagtaagtgagaacatgtgaagtttgtctttctgtgcctggcttattttacttaacgttatgacatccagttcctccatgttatttcagaaggcagaatctcattcttttttctggctgaatgatactccattgtgtgtaggtgccacattttcttgatgtgttcatctgttgatggtcacttaggttgcttccacatcttggctattgtgaacagtgctgcagcaaacatgagggtgcaggtatctcttcggttagctgatttcctttcttttgggtatacacctaggagtgcaattgctggcagttacgtaatttagatgtcacatacgtcagagtccccaagaccacccccaggttgtgcgatttcacttgaaggaccacaggactcggcatgtggttgtcccaatggctaacatttatcccagtgaaaggatacaaatcaaaatcagccaagtttagaaaaccaggcgaggcttcccagaatcctgtcccagcggagtcagggcgtgtgcttcattcctcttactagttgtgacaacacatacaaagtgttctcattcgggaaagctccttagagacttggcacccagagattttactggaggctggtcacataggcatcctctgcctggcatgtaccagaattccagcaggaaagcagacgtgcagtacacaccacattgtttgcacaagcagcccaggagtggtgagttaccctcaccgtttccggtaagttttatatccatgtagggaactgtttaccatttgtgtacccgggcactggccaaggccaaaccttgcaagccgcctttcctaagggaaggtctcaggcctgctgtgtgaacccttatctgcacctcataagtctttctactgcagagcaaaatgaaacaaaataataaaaactattcattagtaggaacaaccatataagtaaataattatactttagggtaaatggctgatttcgccttgcttattttttttaaggaagattgatatgccctttgtcgatggactctatcacagttgtgatgacatccctggtggaggtagaggaaatagttggacataaataagagaaaaacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagactttcagttcgtttgtattctacctttgtaaaacagcctatagatgatgatgtgtttgggatactgcttattttatgatagtttgtcctgtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccgtatgatatgattgcacttagaacacccaatttacttaaatcttggtttacttttgacttgataccataatctttaaaatcatttgtcatctttttttttttttttttgagacggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacctgcctcggcctcccaaagttcatttgtcatcttaataaaaatataaagacaggcaaagtttattggaaatgttcaaatggtgtgtggaagcaaaaaattacagccagtatatgagaccactattatggttttttaaaattaacttggtctagtaaaagtgatatcaagagttaatcttagaaacttgctcagtaaaaacattttctagtataacatgttctttaaaaagcaaatgctgccgtctttggaatcttaatctaaaaatgtggccgggcgcggtggctcacgcctgtaatcccaacactttgggaggctgaggcgggtggatcacaaggtcaggagttcaagaccagcctggccaacatggtgaaaccccatctctactaaaaataaaaaactcagccaggcgtggtggcgggtgcctgtaatcccagctactcgggaggctgaagcaggagaattgcttaaaatcagaaggtggaggttgcagtgagctgagatcgtgtcactgcactccagcctgggcaaaagagcgaaactccatctcaaataaacaaacaaataaataacaaaaaacaaaaatgttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagctctttaaataattaaaatataaaagcaaacaacccaaactacctgactataaacaggaaaagttaaccctcaaagagagttcttgtgaattctctttatgctggcaaatagctctaggattaaaggcacattagggtttccttcagtttgtttattctaagcttttactgtgctttttactgaacaagtttctgatgtataaaacttgcatctgatttctttggaaatattttcacaaaagttattttaatcagtatttttacattgcctttccagtgtccagaagtgtttctaaacttagaaagtgacctatagttttttaaaattatgttttcctagaacgtgccaaattttgatttactctaacaatcagtacttttcttcagatgctttgttctgtttagaacaaaaatgcactatagtttttaaagaatcatgcatctttgggttggcccaggatcaaatttgatattgaataatttattccagggcagctttcataaacatacttcatagatgttgttttgaaatgtttctaaatatctaaaatcatttcaacagcagaaatgatttttattttaacaaaagattatgatagcccttgtagtgtttaaaagtggtcatatttattactgactttgagtcaggtgttaaaatagcagtgccacagctcgtctcttgccttagtgtgctgctgtgagagtcacagtggaaactgcagggaggaggtgtgttcctaagaaccaaaatccagcacagcatcctgtgaagccacgtgtaatgatggtcccataaggaaagtatgtgaatatggctcttgtaaaggattaactattgtaattttagcttatgctctgtattctgttttctatggaattatttaagcccttttagtgacctttgtcctggcccatttaaaaactaaaatgtagtatatattgtataaaatggaaatatcattattgcttcattaggggaaactgtacataggcattgaaagaagggtaaaagcaagcagttttatcaggcagttgtaaaacaccaaaaatatagattcgtctttgacgtgtaacacactaaatgtattttgtacagcatctggtttaaaaggtgccttaagagtttaccattacttgctttgttctatatacagattatgtccaatgtatcattttgaagtaaataaccttattttagtatactttagtgatgtgttttgtgatgctacactcagacggtattgtgcatcagaagtcatctgttgagatttttgtaatgattaagttagtgtatatacatatgttcctgagatgtacacttcaactaccagaaacccagtatggagcacaggtaggtacacgcttgccctgtggagatagagaacttctaaacctatcacggtgcaggggtttttcctttaaaaaacaagacaaaacattgttttctttttcctttttttttttttttttttgagacggagttttgctcttgttgcccaggctggagtgcaatggcacgatctcagctcactgcaacctttgcctcctgggttcaagcaattctcctgcctcagcctcccgaatagctggaactacaggtgtttgccaccatgcctggctaattttttgtatttttaatagagacagggtttcaccatgttggccaggctggtctcgaactcctgacctcaggtggcccacttgccttggcctcccaaagtgctgagcttacaggcatgagccaccatgcctggccaaaacattgttttctgattatggaaatgtactcatggcagaaaatttgggaaacaacagcaaataataaagcaaataaaaatcactcaaaattctattgccagacattatcactatatacatttgagtgtttcttttcaatctttttttttgagagagtcttgctctgtcactcagggtggagtgcagtagcgcgatctcggctcagtgcaacctctgccccctgggttcaagtgattctcctgcctcagcctcccaagtagccgggattacaggtgtgcaccaccacgcccggctaatttttgtattttagtagagatgcggtttcaccatgttggcccaggctggtctcgaactcctgacctcaagtgatctgcctacctcagcctcccaaagtgctgggattacaggagtgagccactgcacccggccttattcttttttatgttgcattttttgtaatattaggatcctagtatgccattaaatagccattgagaactttttttttaatgactgcacaatatttgactaagaagatggagtaatttctgtgctcaatcccctattgaatatttggattattttcattgttttgaaaaatagatattaagcatccttatacataaatctttattttcttatattacatttctgaaaatgagactagtggatatgaacttttaaaagatcctttaagatggaaaaactaaggttcttggaaaacattgccatattgctactcacaaagcttttcattttcattcctgctagcagttcatgagcttagagcgatgggatgcatttacctggccttaagatgctcctgctgcaatgggaagtgaagccttggatagctttcctcctcctgtgcaatactttcttgtcattttcccacctgcactgagtcccaccgccagtcagggctgttttcaggtgtatgtgaattcatcccagcagtgtgccttctgctgccttttcctagggaactgaacatgttaaatcacagacgcgatgtggcactgattattgttcctcaaaagaaatgcgtgtctgaagatagcctcttacagattcctcacgggagtctctgttcagtgtcattgtaagtttctcagaataatcgcaggcgctctgatgcagcctggtaaagaagactcagtgatttctgggaactgcaaatgcttgccagctttccttctgtctgtggaaacactgaataaatgtattcatttctcctttccagcaatctgttagtctcactgctccattccaaggtttctttaatattattaacagagcagacattaagaaacagaattgtctaatccttgttcttccaaaataggtttaatccttgtagatagtttcaagcagacagtaagtcagttactaagttttcacttggagaaacatttgctgatagtagtagcatattgaccatttctgacatgtcatccttatatcaagttaggtgcacgctcctacacagccttggctcagcgcttggagcatacagtcttgactgggtggacataaaccgctgaaagtggccagcagtgagcagaggccacctactatcagcggcactgctgcaggcatggagacttaaatgtgtgagtgctggtataagcagaagtgggagagtcacctcgatgctgggatccagatggcggcttatttcaagtgcagtggcacatacaaaaaatatttttggaagggagcaaggactagggctgaaaggttcattcataatctttttttctttttttttttaggtggagtctcgctctgtcacccaggctggagcgcaatggggtgatcccagctcactgcaacctccacctcccgggttaaagcaattctcctgcctcagccacctgagaagttgggattacaggcgtgcaccaccacactcagctaattttgtatttttagtagagacggggtttaccatgtgggccaggctggtctcgaactcccaacctcaggtgatctgcccaccttggccttccagagtgctgggattataggcgtgagccactgcgcccagcccataatctccttttgacataggaattgttaattcacatattccatcaacctattgctcctctgaatcttagcagcttcttggtctttgttcaaatgaaatctaagtcaattccatatctctcaatgtcgctacatccacctcagtgcttatatcctaattttgtcttttttagagacagtcttgcactgtcacccaggctagtgtgcagtggctgttcacaggcataatcataacgcactgtagcctcaaactcctgatctcaagccatcctcccacctcagcctcctgagtagctgggaccatgccaccatgcctggctcacattctaaacattatgcaggaagctcaaagtgaaaatcaatatggaatgtttatattgaaaatatttttggctgggtgcagtggctaatgcctctaatcccagcactctgggaggctgaggcgggcagaccacctgaggtcaggagcagcctggccaacatatagtgaaaccctgtctctaaggtacaaaaattagctgggtgtggtggtactcgcctgtagtcccagctccttgggaagctgaggcaggagaatcacttgaacccaggaggcggaggttgcagtgagctgagatcgcaccactgcattccaggctgggcaacagagcaagactccgtctctcaaaaaaaaaaaaagaaaaaaaaatatatatatatatatacacacacacacacacacatatatatatatatattcaagcaatgtgaagaaaatattgggcccccttgtttttctttaatggaagagccatttttaaaagccagtttagaatccagatgatgacatctgttgctctactgtatgactgaaatgcaggtcagtgttgaaaaacataaaaaattggaagtctccactgaaagacctacactgctgtgggagggattttaatcaagacatttcaaaagcaatttttattacttgatcctgtcctcatacttggctaggagttcagctggagatagaatctaactctgaagatgatactccatgatcttctagcatcccttgtcaccagtgagaagtctgatgtggatctaataagtgacatgttatacaggttaacttattttcaagaaatagaattttctttttattattgatgttggaagttgaaactggccatatctaaatatattcattctgtttcttagtactaatgggatcttttcttagacctgggaaattttctcccattatttcttttgtttcttcccttttttctttcttttccttttctctttctagaactttctagaacaaatctcaggtcccctagatgtttcttccataattgttactatgcttctcatatgtttcatcctaccttctacttttgtcagcccatctgagtttatttcaacagccaaatgttttattttgaaatgattccaggcttccattaaagtttcatcaatagtataaggactgccatttacccttcacccagattcataaactgctaacattgcacaattgctttgtcattctgtgtgtgtgtgtacaggaatcacagagactcatcttgtaatgtttgtaatgtccatgtatcgtgtatgcacacatttttttctgacctattagaagcaaattacagagctaatacccctttatccctaaatacttcagggatgttctattacttaaccaattatgtacaattatcagaaccaggaaagttcacattgatacaatagcaatgaccaacaataccataatctatagaccttactgaagttttgctaattgttattttggtgtggttgggttttttgtttgtttgagatagggtctcactctgtcacccaggctggagtacagtggcacagtcatagctcacttcaacctcaaactttgggcctcaagcgatcctcccgcctcagcctcccaaagggctatgattacaggcatgagccaccatgctggcctcatttcccctttccttctcaaaaggattctggctttccctactgcattcatccacgtccactacccgctccaagagagctgagtaattgtcaagccaggtttggggagctttcttgatggaggggatggaaggagggtggtgctcaggctacagcagggagagcttttctgtttttgagctaaagacataacagggtgcagaggctgagaaaaggagagttctaagcaacatgtcacgagctatgtagcctcttcacactgcttctgaaataaaatctaacagtaggagtga

SEQ ID NO: 456 - DNA, 137368 bp, Homo sapiens
agttaccacgtcagtgagctgacagggaaggtacccggctctactgcccgtcccggacgactcatcctggcggactgtgcagtcccaccctgacttcggcctcaatttccaggaaacaggctccttctcttctcccatctgctaccagagccgggagagctgctcggagacgcctccggggtgcgggctggacatgagcagcggctgccggtcctgggactaggccccgccattttggatccgctgacaggtcagcgaagtctcttcctagagttccggtgtcgtgaaggccgccctgacatcgcaatagggaattagtgggaagggcccttaaattgggcgagccaaggtgggctaaggacgcagcggacaggaataagacgagggaagggttgttgtgggagggaacagggaggtatgcaggggcaaaggtcatgcctctgccgcaggaggggcgatttctgctctcattactgatcctttgcaggtgcccaaatcttctgttttcccaggcttgacctagtatttagcttctcctttccagcgctttctgcatcctgaagagcccagtactcaaaagctgaaagcaaacctaaggagcattgtgtctacttttatgggttttcagactttagatgtgaaagtctctctagattctgtacagcgtctacttctttgtgattgcctcactaatacaaaggaactgcttcattaataatgatgaactagtgcaccctagaatcaggttgtcagcagagggacgtgtggaaggcttgaggttatagcagcgcagggaactgggctatgagaaggcttccctcttacaggacagctcagctgccagtctgggtctgtatgtaaacactatacttatcttctgggcctgtttgttcctttatacaatctttcacaggcattcttttgtagtgtatgtttttgttgacatttttctctcagatcttcactaaggagatgaggcttaatcataaggaaaccactctattatgacatatttgactgacagcagagagagatatttgaatactggcaaagtttggtattgtcggcctattatgtttagtgggcaaaaagagtcatgagagattttcagccaattgtagggtcagagccccagagtgaatgatggaacataaccctagagagtagtttatggcactgtgatgacctttgataaactgctgtgttgtaaagctataaaagtccaccaagggtaacgaatgcttttagaaataaggaatagtgtagatggtgttttttaatgcacaatgtggaaacttgtgcattaattcaggtataaaaggcactctaggccctgtggaggatacaaatggaaaggtctgctttgggactgctcagttaatgcacttcttaaaagtagtagcatgtatgtgcagtggcctagctagagcatgtagtaggttaagagcaggatcaacctaataccttttggtatgtagtgggcactcaataaacgttatctctatctgggattagtttcagtatgtgatcaggacttgtggcctgcttttggccctggcagtcaggaacactttgcacttttgcatgatgaggtagtaacaaggaggatcaaaacctcatagtgtcagaagagaaaactatttaggatcttggaatgactaactcaatttttcctacctttgtccttatgaaattgaaatttcataatttcccttttcccttcctaccttcgtccttatgaaattgaaatttttgtgtgtgttgggagaagggggatggcattatttatgcttcacctgtgttgatttagatggaaatggtacaggaaactatttgcattttaacttgctgatctaagttgtagaattcctcccctctccccgcccccaagaaagtagttgaacgcagcaaatgaaatgacatacctcaggaggtacccaggtttgatgatcctgccttgctcacttgggccattgccctgttgagttgatatgctttgcataacaggcaatctagtctctgggtaggcagtgtgatcaatccaggatccagtcatcctcagttgagcctaagggtgactatagaggcatcaaaacgttttctctttctctctctttcttttttttaatcctaaatgtcatttctagataggaataattttctagataggaataattcccactcctacccacaaatcagaaaattcatccttcaaatacaagtcccaagcttgtatttgagcttctttttaatggtgtttgtagacagtatgttccagtcttgacagtgatgctcattggcacagtgggaactcaggctatagacatatctcctcagtagctgggcaccaatcccagtttcagctcagagttctcaaagttacactactattttatttccctcttttccagaagtcaggatgactgccactttcacataataacctcattgatagggtacttagactggctgctgtgggcagctaaagaggaagaagacacagctcttgcttttgaggagactctatttatagagtactcactgcaaggatcaccctaatctttgtatgacacttctcattgattgatcacacactatatccctgtggctctgtgtgactgattagaatgattctgttgttgggttaatggtgggattgaatttaagggtgtatgtttttgttgacattttatcctcaggctagaagagctatgtaaatataatgagctgctgtttagctgttactcttttttttttttaatatttcagtatgttcaactgcagttgtttaactaaatgaaaatataataaagcagtgtgctgatttggaaccccaataataatagaagtgatcatagaagtgattatttgttctagtagtagtggaaattacgatagatgcaatagtagtgtaaatgatcatggaagtatgatggcaaagtaatggtttgccaatcatataaaccaggggttacgagctcatgtgcctaaatgccaggcaggtaatgtaaatgagttaattgagtcccatgggaatgtattaggattagtggggactgttgtgtactggacaacccatgcctttattttttttttgtctttaattttaatttctttttattgagacagggtcttgctctgtcaccccggctggagtgcagaggaacgatcacagctcactgcagccttgacctctgggctcaagtgatcttcctacctcagcctcccaagtagcggggaacacagatgtgcgccatcatgcccagctaattttttaatattttgtagagacaaggtctcactgtattgctcaggctggtttcgaactcctagactcaagcagtcctcccacttttgcctcccaaagtgctgggattttaggaatgaaccaccatgctcaacccattcctttatttagaagagccaactgctcctttttcagcagattgttactgttttagagtgcaggcacagaatgaccactctttctatttttcaggagaaactggaaatttagatcattgtgttttctaattgttggaaactagttaaaagtatttttaagcctttttcaggccaaagaaaatatgtctgtggactggattctgcccaatggttactggatgatgaccctcaataaacaaaatgggcaggccttatgagacttaatcactgcagttctctatacataatcacatagactttttttctttgtcctactctgccagctgtcacctttgtaccttgggtgccctgagtggctaaaagatggagtgagatagagaaggtttgttttatttttcatctccaagctggcagaagggacagctttggacatattagtagcttaccttgtaaacggtttttgagatactctcagaatctccacagggggaggagatggcatgctagagctgaggtaccctggtcacccgattatcaggtctgggaggattttccagtgatgcattgtcagggcaccagcttttttcccagtttaaccttcttttacttccaccctttaagtaaatttcttgagctcagtaagttgtttcctagtttagtaactttggttattctcaataaagcacagaactatgatgtgttcctaggccagctctggaaatgttaaaagctctgcatctttagtgtttctctggctttttttttttttttctctgatggagtcttgctctgttgcccaggctggagtgcagtggtgtgatcttggctcactgcaacctccgcctcctgggttcaagcaattctcctgccttagcctcccaagtagctgggactacaggtgcacgccaccacacccagctaatttttgtatttttaatagagatgtggtttcaccatattggccaggctggtcttgaactcttgacttcgtgatccgcccacctcggcctcccaaagtgctgggattataggtgtgagccaatgcgcccagccttctctggcttttaaaggtattgagtgaacataaaccttagaagggcctattgctggtcctttagctccctactaccatctaccttttcagaaagtccatcagtttttcttggtttgcccagctctgtattagacacaaaggcatcatgaaaaagaaaaacaaaattgcgcttttgcctttggagaatttatttgctagttggataagaataatttttttttgagacagagtctctctctgccacccaagctggaatgcagtggtgtgagatctcggctcactgcaacctttgcctctcaggctgaagtgatcctcccatctcagcctcctgagtagctgggactataggtgcgtgccaccacgcctgcctgatttttgtgttttttgtagacacaggattttactatgttgcccagagtccagtggtgtcatcatagcccattgcagccttgattttttttggctcaactgatcctcctaccttaggctccctagtggctggaactacaggcatgtatcactatgtcccactaatttttttttttttttttttaatttatgttgcctaggctggtctctgactcctgagctcaaccattcctcctgctttggcctcctaaagtgctgggattaaagatgagagctactgcacctggccaaggaaatgtttaaaagtgattaagaggccgggcgtggtagctcatgcctgtaatgccagcactttgggaagtcaagggaggcagatcacctgaggtcaggagttaaaggccagcctggccaacatggtgaaacgctgtctctactaaaaatataaaaattagctaggcgtggttgtgggcgcctgtaatcccagctactcgggaggctgaggcaggagaatcacttgaaccctggaggtggaggttgcagtgagccgagattgcgccactgcactccagcctagacgacaagagcgaaactctgtctcaaaacaaacaaccaaacaaacacaaaaccaaaccccataaaagtgattaagaaaaaaaaaaaaaccacttaaacactagtgtactaaaaacagctatttagagccaaagaaaataaggcatatatgaagaattgacagttacattaaaaattatatatttcacaaaaatgtgaatgtgcaaataacacttaaggagatgtcaggaagatagacgtgaaaaaagaagcattatgatatggctggtaggtaaatgtgggttctttttacctgtatggaaggtttgtaacttctggtagagaagcaaatatatattatcaaaaaaaggtttgccagtgtggctcagagttattgtcttctatgaagtcatttttctcatgaggtggatgtgtgctgtaccactcttgaagagtcagtcttgatgttatttcatttgttcatctagtatttattgatcatttttcttactatgtgtcaggctttggagataaaagggtaaataaatcatggtctttccccctgagatagagcctgatagtcccatggtggtgatacactaaataaataattataaattagtataagatgtgtttatttttattttcatttatttatttgaggcagagtctcactctgtcacccaggctggagtacagtggcacgatcataccgcaaggcaacctggaactcctgggctcaagtgatcctcctgccttagcctcccaagtagctgggacaacaggtgtgcgccaccacacctggccaatttttctttatgttttgtagagacagggtctcgccatgttgcctaagctggtcttgaacttctaggctcaactgatgctccctccttggcctcccaaagtgctgggatcacagacatcagccactgtccccagccaagatatgtttagagataactacaaagtgctgtgggtggccgggcatggtagttcatgcctataatcccagcactttgagaggccgaggcaggcagatcacttgaggtcaggagtttgagaccaggagtttgagaccagcctggccaacatggtgaaaccccaactctactaaaaatactctgctaaaaaagtggaaaaaagggctgggcgcagtggctcacacctgtaatcccagcactttgggaggccgaggtgggcagatcacctgaggccgggagtttgagaccagcctgaccaacacggagaaacctcatctctactaaaaatacaaaattggcccggcatggtggcgcatgaatgtaatcccagctgctgggaggttgaggcaggagaatcgcttaaacctgggaggcagaggttacggtgagccgagattgtgccattgcactccagcctgggcaacaagggggaaacgctgtctcaaaaaaaaaaaaaaagtggaaaaataaataaataaataaataagtggttttaagattgttcttagaaccactgtgatattctgactccctcattgacttttggatggaatgagtaagggtttatcaggtggacaagagtgagaaaaaacattcagaatagaaagggagcttcatatgcaaaggcaaagaggcagcaaagaccatgactttaaaaagtaggaatgatgtggcgtggtggcccacacctataatcccagcattttgggaggccaaggcaggcagattgctttgagctctggagtttgagaccagcctgggcaacatggcaaaatgttgtctctacaaaaaatacaaaaaaattagccaggcatggtgactcatgcctgtagttccagctacttgggaggctgaggtgggaggatcgcttgagcctgggaagcagatattgcagtgagtcaagattgtaccactgcactccagcctgggcgacagaatgagaccctgtttcaaaaaaaaaaaaggaactttttaactttttagggtcttttattttattttattattattattttttgagccggtgtcttgctctgctgcccaggctggagaccagtgatgcaatcttggcttactgcaacctccacctcctgggttcaagcaatcctcctgcctcagcctcctgagtagctgggattacaggcccctgccatcatgcccagctaatttttgtatttttagtagagtgggggtttcaccatgctggccaggctggtctcaaactcctgacctcagttgatctgcctgctttggcctcccaaagtgctgggattacaagcatgagccactgcccccagccgaggggctattttagacaaagaatatgtgtagcttatatggggcaccaatggctgccacccagcttgaaaaataacatcaccaaaactgaggctgcatgtatgtatgcccttccctgttagttcccccacactccctgccgcttgccactattctcaatttttttgtgtgagcttctctggggtatagtcctagaagtggaattgctgaaatataggatatgaagtgctttagctttgtaagataatgccaaattgttattcaaattcatattaatttagatacataccagccacttggtctgcattttttaccaacttaaaaacaattttttttttgagacagggtcttactctgttgtccaggctggagtacagtggtgtgatcgtggctcactgcagccttgacctcctaggctcaagtgatcctcccacttcagcctctcaagtagctgggactacaggcacatgccaccatgccctactaatttttaaattttttgtagagatggagttttgctatgatgcccaggctgttctcaaactccttggctcaagtgatcctcctgcatcggcctcctaaaatgctggattataggcgtgagcacctggccttttaagtattatcagatttaaagtgttttgctatttcaggaatgtaaagtggtatatcattataatcttattttgtaattttcctgattattaatgaagctaataatcttttcatatatttatttgctgtttatgtttcctattctgtgaaacacctattcatctctgttgccaattttggggaggggttatatgtctagttcttatagttttgtagcagttattgtatactctggatattactcctttatattagttatatgtgcctcaaatattttcttctggtttgtgccttatcttttccctcttttttatgttgtcttttgaacaggcatttttaattttaacatggttgaattcaccaattttttaaagaggttttgctttttgtttcttgtttaggtacttctcccttatgctgagtttataaaaatactctcctgtagccaggtgctgtggcacacacctgttgtcccagctacccaagaggctgttgtggaaggattgcttgagcctaggagtttgagtccagcctgggcaacatggcaagaccctatctctaaaaaaaaatcaaaaagaaaatattctcatatattagcttctaagagatttcaagttttgcttttcatatttaaataacctgagatatatttttggtattccattaaataagaatacaatttattgtttctttttctcctgcttttgttggatatagacagagttgccaagtgatacagtgactcctctttggatcctgttgaggtaactgggatgccacaaagcactaggggaatgttctagacccagctttaaatggacagtggtttcaagggtacatgttactcagagtctctgggccagtggcttatctggctaagggtgttagttggtatttatttagttgttccctctcttatttatttttttctattaatttttcatttgtgtgggtacataatgaatgtatttctcttgttatttctgacacaagataaatcttaagttcgtttctactatacttttatgaggtttctgcaggcctttatgaccttgtgacaagggatttcttggccattggctaccaggcagcaagtggttcatcagtttcccatctgaagctgaagggcacaactgtttggagattccctgagtgaggggacatactcagagacctagaaggagattaggcagctctgcatagtacttgaaaataattcctcttcattccctagatgtttctttttttttgagacagagtctcactctgttgcccaggttggaatgcagtggcgcgatctcggctcactgtaacctccacctcctgggttcaagtgattctcctgcctcagcctcccaagcagctgggattacaggtgtgtgtcaccacacctggctaatttttgtatttttagttgaggtggcgtttcaccatgttggccaggctggtcttgaactcccaacctcaggtgatctgcccacctcagcctcccagagtgctgggattataggcgtgaaccactgcgcccagccctagatgtttcttttttacaatgattttttgcttagacctttgctgtcttagaaagtggttacttcttttctaaagggcttattcatttttagtcaatcagctgattaaaatttaaaagtagttaataggtaatatatgtttgtgacacaaaattcaaaaggtaaaaaagaatatacagagaaaagttagtcttcctttcactcctccaccactcagttccatagtcatccagtttctttccctggaggccgtaacctcttagcattttcttacaagtccttccagagacctagagcatattcatcttgcctacataatttaaggaaagggaaataccaggaaagatttaatcttttctcttctgatactttaaatcatttttgaatatatctttcttctatttctaagttctcctcctcctcagaagagagcgtggttgtacattcatatcattgacacttctcagaagagaacgttgttgtgttcctagagcatttggaaagcagatagtcttctgagattaacctagttttttaaattgtcattaatataaatcttgtgttggattcccttgtggactggggagctgtcatgggcatggacacattattattattattttaagacagagtctcgctctgttgcccaggcttgagtgcagtggcacgaacgcggttcaccgcagcctcaatctaccggcctcaagcaatcctcccaccgcagcctccctggcaactgggactacaggtgtgcaccaccacacctggctaatttttgtattttttatagagacagggttcgccatgttgccaaggctggtctcgaactcctgggctcaaatgatctgcccacctcagccttccaaagtgttagggattacaggtgtgagccactgcgcatggcccctggacaaaatttgtaccagtttctttttcctttatcatggtggttttcatgcttttcactttcttggggggcctcatcttatgcaaaatatgcaaattgagctacttgctaggtacatttctttctctattatctctggctgtgtctgtttttgtatctattccactaaactgtataaatgcctcaaggacataaattatatacctcttatcattattaatgtttaattatattgatagtacagtaatacattctctttgtaaaaaaaaaaaatttttttttttttgggatggagtctggctctgttgcccaggctggatggagtacagtggcatgatctcggctcactttaacctctgcctcccaggttccagcgattcttctgcctcagccactcgagtagctgggattacaggcgccctccaccacacctgcccaatttttgtattttgagtggagatgggtttcaccatgttggccaggttggtctcgagctcaggttatctacctgccttgacactcctgaagtgctgggattacaggcatgagccacagtgcccgaccttcttgtaaaaagttaaaatattacagatccagcctgggcaacaaagtgagaccccatctctacaaaaagtacaaaaattagttgggttggtggtgtgcgcctgaagtccctgctactcaggaggctaaggcaggaggattgcttgagcccaagagttcaagtctgcagtgaggcatgacagtgccacaggactccaacctgggtgacagagtgagaccttgtctcaaaaaaaccccaaaagacaaaacgattacagataaggctcaagtatcctctgattgcaccctgttttcacagcaccttctctaggaataattatggttataagtttgggtatattagcacagaccttttattttatatttacatatcatattaatgctttcttgctgtcagttaatatgagttttcagaacttttcaaaggtcttgtcactgtcactgtccagttttctggagctgactgggcagattggatgcagtcatttgtttatatttatatttatatatttttagagatagtgtcttgctctgtgacccaggctggagtgcagttgtggggtcatagctcactgcagcctcgaactcctgagctcaagtgatcctcccgcctcagcctccccagtaactagaactacaggtgtatgccaccatgcctggctaattttttagttttgtttttttggtagagactgggtctcactgtttgcccaggctggtctcaactcctgggctgaactgattctcctgccttggattcccaaagtgctgggattgcaggtgtgagccacttcaccttgtctggatgcagcctttacgctgacattgcaactgtggttctaaaccaacactatgcttccaacaacctttattcttttctttaacttgaatctttaaattcaagttaaatttttattgagtagattaaaaagaacaaagggaagactatatacttaggagagagcgagagagagtgtctcgatatgctgcccaggctggtcttaaattcctgggctcaagcaatcctcccgcctcgtcctcccaaagtgctaggattataggcatgagccaccatgtctggccagaaatattgtttttaacaagctgacattacagttgtatctgtgtacttaaaggcatcataggactttgggaacaattgactttgaagaatttgacatgcttcctgaggattgttgaggtgcctttgaaaaatgttctggattgactcgctttgagttgtatcttgaactaccttgaacttctaaagacccccaggagagccagatagttggattcataacataagatggacttcatctcattttagtattacagattttttttttttttttttttttgaggtggagtttcactcttgttgcccaggctggagtgcaatggggcgatcttggctcacacaacctctgcctcccaggtccaagcaattctcccatctcagcctcccgggtggctgagattacaggcatgcgccacctcgcctggctaattttttgtgtttttagtggagagagggtttctccatgttggtcaggctggtcttgagctcccgacctcaggtgatccacctgcctctgcctctcaaagtgctgggattacaggcctgagccactgcacctggctaacagattttatgagtatagaaaattttggtactggccaggtgcagtggctcacgcctgtaatcccagcactttgggaggcccaggcgggtggattacctgaggtctggagctcgagaccagcctgaccaacacagagaaaccccgtctcttctaaaaaaaatacaaaattagccagatatggtggcgcatgcctgtaatcccagctactcaggaggctgaggcaggagaattgcttgaactcgggaggcagaggttgtggtgagccaggatcacgccattgcactccagcctgggcaacaagagtgaaactctgcctcaaaaaaaaaaaaaaaaaaaagaaagaaagaaagaaaatcttggtactgaaaagttaaatcacaattctaaccttatcaggtactgatttttaaacttgggtatgctttgggtaaccaaatattaaccagactattatcttaactgttttggtaggtttgccaagatggtggataagaatatttacatcattcaaggggagattaacattgtggttggggccatcaaacgaaatgcccgatggagcacccatacaccactggtaagtgggaaatggataaatagcctggtcactaagtttttataggggatctgttggcatggttaaaagagtaatcaaattcctagtaataatgagaatagtaggaattcagagttgttcttgatatcttgtttttttgtatcccaactagcatcagatatataggctatctttttttctctgggacccaaaagatgacaccattcttcttctaaatatttttgtaaacagcttaagctagtcctgtgcttgggacctctttagtatgcctaaaagtatcagaaagattctttattttctaattctttagggctataattagctatcaaatttatttaaatcagggtagttattgatacatagaacatgacttagtgatggtactccttcttgggggttcagcaaacttccatatatagagtaggccatatcttaccaatcagatgagtaagaaacttacctgttatacagttggctttctttgctatatatgtttgaggacttttttttgtagaattgtgtaaaacaatttttggcccagttgtaaaagcaagtttagaaattgccaacttgggagtttatatgaacatagttggtaagtgcatttggaaatttctcaagttctttcataaaaatgtattgatttaaaagtgagcatggcatcaggaatatctttgaaatgaatatgtatgatgacatagtgggtatgaaaagggagagaagacagaataatacacatataaaggacctggcaatctgtagtagcttgagtgttatggtgatgatatagattagcacttaagaattcactattttgtataagcccagagtatctctacgaaataagagattagggtacagaaaaatatgaactatggctaattttcttttcctcagaaggaaaacttaaatgattttctgattggattcatagaaagagcccttgatctgtcctttattttccttttcctcttttggcccaataatgacttactttaatctatgtgttctacaggatgaagaacgggatcctctgctgcatagtttcggtcatctaaaggaggttttaaacagtataacaggtaagtctccatatgtatgtggattactaatcttggtaaaaaatatgtgtttgatttattgaaaggatagacaaactttttgtataaaggactttatagtaaataatttaggctttgtgggccatacacaactgcaactacttaactctgcctttgtagctcaaaagcagccatagataatatataaataaatgagaaatatatattttctttttgtttatttcatagagacagggtcttgctatgttgcccaggctggtttcaaatgcctgagctcaagcaatcctcctgtcttggcctctcaaagtgttgggattccaggcttgagccactgtgcctggcctatattttcctttcttctttttttttttttttttttttttgaggtagagtctctgttgcccaggctggagtgcagtgtcatgaactcagctcactgcaacctctgcctcctgggtttaagccagtctcctgcctcagcctcctaagtagctgggattacaggcgcgtgccaccacacctgcctaatttttgtatttttagtagagacggggtttcaccatgttggccaggctggtctcaaactcctggcctcaggtgatccactgcctcggcctctgaaagtgctgggattacaggaatgagccactgcgcctggcctatattttctttaaaaaaaagaatctgcaagccagatttggcccatgggtgcagttttccaatccttggtttattgcattggtttcagtcttcatgatctttcagtcttcatgtgttctagaatcatttgtccctttgtttgccccctattttcctaatcacggtaaccttatataatatattcatatgtttagaattttcaaagccattttcacatttattaccttattgaacttttatacaaccctgtgagggaggcatggcagctattgtcccctttttgtgaaagaagttaaagcccagaggagtttaaagtgatttagctgaggtcacactaatcctaagaggtggagtcaaaactagaattcaggcctctgttgcctggtttagggctctttgctctatattgcttctgtacatgtgattagaagagaatgtacacattaagtaccttatatttgtgtgtgtgtgtgtgtgtgtgtttattttatgtatatatatacacacacacacacacatatacactggcaggaaaggaggaaagtgtcaaaaccaaggggatgtagatacagactgaaagggacagcctcagagctatgttcctttgttgaccacaaagggctcctgcagtgtataaccctggaatgcttttggctagtgacatatgtcagactgtaattggatagtgtttaggcttctgcaaattaaacaaacaataagaaaatttcttcttttcattagaaatatgggagaagatctggagaaaaaatctattttactttcctaaacatgggctaaagttatctaagagttccctacatattttctttctttctttcttttttttttttttttttgaaacagtgtgtctctctgttgcctaggctggagtgcagtggtgtgatctcggctcactgcaactgcaacttccgtctcccagattcaagcgattttcgtgcctcagcctcccaagtagctgggattacagacgtgcaccaccacacccgactaatttttgtatttttactagagacggagtttcaccatgttggccaggctagtctcagactcctgacctcagatgatccacttgccttggcctcctaaagtgctaggattacagacgtgagccaccgtgctcagcccatattttctttttgtgcagtggcgtgatctcagctcactgtaacttctgcttcttgggttcaagcaagtcttctgcctcagcctcctgagtaactgggattataggcgtgtgccactatgcctggctaatttttgtatttttagtagagatgatgtttcaccgttttggccaggctggtgttgaacttctgacctcaagtgatccgcccaccttggcctcccaaccatattttctttaaaggagcaaatttcactcaattgaaacagcttggaaatgttagctaagaaggatcaagtatagaggaggcaattgttgactagttagcagggcaaatgctgctactaggtggcatgttcttattttatggcctgtaccgactggtacttgagtgctttagaatgttggctacttgcacagatttttttttttaattttacagataaagcttacatatcccaattagaaaggaaatataatgaatggagatttacagttctttttgtttggttttgaattcagagtactgtcttcttaagagatattaagaggatcaaacaagttaatataattggaaacacttggtaaacatcttatacacagtgaaggattgttgttataagtgactgggaataccctaaaatgactgagatcaccctggccttgtaggccttttggtcattctgcaaaccttgaggagctgaggtggtgctgctatcctgacagagccacatttcctgcctgctactgaatccagatcccatgcttattttcttcatgctaacatgtcccaagattttacctcagagaccatacctgtggtgaatgatgcagtctaggaattgtagactatttaagagctatcaaagttgagtctgacgcctgatttccttacgtccttgggtcagaaatccagccagattatctgctcttggaactagtaaaaccagagtgtgttcaggagccatttctctcattggtggtaggaacatctctgggtgttgctaagctttcccctggagtgagagggaagggagtagtgttttccaaggccaacagctgtggcatgtcttgaaatggtgcctgccaaggttgctacattgttcttggtttttagcatattacctgcctgagaaaatgacagaatagacctaaaatagagcatttatggtcttcatattgcttctgaccccacacacagtgccggctcccaggagcaggtttatgggtcagctgtccctgtggtcctggactctgcaacccatgactaatttcttgtttcttttacggaaacaaacagatttttctgattggcagtgtcaggaggactgctttcctggaagcttattaatggtaggaggctgggaaagggtttttaacttggagagaaaactgaagggaatgtgcttgtgttagatgaccagttaaggtgtaccacttagattggaggagggatagcaggaattctaggacttctacccagtttctcatgaaactgacttggacatggtccttttttgcaaagggtttctgtttgcatttttctaggctttctgctggcttgattggtaagactatcactgttggaaatgggtggttcattggacattgtcagtaaaccaaaatgatttttttttctctttttgtagaaagaatctttaaaatgtataagtactacctacactactcctccaggaatattatctcattattgtgaaggaaataagtccttttctccagtaaggttggctaagtccatactagtttttctcacagatgtatgtcattggaccacatttacagtcagtatttgcctaaactgtatgatgactacaaggtctatagcatttagagtaataagatattctaataataccaaatttgaaaagagggttgctcttggaagaaaaagggtgtccaagagcaaagtttgcatactgttactttggataaagctttagcttaccaccagtgagagagacttgactgctgtccctcatttggtcttgaagtcctctcaggactccttttagattattctgaaggagttaaaacagatgtgtggttaccaggggctgggagggggtatggagagtgactgctaatggctacagggttcctttttggggtaatgaaaatgttctagaattagatagtagcgatggttgcacaactttgtgagtatacaagaaaccactgaattgtatacttgaaaaggataattttatagtatgtgaatcatatctcagtttataaaggaggcaaatgtaggctgcagaagtgatggatttgccagttttttctcaggtctcagaactgtggagggaagtctctgtagtcactgctgtgctttggacccattacccagcaaaggcagcataaggctctgttcagcttctggcccagtttgtccttttatgtctctctcattaactcaaggaagcacatggcttttatatttaaatttattcaaactgtaatctttgacatttgagttagcttttagtacagttttgcatttatagtaatatatattatgtattttctctatccccaaagaatccgttttaatcttttccggatgcaaatttcaggctgtcttgtcccatcttccctctcttgctctctttcccctccccccacggagtgtgtttgatcaggtgtggcaggaatatccactgtcaagctgcgccctttatattagtcaatattatccttctcccccctccctgtctgtctgcccctttgggctttcccagttgatttataattttggaattctcattggagtctgtaatacagtttgttcattatttaaccaaaacctgtttaatgagcagagagaggcaatgtaaatgttaggcatgttgcagtgatgtacctttgtgcttctcagagcgggtgggtagttaactctgtgctgcctgcagggctggggtgtcctggccttaggggcagaagggccactgcctctctcttacatctgcccaagccctgccatgggtttagattccaaagacacatttccttttattcttctaagaatcttttggggctcttgcatatgggagttatcttcagtctcgcagctagaccttgtggtaggatctgtggcatgggatggggcatggaagggaaagtgaaatatcaggatacttgatattgctcttggttttagatctgacaagagtagacagtttatgggaatgcttctagccaatatggtctgtggtctttgatctctttgttcccagactagataaattcttgcaagccttagttcccttcatccagtatagctttatggaaagggctatagtcagttgtgagttgtggtgtttggttgtagtcatttgcctccagatatagtctgtctttgtccttggtctttaaacttagatcattacaaagagattcttttccagaaaatttttggtttaaaacaggagaggaacagtctaaaagtatcacaaccaggctaggtgcagtgacccacatctgtaatctagcactttgggtggccaagacagcaggattacttgaggctgggagttcgagaccagcatgggcaacataccaagattccccccatctctacaaaaataaaaataaaaaaaattagttgggtatggtggcgtacaactgtagttccagctacttaggctgaggcgagaggatcacttgagcccaggagttcgaggttacagtgacccatgattgcgccactgtactctagcctgagtgacaagagtgagaccctttcaatgaatgaatgaatgaatgaatgaatgaaagaaagtatcacaaccaaaatcttctcttatgggatcatcttttaatgacttactttaaagccttcagggccagggcttgaggaagacttcttagggtgtgcgtgtgtctatgtgcgtgtgagggtgtggtggtgaggagtttgcctttggagatttagtcccaggtctttttagctctgaggacctaatgtccagttttggttatcaggactggggttctcagtgtaagactaaggtggagggccgggtgcggtggctcacgcctgtaatcccagcactttgggaggccgaggcgggcagatcacgaggtcaggagattgagaccatcctggcgaacacggtgaaaccccgtctctactaaaaaaatacaaaaaattagtcgggcatggtggcaggcgcctgtagtcccagctactcgggaggctgaggcaggagaatggcctgaacctgggaggcgcagcttgcagtgagccgagatcgtgccactgcactccagcctgggtgacagagcgatactctgtctcaaaaaaaaaaactaaggtggtcttgaggcccagtataggtacccatattaactataacattgttctagcttcttagaccttttcttttggggattctccaagatttggattccttcagggcctagcttattgagttgcttctaactgatatttattgactatctggtatgtgccaggcatttttcttaggtacttaggaagtgggtctgtaatggtaaacaatcagtcagacttcctgccctcatagccactggtttgacaggactaatgactctagctgatcattccaaagctaacattttgtagcctctactttatgctatatggtccctatcaggcatggaatggatgaccatgagtgagagcaatctgctgccagcttttcttattcctgctctttccttaaggaacaagccaaagaaataagtaaaaacaatagctcatatttgcttatttggctttcacatgtaaagctgttatggccagagtttagctattcccaaagacattggtgggttgcatagcgtaattctgggggataggatatttctttacagagcttactgggacagcaggttatggcgtgcttgagtttaagagggagaagcacgtgccaggagaaagtggatgtgtcaggagtttatttaagtatagtttatcctggacaaacacacctgtagggtactgtctgtctcaagctttgtgaattcagagtctgagctaggaggtttgagtccatctaacctccagaggtttgcagagaacatttaaacagagtctggaagccaacttgggaggaactatgacttaacacctgtctggcctgggcctcttagcagtagccgcttaggtagaaaagaaactgtttgagaatgcctgatacctcaagtttaatctgtttcatttggaaaatggggaggtgtagagaaaagagattttagtagtcattgtcaggaaaaagattgaataagagtatattatatgtgccaggcatggtggctcacacctgtaatcccagcactttgggaggctaaggcgggtggatgacttgaggtcagcagttcgagaccagcctggccaacatggtgaaaccctgtctctactaaaaatacaaaaattagccaggtgcggtggcgcatgcctgtagtcccagctactcaggaggctgaagcaggtgaattgcttgaacccaggaggtgagattgcagtgagctgagatcgtgccactgcactccagcctgggtggcagatcaagactccatctcaacaacaacaacaacaacaacaacaaaagcgagtatgttatatgaaaaaaatttgctggagtcctattgattaagtgcctacttttattttttcctacaggggtctatagtttagggagtaaagtaatatatcattattaatcagcatgagaagaaggttgaatgggtcatcagcttttgttccacttggaattgagcttgtgaattgttcaaggcctaagtaggaactaaaagaaccaaatgtgataaaatttggcagacaaattttgtgaagggctgagtgttaggaaaggcaatgggcacacttaaaagtatccatttcctgtgccctgttttactttcttggtttataatataaaactatagttgagtaatacattagaatgtgacttgaatttgagtcagactgactttggcaccttagaatctctgtaacttgagtggccacagacttgtagacatttcagcacagttagagtgaataaaggtactgtgattctttttttccccagggactattcatattaaaagggtagctccaagaggcctatattttgatgacttgattttgccatttctttttactggggccttccccagatgatttatgaatgctcttcatttgacacttttaaaccaagaagttcttccaaacatttgtttgtactcaaggttaggaaatgaagactcttgagaagaaacagctctgcataatctgtcctctcatgggttcagctctctctttttctcttcctcatacccaggcacacttagccatcagaactagtttcctggctgttgagggggcacattttctactgcatgtatcagaaaaggaattgtgtaaaaagagggaaaagcattcttaatagtttagctctcaaaaacagagaaacctaatttctttgtagcaaaggttagggggcagtgtaacagtgtggtttgtggtgggtatcaaagttgctggtgtttttattgcatttgtcctctttagcacagctacctcttgaggcctgaaacttctgagtatatgcccaacttaccatgacagcagtcagatgagtaaaaagaaagccagctgctgtttttttttcaaacaaggaggcaggcagagtcccttcctgcttttccacccattcaaactcaggacaagtgccaaaagggtttcagaagaagccaaatgcttgaaattcaatgtgttgttttgattaggagagatagtgaagagtttgtctcagccttgcccccctctgactatctctctatgttcatagatacttagttgataacccagtttctgaagtgatagtggatatgtttatggaaagggtgagtacatttgtcttttctctcctggcatctgttagaagatggagttggctatagagcaaaatggagataagatcatttcagctcagatcacttcattaagaaagggtaatagatggagagcaatgactactttaggctctcagttttactctaggaaaccaggagataatttgcacctcaccagtttaggggcctttattcctttcctttattctttgaagatcctaaagaacttagatggacaagcacttctggctgtctgttggctgggttctcatggcatgtctcttctgtaacatcagcattctgttaccactgttaccactgtaggtcgagttgtgaagggctgccacatgtgcacagatcacaactgacctttccttgttccacgcttattgagcaattacttgcccgtttgtggaactcacattattgtcttgcatttctggcccagtgtgaagtgggggcatccaggaagtggcctaatggactgtacatcagagggcaataaattggcatatgatttggtggaaaggcagggccagatgtagtgtgggagctagagtttttctgcagtcagccatgcagcttgcttccaggtgtcctggaaagcagcttgggaactagagggtaagagtagttgaggacattcactggggaagaaaaggatcaaaagcacttcagtgttatctgggattggccctgaattgaaaaaaaatcctctaaaagtagagggacaaatgagatttccctgacactgacagggacttttccacagattattttttgttttcaagtaaagtgagttattgtaagaaaaaaaatctaaaatttgagagacccttgacaagaggatgtagaatgagaaagcctcattccaaatgagtttttgcatttaagaaaactggtaccaaattgattaaatgaaatgagagctgatatggtattacaactgccctgggctacagtggtgtttttcagactgtaggttgatttgcattagtgaattacatcactgtaatgggttgcatggcattctctccaattttttttttttttttgagacggaatcttgctctgtcaccgcggctagagtgcagtggcgcgatctcagctcactgccagctctgccttccgggttcacgccattctcctgcctcagcctcccaagtagctgggactacaggcggccgccaccatgcccggctaattttttgtatttttagtagagatggcgtttcaccatgttagccaggatggtcttgatctcctgacctcatgatctgcccgtcttggcctcccaaagtgctgggattacaggcgtgaaccactgcacccggccttttttttttgagacggagtctagctccatcacccaggctggagtgtagtggcgcaatcttggctcactgcaacctccgcctcctgggttcaagcaattctcctgcctcagccttctgagtagctgggattacaggcacgggccaccacgcccagctaatttttgtatttttggtagagacagggtttcaccatgttggccaggttggtctcgaactccctcggcctcccaaagtgctgggattacaagtgtgagccactgtgcccggactgctctccagttttttatgatgaaaaattttaaacttagcaaaaattgaaagaataccataatgattacccatatttcacatttagagtcaaaattactaacatttaggcatatttgctttatccgtatatgtgtattatcatttttttcatgatccatttgaaaataaattgcaaacatgttgacatttcacccctaaatacttcagcatgaatcctaaataaggatgttctcctacataataccattatcacaactaagaaacaacaataatttgccaattctagttaatatccagttcatattaaacattttccgtttgtccccaaacttttatagctataattggttttagaaaccaaaatccaagcacaattctcatttcattaggtagttatgtctttttagacgttttattttatttattttagagatgggggtctcactgtgtcacttagggtggagtgcagtggtacgatcatagctcccagcagctcaagcgatcctcctgcctcagcctcctgagtagctgggactacaggcgcatgccaccaagcctagctaattttttattttattttattttattattattattattattttttgagatggagtcttgctctttcgcccaggctggactgcagtggcgctatctcagctcactgcaagctccgcctcctgggttcatgccattctcctgcctcagcctcccaagtagctgggactacaggcgcccgccactgcgcccggctaattttttgtatttttagtagagatggggtttcactgtgttagcccagatggtctcaatctcctgacctcgtgatctgcccgcctcggcctccccaagtgctggaattacaggcgtgagccaccgcacctggcccatgcctagctaatttttaaaattttttgtagagacaggatcttgctgtgtttcccaggctgttctcaagctcttggcctcaagcaatcctcccaccttaacctcccaaaattgttgagattacaggtgtgagccactgcacctggccctaggcttttaaaagacaattttctccacctttttttttttttttcttttgcattggctttttgaggacaccagcccatttatgtttagaatgttctacattctggatttgtctgtgtccttgtggtatcatttaacttgttcctctttcccgtatgttatgtactaaaaggattaaaagcttgattagattcaggttaaatatttttggcaagagtattttatagatgatactatgtaattcatattattactattattattatcatcattaccattattttttgagacagagtcctgctctgtcccccaggctggagtacagtggtgtgatctcagctcaccacagtctccacctcctgggctcaagtgatcctcccacctcagcctcccaagtagctgggactacaggtgcatgccatcatgcccagccaattttttgtattctttgtagagacagggtcttgccatgttgcccaggcctgtcttgaactcctgagctcaagtgatccacccacctcagcctaccaaggtacagggattacaggtgtgagctattgcgcccagccttatttcatattatatcaccacaggaagcacatcctgtcaggttgtcctgcaattgttgatttttttttttttagacggagtcttgctctgtcacccaagctggactgcaatggtgtgatctcagctcactgcaacctcactcccaggttcaagtgattctcctgcctcagcctccccagtagctgggattacaggcacccaccaccgcacatggctaatttttgtattgttagtagagacagagtttcgccatgttggccaggctggtttcgaactcctgacctcaggtgatctgcccaccttggcttcccaaaatgctgagattacaggcatgagccactgcacccggccgcaattgttgattttaacagttttgttacttgcttcttatggtgactgccatatctcctaattttgaaatacgttaatttttctttttgtaattttaagtaatctgtgaagtaatatttttgcaccttgtaaatatcctgtcctctaatatccttttacctaatggttatccactgattaatatttgactgaatcttttatttcactggtcacagaatgatttttctaattctgtcatttttttctacatttattagctagcattttctgtaaagaactattttccctcatcaactggaggataaaccaatttcttctaaaaaggcaggataaatgcttaattcattccctttaattggcagttttcagattcagaagtgagtgttaataatgatcactagtggtggcaaatgtgggtctgcctcctcctaggggcttgtgagtattttttagtgttttacaattaattacagatatgtttttttccattgttatttttggtgctcacattatttcaagtttggccagtgtgcgtccccttcagactggttcctttgtcttttgacatgacatctttgaacacttccttgctttctggtacaatcaaccagcaataaaggggaaaaaagaatagaatagaaattatcagtgtatctggccgagtgtggtagctcatgcctgtaatcccagcactttgggaggctgagatgggtgcatcatgaggtcaggagtttgagaccagcttggccaacatggtgaaaccttgtctctactaaaaatacaaaacttagccaggcatggtggcacgtgccagctactcaggaggctgaggcaggagaattgcttgaacccaggaggcagaggttgcagtgagccgaagtcgcgccactgcactgcagcctgggcgacagagcaagactgtctcaaaaaaataaataaataaaataaaaaataaaaaaaagaaattatcagtgtatcatacttaagaaagataagtattgtttttcgcaacttgttttagttagaaacctgtattttctgggttgtagcgtaagctgtatcttctcctatccatcatggtcaaaaaagtttgaaagcactggtagaaagtttgtgatgtactcctgttctagcactggtttgaatttgtctgtctgcaatgttatttcatgggcaaggagtcaaggaggatattgagtcagggtgcccttctcaccattttcttgacattctgtgaaggactctgtgaggcaccttagcccccttgacttttgggaatgagtggattcttcatccctatcaactttgatttcagtaagacagttctatttagatggttgtttctggatgaatcagcttttgccaggcagagattaatttgagcctatttgagtcgttataatcctggaaaatattagagtaagtattcttccccaaggaaataagaattgtggaagtaattatgactgattagtcactttgcaccttatcccttttatgtgatgctatacagattgtttagacatatcatgttagacatggccacccttttgaatcatcttggtgagctgagggaatcatttgtcctcgaaagactccaaaagagcatcttctccaggaacttttctgttagtggaagttcaacaaatatttgttgattacttactatgtgccaggaatggaactaggttctagggacctagttttcaaggagactgacacagttcctgttctcatagtttatggtctagtgggctggtgatttgagaagctctggaatttgagcagacaactgggcactagtttgaagtctgccagtttccacacgtgacctcaggaaattgttgtatgctttggtttgctgaaagaggttctaggatggtcaaaagaatagcattggtgttgtccacattgtctgtcccacctccaccctgtgccctagccctgcctgcttggcagtgaccctggaaattctgtgcatggcagcttcattagctgcttttagggccttgaatgtcttatagttgattagtctattaaaaaaatttttttcacctataatatgttctatgatatgattagtctctttatattggcctttgattaatcagtctgtgcatcacagactgaccacatcacagacggaccacaactgaccacagttgaaccataggataagttatcaatggctgattgttttttctaataaaattcaactttgcatttgagtcctctttggcttgggcttctgacacaatttttaggacattgaagtctacaggtgcaaaacaaagattttttttttttttttttttttttttttttgagagggagtctcactctgtcgcccaggctggagtacagtggcgtgatctttgctcactgcaacctctgcctcccgggctcaagtaattatcctgcctcagcctcccaagtagctaggattacaggcacccaccaccacgccagactaatttttgtatttttagtagtgacagggtttcaccatgttggccaggctggtcttgaactcccaacctcaggtgatctgcccgccttggcctcccaaagtgctgggattacaggtgtgatccaccgcgccaggacttttttttttttttttttgagacagaatcttgctctgttgcccaggctggagtgcagtggtgcaatctcctgccctcaagtgatccaccggcctcagcctcccaaagtgctgggattacaggcatgagccactgcgcccagccaaaaacagattttagtagctgtttaccttatgttgctaaaagaatgaggaaagctgttttttccagccagggtctaatagtcccagttcacaaataacaaaagtgttttttagtagcagcctactacctttagcccaagggtctcatgtgaggaaagtagtaccaaaacccttgtaactttgaacaggatttagcttcataatcaataggacatttcatcatatatttgtcttttgaatcccagagaaagcacctagaagtagcctttgggagcattgagacctcagagagaccgtccccttgtgtaggaatagtattcctaggattttcaagggtagaaagaggtggtgaggcagtgaaacagttaaacagtggttaagaactttctaaaagagaaagttggagtgaatgttggagtacaaatgtagtccacagaaagacctgtgacctgtcatttgcttgaatggcttatcgtgttctgaatttaaagtgcaattctttctcctttgcctctttttttctgggatgaatctatatccaagttacattatttaatacctactatagctaaatactttttgtgaccagaatctgttgactctgataggatccttgttccctctggcctgggaaaaaaagttcttggttcagtccacctggacagaagcattgtagggaaaatagtcaaaggaaaatggacttcggttctcagactccaagtaggtttcattaatcctcccaagtgagccaagactgcatcttaatcagtttcatttcaggggttttaaataatgtttctgggctgggcgtggtggctcacgcctgtaatcccagcactttgggaggccgaggcaggtggatcacctgaggttaggagttctagaccagcctggccaacatggtgaaacctcgtctctattaaaaatatgaaaattagccgggcatgggtgtgagcgcctgtaatcccagctactggggaggctgaggcaggagaatcgcttgaacctgggaggcagagattgctgtgagctgagatcgcgccactgcactccagcctgggcaacagagggagactccatctccaaaaaaaggcctggcgcggtggctcatgcctgtaatcccagcactttgggaggccgaggcaggcggatcacgaggtcaggagatcgagaccatcctggctaacacggtgaaaccccgtctctactaaaaaaacaaaaaattagctgggcatggtggcgggcgcctatagtcacagctactcaggagtctgaggcaggagaatcgcttgaacctgggaggtggaggttgcagtgagctgagattgcaccactgcactccagcctgggcgacagagctagactctgcctcaaaaaaaaaaaaaaaaaaaatgtttctgttgccaaggttctataaggaagaaaatgagtagtgcttgcctttggtagaactgctttttatttagagaatgggagatggtgccagggtcctaagtaatcctgggtaggccgtaggctcaatagtcaacaaaatgggttgtgtgcatgtagtaaaggaaggtagagaatgggaaatatttgggttggtaatagtctaacaaaagctccaaagggaagcaaaaagttggctactagaggttgttttactgctatttagaatgtgaattcatccctatttcctttttacctaattggtatcaggacattgaatcaaatgaacagatggtgaattttcttgaatttttattttgaaataatttcaaatttaaaggtgcaagaataataggtctcccatatgtccttttgctacttacacacacacacacacacacacacacatgcacacacgtatgtatgtatgtatgtatatatagacataaaattattttttggctgggcacagtggttcacatatataattccagcactttggaaggccaagatgagaggatcacttgagctcaggaatttgagattatcctgggcaacataggtagactccatctctacaaaaaattaaaaagccaggtgtagtggcatgtgcctgctgttccagctacttgggaggctgaggtaagaggatcacttaaatctgggaggtgaaggctgaagtgagctgtgatcatgccactgcattccaccatgggtgacagagttagaccctgtctcaaaaaaagaaaagtacataaataaataaatttttctaaatcatttgagagtaggttatatacattgtgactttttttttttttttttcagacagtctcgctctgtcacccaggctggagtgcaatagcgtgatctcggctcgcctcccgggttcaaccgattctccctgcctcagcctcctgagtagctaggattacaggcgcccgccaccacgcccagctaatttttgtatttttagtagagacagggtttcgccatgatggccaggctggtctcgaactcatgaccacaggtgatccgcccacctcggcctcccaaagtgctaggattacaggcgtgagccaccgcacccagcctatcatgatcttttatcccttaatacttcagtgcatatttcctaagaacaaggatattctcttactaatttaagtatagttatcaaattcaagaaatttagcattgatacaataatttactattcatattccaattttgtcaataaacttttattatttgttttttttttccccttcagccaaggatcacaaattacattagttgtcatgtttctttagtctcctttaatctgggaccgttctttagcttctctttatgcttcatgacattagcattaaaaacatttttttaaaattttttcagccagtggtttatgcctgtaattctagcgttttgggaggccaaggcaggagggttgcttgaggccaggagtttgagaccagctttggcaacatagtgagaactcattgcttcaaaaaataaaaaaaattagctgggcatggtggcgtgtgcctgtagacccagctacacaggaggctgaggtgggaggactgcttgagcccaggatttggaggctgcggtgagctatgatcatgccactgcactccagcctgggtgattaagaaaacaaacaaaaaaacattaaacaaaaacacttttttttttttttagagttatggagttatctgtaactccataactgtttacagagtctggtggtgggatcgtagcttactgcagcctagaactcccagcctcaactggtcctcctgccttggtcttccaaagtgatggaattacaggcatgagccaccacagccagctgacattgacattttttataactacagaccagttcatgtctgtgttctttctttttaaaaaattgatccataataattatacttatgtattggttacatgtgatattttgatacatgagtacaatgtgtaatgattgtatttaggatatctatcacctcaaacatttgtcgtttctttgtgttgggagcatttcaaatcttctcttatagctatttggaaatatacagcaaattattgttaactatagtctccctaatttatttatttctttcaagaatatttctcattttgggtttgtctgatgttttcttatggttagattcaggtggtgtgtgtctatcgtgaatctgtaatatataccactactgatatagggtccttctcagggtatcacaactgcaggtgctgttcattggtgatactaattttgatcatctggtcaagtgttaatctgatttatttactgtgtagatgttatttccccttgcaactaataagcaatctgtagggaaacatttgaagatcatactcctctttaaactttccctctaatacctaacatacattgataattcttgcctgaaccaatttctggttgcagttatggtgaaatttgagtggttgcttaaaatacttgttcttaggtggacacaaactgtctttctagcttgcttctgtttgtttctcttcctataagaaacacaattgcataccctaaagatctatatttttttatgtctaaatctaataactaaaaagagtttgaaaattggaaaaaggtttggctcaatgaggcttgacttggaacttggtaatttcctagaatggccacatcacccagtggaatttgttctccactcaaccaacagcataagtgctttttctctaagccagactgacaacagccatgtgaagtggattctttttttaaaatttactccctcttttaataagtgggatttgctatgaattcatcattatatttcagcttttgttctcaaatctattttaatagcttgattcatcttattaagcacttccacttaagctttaacaaaatccataaagtttggaaatgcccattgtccaggagctttaagagagaaaaggttaggagaaacgttttcctattctccttttctatcatttttttctttccttccctcttatttttctgtattttttccttgtgcctttcctttcattcctttgaagcatgattaggatgcatgactgagcctccaaaagcagagagaaaaagaagtattgcttcttgagactcaggttttttattgttattactacggagaataggctaatgatatgataattatgaccattactaatgaatgccttatcagctatcagttgtttcttcgagggaaccttgccctcaaaaaaagtggcttacgcctgtaatgaccagcactttgggagggcgacgcaagaggattgcttgagctcaggagtttgaaaccagcctgagtaactagtgagacctcatctctactaaatttttttttgttttaattagccaggcatggtggcacacaccagtagtcccagctacttgagaggctaagacaggaggatctcttgaaccccagaaatcaaggctgcagtgagtaataatggcaccactgcactctagcctgggtgacagaggagtccctgtcttaaaaaaaaagagagagagagagagagagagaaataagtagagacaaaagaaaacaactagagagtcagaaagaggaaaggggcagaagcaaagaacttggggatggggaggcaagggtaggagagaaggacagagaatacagaactcctaaaataggaaaatgggagtcagctctaacatttacctttacccagtccagtgtgtgggttttcccctttcagtagaatgttctatgagataggatgagatggggtgaatgaaattgtcccatccttgactccttggatctgtttacatggaactgaaggttttaccctgtaatgtgacttgatagcctgatcctagtgggttgggtaggaagaggctattaagtgatgttttttggcttgctagcattaacagagttatttttaacctcccatttcaatctcttcgttgttcaggttcctctgctggctaccatgagagcagtcaaaattagcaactatataaaatgaagtacctcttgtctccccagtcacttccaaaataaacagggagtaatactgtccatattttgtctcactttactctgaaggctagcaatagaggaagcatggattagtgtgtagtgatttccaggctctgccctctggacagattcccctctgagtgctccagttgagtgacaggaccatgtggcaggagtgcagctggaagtatatcatcggcagatttgggttgggtaaatatagcaggagcaggatgtcagtgtgggagatggattgttctgggaaaggaagtgttgtctttcgtctgagaaacaatttcctgcacttctgggacttttgctttcttctttttcttttttttcccagggcagagcaggagttggcaggggatgggtacacttgctgaattctatctctggatgtctgcatgtttctacatttgaagttgggagtagagatcagatctgtttcagccagttaggaaatggacctaataaattatcgtacccatgccttaagtttcactttttgaagttttaaattaaagcacctatctgcttaaagcctctttttaaaaagttactgttcttttagtgaaatagacgggttgagaggcaaaaataattacgtaaagaaaatcaactctattgcaagtcagacatgaggcaccagctggcaggaaacagctgggatatttctgggggctagactcttccacaccagcacttaactcttcaagtgatctctgttatctgagctacttaagatagctacctaccttaccaacaatctgcataaaatactaaatctactaaattatgtgatattttacaattgactagaactttataatttataaagtggtttttcattatagcctttcaattttagaatctataaagcacataaattataatctataaattatatttttataaattatctataaattatatttatataaattgttatattataacttagactcatacataatctataatagattatttctataaacatatttatagaagagttgtaaagaagttctcatctatccaatgcccagtttcccctgttattaacatcttacattaatatgacacatttgtcacaattaatgaacaaatattgattcatcattaattaaagtccatactttattcagatttcattaggtttttacttaatggcctttttctgttcaaggattccatctaggataccacattacatttagtcatcacatcttgttaggttccacttggctgtaacagtttgcctgtattctttttcttttcttttttctttcttttcttttttttttttttgagacagagtctcgctctgtcgcccaggctggagtgcagtggcgcgatcttggctcactgcaagctccgcctcccaggttcctgccattctcctgcctcagcctcctgagtagctgggactacaggcgcccaccaccacacccggctaattttttttttttttgtattttttagtagagatggggtttcaccgtgttagccaggatggtctcaatctcctgatcttgtgatccacccgcctcggcctctcaaagtgctgggattacaggtgtgagccaccgcgcccggccgcctgtattcttttcaagtttcacaaaaactcacaagatagactgtgcctttattaatattccccttttacagataaaactcaggttccagaaaaattaagtaacattttcaaggttatacagtaaaagcttcttttaaagtgtgattatgatttggaaaaaggcgatgaggttatttatttgcttttcacgtgaataagggcagacttacagctaaccttcaggtgggccatttactgaagaggaacaagagacagaggtgagtctagcttgttcctggactcttctgtcttgctggagacaaattaacattattattttaatcacaattattttgggaaaacccctttctctttgattctgctatgtctaccaaaggaactgatggcagaaaatcctgagttagccttgttccctggcaacagacttcaggctgcttactggtccctgttgttggataccaggttcagtaggaaagtctgctgagagtatagcatgaacactaacccaactagcctatttccagcacgtgtggtgttaactatctgggaataggaacatgagtttttaaattccagtctctaattgggtaggctgaagttctggcttggagtaaggagattcacagaactgcagtgctaagagatagtagaaaaatttaaaaattcaataagacatggcacttaactgactctgaatgctctgtccggagggatgagtaaaggggagaggtgagaggaggtaaagtagcgggttactaatgatcctagatactattaaaagattatcacaaggaggtggaaactattgaggtacaaaccatcagatcttaaggtaaggagtcactcatcttgcccagagaagtagtagtgaagatagtacctggatcctaaaaggtaacttttaaagtacttcaacctaagatgacagagggtaggcagtttattgatacccttaacaaccacttgttagtagagccattttaattaatgggaaaggggatcattctccgtttatgcttttattatatgtagctatgagcatagaagctgtgtttggaccctctggtgactattgccctcttctagttgtgtccaggcacaggtaaattcttgaggccaggaagggcctggctttatctccaaaaggaagctgtggaaatagcaatgagcaaaacaatgagaaagagctttagaaaatttgcaaatattgtgtatcttcatggcatgatgaagtgggattaggacaggggagaaagtataaaccaccaattataggagtctttaagggcttgggtgactgaggccttctgctaggaggctgggaggttgttgatgacagcaaagatgtaacaggtattgaatactagaggatagacctcatactctgaaaatgcttttgcctcaacaatttgaaagagaaatatgaaagacaaagtgacaatatgaagaatgactattcaaagtgcttctaccagtaagtcttgtctgttggcaagttttaacctgtaggtaggggaaaaacgtgggaggatctcttattcagaatgcaaaacaggagacagtgaagtacctgtgtttccaaagaactccgaattgagctgtggtggaagaggaggaaatttcttactgtggtcttgtataatgtgaaatctttgtgaagtctcaatagatgttaagtctccaaggaggggagactttttagctgctaaagaagcttaggttcagtgagcctccagtgggaatacagacatagacgtccactgacatttctgcaaccagttttggtgagtggaaagcaactaggtaagtttcactttttgcaagaatcccaagtgaccctttgcactatggactgaggtacctgcttgtctctacaaaaactatagaggagacacgacaggctttaactggaaattgttcatggtttcttagaagggaagctcatatcctgttaaagcactttagaaaaataaagtcaaattagagataagaggatctttacttgtattttcaagagcttttttaaaaaactgaagtgaaatgcatataacataaaattaaccattttaaagtgaaacaatatagtggcatttagtacattcacaatgtaccctatctaattccaaaacattttcatcgccccaaaaggaaatcctgtacccattaagcagttgctccacactttcccttcccctccagcccctggtagccatccatctgcattctgtctctgtaaatttacctattctggatatttcatataaatggaatcatataatatgtgtccttttatgtctggcttctttctcttagcataatgtttttgagggtcatccatgctgtaacatgaatcagcacttcaattctttttaggattgaataatattccattgtgtgtgtataccacaatttgttcatccattcattcgttgatggacatttggaccatttcttccttttggcaattatgaatagtgctgctagggacatgtgtatacatgtatttgagtatctgttttcaattcctttggatatatacctaggactggaattgctgggttgtatggtaattctatgtttaactttttgagtaactgccaaacagttttctatagcagctgaaccatactacattcccaccaagaatgcatgagggttccagtttttccgcatccttaccaacacttgttatttgtgtttgttttgttttatatagcttcaaaagcttttgagactggataggactttgatgataaagctcctttcaggtcttatggatcttctgacatgcttctctcctgaaataactggatggctcttctgggccaaataaggtattgagattttagcttttatactaaaggattactttcttccaaaatttccaataaacagcgaacacagattttacagattttacaggttgcctagacagggtcgaattctgacttgccaaaagaagagtgtcagttacactttgggtcttgaaagtagatgatggtatttctggtttcatttgccatcagaatcctggaccaggcaataggctaggtcttgctgactatacaggtagctcagtttgcttacacattaccagcttatcttcctgctcacagaataaccttctggggagggagttaactctaattcctgataaatgactggctctttttaaggtgctatataaactgaatttggatgttacttcgccactacttacaatgatactatgtacagatattaaaactctaatgttcccatctccttactgtgtggctgggtggtttcttattttgatgtcttctacatcaaactgttgagttcctaagtgttctcttcttacccctctcttttttagtctctcagtttctacttcttgcatctatatattttgtgatttgtctaatagtcactgtgattaatgttttagtttgtttttcttttgtgaaaattattttcttcttgtgaaaggtgaaaattagtttcttcttgtgaaaggagaaaactggtacagaaatctaggacgctggaacttctagctctctccgttttttctagaattgtagctttccttctttttttttctttgactgttttctccagtttatatgttgagtggtaggtttttctaacttttagaaaaaaattattttgctatttaatgtgtttgctgtatctccttgaaatattataaatcagaatacattttagtgtttattgctgccattggttgctttaaaaaaaaaggttgaacctgttttcaaagtaaacaaaattgtagcctctacttaccttcctcctttccccaccacaatacacagtgttgttgggtttgcaaattcatcctaaccatttgatcaaagtcaggctttgaacaaggctttatagtgaggtgtggtgaatgacaggtatgtctggatttggccttgagagatttggggatgtaaaagcataagggtttttttttttttttttttttttctgtctttctttctcttctcctaatgtactgtggtctataataggttgagttgtaacattcattaaaccactcctcgcattccctgttttcaaagcttatcaggatgactttgatttagttatttggaaccaaaaaggcagtttgtggagcctggtctggagctgtgtagcagtaatatatcagagatcagacttaggtcccagtgggattattcctcgggatttatttgcctggaagtacacacaggagccaaatggtatgtatggaaagctttgctggaatgcaaattggacacattttgttgggacctgtaggggattttcactgcttcataatttttcaaaggtttgttatacatcagacagtcactgcctcttctttaaatctttaaatcccccctctttttcctgttgtaaaggtcagattttttttgacaactgtgtgcaggaacaagatttgctaaatcccttcatttttattcatacaaatatcggaattcagtgagcatcagttattccagcatttagaggtaaggaaaactcagggagaatcttgtgaatctcagctttgtgctagacatatatctctggggataaatttgctgcctcaactttaaccccttgactgctctgatgtgagacgacacccttacagtggctgccttgtatgtgaaacctacccttaactaacccccatttatggctgtaggatatgtaatataattactgggaggggactgtgttggactcttctgatggggcctttttggctgtgacaagccttagattagtgttggaagagaaggacaattcattccctccagtggagccccttctttaggcatatttagcttttaatggtatcataggcaataaccacttttaatttgcagatgattctttctcaaccagtagatgaaataatgatatcaaatggtacatttccccatcaaacttgcttagtttgatgttatgttattatgttatcgattgctgggtaacaaattaccccaacaaattacctctcctacccatctattgctgggtagcaaattaccccccaaaatgtggcagcttaaaattaaaaaacaaaaaaaatttcacacagtttcttttattttattttctttttttttttttttttttttttttttgagatgaggtctcactgtgtttcccaggctagtctcaaactcctgggctcaagtgatcctcccaccttggcctcccaaagtgctgggattacaggcatgagccactgcacctggtctatttcacacaatttctaagggtcaggaatctgggagctgcttagctagtggttctggcttagggtctctcaagatgtcagccagggcagcagtcatttgaaggggtgggctggaagatccatttccaagttcattcatgtggttgttggccagaggcctcagttcctcacaatgtgggcctctcaataggactgctcacagcatggaaactagattctccataggtgaatgatctgagagagagcagaagccacactttgttttctgacccaacctcagaagtaaacctcaggagtaaccatcactcctgctatattatattagtcacatagaccaacctaaatacataaagatgtaatcactggggacatcactgggagtcatcttggaggctggccttgcaggaagttaaatggaaatttttagatgttcactgggacttcaagattgatttttttaatttgaaaaattttgttctccccagtcagccctgtctccctgtcttctcccaaacctttatgtctctgaaattgtccaatatgtatatggcaaatatctctttctcttcctttgctgtctcagccataagcgctagtaaaaactttccgtttttctaaagcaagccagtaagcatgatcgatctacctcctctacccgttttgctgggacatccatggcagctggtcaaaggaggcttctgctcatgagagcacttcaactggattcagataatcctttgtggtttctccacctatttactactgatcctctaaaatttggtgcaaatgaactagactgactagagttacagtgttaccatgtttttttcagactgagatatataatgatataatgatatgagctctttttggattctatccaggatctccaaaatggagataaagacctaatgctcgggagtgatttaaaaacgaaattacggccgggcgcggtggctcacgcctgtaatcccagcactttgggaggccgaggcgggcggatcatgaggtcaggagatcgagaccatcctggctaacaaggtgaaaccccgtctctactaaaaatacaaaaaattagccgggcgcggtggcgggcgcctgtagtcccagctactcgagaggctgaggcaggagaatggcgtgaacccgggaagcggagcttgcagtgagccgagattgcgccactgcagtccgcagtccggcctgggcgacagagcgagactccgtctcaaaggaaaaaaaaaaaaacaaaaaaaaaaaacgaaattacttgtcactagatagattcatctggtcctttgtataccagtcagataagagccttaggagttggccgcatgtggtggctcacgcctgtaattgcagcattttggaacgctgaggcgggcggattacttgtggccaggagtttgagaccagcctggctaacacagtgaaaccccatctcaactgaaaatacaaaaaaattatctgggtgtggtggcacacgtttgtaatcccagctacttggaaggctgaggcatgagaatcacttgaacccaggaagcagaggttacagtgagccaagatcatgccactgcactccagtctgggtgacagagcaaagactctgtctcagaaaaaaaaaaaaaaaagccttaggagttatttactattcttcacctttctaggacaagcaagtcgatagccacagtgatgaggactgcacaggcagaccctaaagctaaccagggacactgtcttgcctctgtgtttggtaatcattccagctatgcagtttcattgatgtctttccctccttggtacataccttactctatacctgataatagaaatccttgtgagaatatacttattcagctcttggtgacaggaggtgggtggaagtgtggggcagagaacaggggtgaggttgttacaatggagaatcagtttactttttcaaaaattctggaagccagacatggtggcatgcgcctgtaatcccagctacttgggaggctaaggcaagaggatcatttgagcccaggtgtttgagactagcctgagcaacatagtgagaccctatctcaaaacaaacaaaaattccagagcatctttggcttcctaggaaatagcctaaggctgtaaataaaccctggcctcatattcctgttgtcatttactggcgtagtagacaattcataactgggaaaatcctttgggtgtttttttgatgtaggttttatagaatcagagaggttccaaaattgtgtttaactgattctatagaagactataaaagtaacaaagcaggcaaacaagaacaaaaacctttgtgccataaaatcactatttaggccaggtgtggtggctcatgcctgtaattccagcactttgagagaggcctaggcgggaggattgcttgagcacaggagctcaagaccagcctgggcaacatagtgggaccccgtctgtacaaaaaaaaattttaattagctgggcgtggtggcaagtgcctgtagtcccagctactcaggaggctgtgacaggaggattgcttgagcccaggaggtcaagacttcaagtgagccataatcatgccactttccagcctgggcaacagagtaagaccctttctcaacaaaaacacaaaaatcactgtttaccttctctaacccttatcattatgtaaacataatttaatagtttaatcagtatgccttattattattttttcctcttattcatttagtatcattttttaaagtatatttttataggcactatagaaccttgctgaaattggctgaggatactcttcagtggggccagaagttcttagcattatttcatacagaattttccatgcatttacctaatatatttatcatctttaatgacattataaaaatacattgaaccagaatgccatagattaactatcctttttaaattttgattcattatatgtagtagaaccttatctctgtgttgataacagtttttctttttcttttttatatttttaatttttaatttaatttaaattttcagacagggtctctgtcgcccaggctggagtgcaatagtgtgatcacagctcactgcagccttgactgcctgggcttaggtgatcctccatctcagcctccctgagtagctgggactacaggtgtgtgcctccactcctggctaatttctatatattaatattttgtagagatgggtttttgccatgtttcccaggctagtctcaaactcctgggctaaagcaatccacctgcctgagcctcccaaagtgttgggattacaggcgtgagccaccacacccagcctgcttttcttttaaattattttctcgaagtaatagtcccataagtagagtgggttttgtagctatgctgcatcctatattgagttttctaacttctctttaattttgctaatttaattgacaaagtgatgcttttataatttgtttcacatttctttaattactagcattttctcaagtgttttactgtttggggtttttcctattgaattatctgttcttatctcttggccacttattggacagaagttggataggaacctttcggatttgtattacatgtatcaggttctttcatagctggatagtgtgttttttattgccaagtctctttttttttctttctattactatgagctattcactgctttgtttgtttgtttgtttgtttgtttgttttaaataatacccagactggtctgagactatgggctatttcaaacctaaataggtagtggtatttttttatccttacagagaagtgcatcaactagtttatttgcatttgaagtgtagaaacgagaggtcctggctgaacttttggcatgggagcagtgtgtgtggagagcaggctgtccatgataggaggggagttgaggacaaggctgacaccaggcctataaataccctaaggtttagctttgtactttgaaataggaattaggtcacttttattgtcttccccagactttttactggttggctgtggagaaaaggcatcaggacttttagaggaaatgttactgtttccagctctcagaaaggtggaaagtgctgatattggtcagctcttactcttgttttctcatttctgttagactgaggtgaccaaatggaaagcgtgggagtggagacttgatatttggcttcctaagtaagaagtggaattctgaacagcgaaaggccttgcctgtatccctttgccgtggcaccatgccttggacagatggatggggagctagttacccagcatctgtcattctccttaccattgacaaaggttctcttttacctttatcataggctgctgtgtccagtcattctaactgggctttctgcagagggacccaaacccctagaacttttctttttttttttttttttgagagggagtctcgctgtgtcgcccaggctggagtgcagtggcacaatctcagctcactgcaagctccacctctcgggttcatgccattctcctgccccagcctcctgagtagctgggactacaggcgcccaccaccacgcccagctaattttttgtatttttagtagagacggggtttcactgtgttagccaggatggtctcgatctcttgacctcgtgatctgcccgcctcggcctcccaaagtgctgggattacaggcatgagccaccatgcccggcccctagaactttttctaaggtcctagtttctagtattctctttggcctttccattttcttctctaaaataagaaaattctggaatctctgggacaaacaaacagaaaagaaaaaaaaatttaatgataaaaaaaataagaaaattggaccaaacgatctctcaagtatgatgtatgtatgtacttgttaattaaagacagggccttgctgtgacgcccaggctggagtgagttgcacaatcgtgcaatacttcactacagccttgaactcctgggttcaagcaattctgcttcagcctctccaatagctggggctacaggtgtgtgccaccattctcggctactttattttttcatatttttagagatggggttctcgccagttctgcccaggctggccttgaactcctgcctcaagttttcttctcaccttggtctcctaaagtgctgggattgcaggcatgagccactatgcctggctcaaatgatctctaaagtccctaaagtcctaagattttttggagtttgatgtcttcccacacaagtttggaaatactttcagagggattctattccatatgaatgtcattacaattttaatgaaaattttgatgtagcaatattgtagaatatattttaaagaggtaaatatacacagtcttctgtgcattttgagatagtctgactttataattttcctttgtctttctgttgtccagttgtcagttttcagataaattctgcttcaaacttgttatgtaagtttctattgggcatttagtttcaaattactgtttccaaaatcttcgtatttctttaaattttcaatcattcttaaaaatagattaatattgcatgaatgtcaagagaacctcttctattttcattttaaaattttaatcattaaaatatactgcagtgtctctatattaatttatctgaagatgcatcagtgtacagtcaggtgctgcataacaacatttcggttaacaatggaccccatacatgatagtgggcccataagattataatggaggtaaaaaaattcctatcacttagtgatgttgtagccatcataatgtcatagtataacgtatcactcgtgtttgtggtgatgctgttgtaaacaaacctgtgctgccagtcatataaaagcatagcacataaattatgtacagtatataatacttgataataaatgaccattactagtttatctatttcatatattatatatcattgttttagaatgtactctttctactaatcaagaaaaagagttaactataaaatagctttagacaggtctttcaggaggtattccagaaagcattattatcataggagatgacagcttcatgggtgttattgccctgaagaccttccagtgggacaagctgtggaggtggaaaccagtgatattgatgatcctgacactctgtaggcctaggccaatgtgagtgtttgtggcttagtttttaacaaaaaagtttaaaaagtacaaaataaaaaatttaaaaatagaagaaaccttatataataaagatataagaaaatattttgtacagctgtagtatgttttgtgttttttttttttttttttttttttgagatggagtctcactctgtcgcccaggctagagtgcagtggcgtgatctctgctcactgcaagctcaacctcccgggttcacaccattctcctgcctcagcttcccgagtagctgggactacaggcacccaccaccacgcccagctaattatttgtattttttaatagagacggggtttcaccgtgttagccaggatggtctcgatctcctgacctcatgatccacccgcctcggcctcccaaagtgctggaattacaggcatgagccaccatgcccgggctgtagtatgtatgttttaagctaagtattattataaaagtccaaaagcttaaaaaaatttaaaagttataaggtaaattatggtaagctaaggttaattaatgaagaaagaaaaatctttttaaaaataaatttaatgtagcctaagcatagtgtttataaagtttgcagcagcatacagcaatgtcctaggccttcacattcactcactattcactcactgacttatccagagcaacttccagtcctgcagggtccattcattctaagtacccagcacagggttgccattttcttttttttctttttctttttttttttttgagacagagtcttgctctgtcgcccaggctggagtgcagtggcgcaatcttggctcactgcaaccttcgcctcctgggttcaagccattctcctgcctcagcctcctgagtagatgggactacaggcgcctgtcaccacgcccggctaattttttgtatttttagtagagatggggtttcaccgtgttagccaggatggtctcgatttcctgaccatctgcccacctcggcctcccaaagtgctgggattacaggcgtgagtcaccatgcccggcccattttgtatcttttatgcagtatttttactgtactttttctgtgtttagatatacaaatccttaccattgtgttaaaattgcttacagtgtatagtattcaatacagtaacaggctgtacaggtttgtagcctagaagcaataggctgtaccatatagcctagatatgtagtaggctataccacgtaggtttgtgtaagcatactctatgatttttgcacaacaatgaaatcacctaacaatgcatttcttagaatgtatctctgtccttaagcaatgaatgcatatcagttaagcctgtgaggtaggcctgaggatgtggaatagcagacaccaatatatcctaatcccaagaggcaacttctttcatctcttttagtagattcttttggaatttactcccatatttctaattaacaagtgtgtattgctgcttcttagtttttcagattaaaggatagagctccactcatttgttttgtttctctgtcaatatttacaagagtcaagttatcttagaactggaagagacttcagatcctccagagaactaaactcaaaaactgtcaagggcttggcagataacttaaatgaaaagaatagggagtagtatggactgtggcagactagaattctgtgccatctaaggacattcaattcagttttaactctgcacatatcaaacagttgcaatatatggaccttgtttggatagtgatttatacaacaaactatctttaaaagtttatggcagttatagaaattgaataattgcaaattgagcactaactaaaatttttatattaaagcaatattactcttttagatgtgatgataatgatattaaggttaaagatgtatgaaatgatatgataggcaagatttgcttcaaaacaatatgggaatagaagggaatagaagggaaaaaacaagataagccctaagttgctaattattgaggctgggtttgggatatttgggcgtttgttagtctgtttacataatttacatttatataattttgaaaattttcataagctttttttaaaagacttatgtgggtaaaaccttgtctccttcgaagaggaatattagaatgaggagaaaaggaatccagattaagcgagaatagaggcagttctgttagctatactgattaagggttgtcaccagaaccttactagtatattccattgaataaatatgtatttgttattatacatatttatttgtttggcatattctgttaagtttatttgtatactcaaataaatacttatatcttaagtagcggacaataacattcattccaaaatgtggtttcacttattctcaataaactcatttattgctattaaaaaaataaaacacaatataatactaagcaaaacacatctatggaccagcccaaatttgtaagctggctttcagtttgtgatttctgagtctattctcaccagcttgtttcacagaagaaactaaaacttaaaccaaggtcacatagcttatcagggggaaagctagaactcaggtctcctgattccccattcattgctgctgcttatgaaaaaaactgcccaactgacttaaataagaaagaagggttatggttttgcctggcaattgtctcctgtttcctaaccttgactattttttttagaatataggtttgagatttgtcttctctctttttgtaagatgatagggataagagattcagccttaaacttctggtagaaatccaggtctaaggatagttatatttctttgaatgataaagaattgtaggccagacgcggtggctcacgcctgtaatctcagcactttgggaggccaaggcgggtagatcatgaggtcaggagttcaagaccagcctggccaagatggtgaaaccccatctctactaaaaagacaaaattagccgggcttagtggcggatgcctgtaatcccagctactcaggagactgaggcagataattgcttgaacccgggaggtggaggttgcagtgagctgagatcgtgccactgcactccagcctaggcgacagagtgagactctgtctcaaaaaaaaaaaaaagaattgtaggccaggcacagtggctcacacctgtaattccagcactttgggcagccaaggtgggcggatcacttgaggctagaagttcaagatcaagctggccaatttagtgaaatcccgtctctactaaaaatacaaaaattagctggacctggtggcgcgtgcctataattccagctacttgggaggctgaggcacaaggatcgtttgaacccgggaggcagaggttgcagtgagcctacgtcgcactactgtactccagcctgagcaacagagcgagactgtctcaaaaaaaaaaaaaggaaaaaaaaggtaattgtagcatttaagcaagttataagcataagacttaagatgaggcaggactggaaaaatgaaccccttggttctatttggtccccaagtgacatttcactgccactaaaaattgctgctgtgtgtgggctttaacatttatttttaaaatttaattcttttctctaagtccagagcactaagcaagcagcatagatgtacagacttgccagctattggggatgtgttgctaagtagctgtgacagccttcgttagatgctttgctgtacagttatcactagactttgctcccaggtctaattgggaaataaggattcaggcagttttgttttatgtatgttttgttagcatgcttaatttaaaagcctaataaacctgagctgacttttgaaaaaccatttctgtactagcaaagattcacatagcaaacatcagttgaggagagattactagaaagcaccagaagaaattagaatgactcttgtagatagatttgaatagtctttctactattccagcttattctcttcttttttaccttcttatactactcctgtttgtttatatatttttccactcagaccaaatggaagcagaagggaaagaaatgatcttattgaattcctttggacatagaatttgagtccttctggaccttttcataacccctttgaagtatactctgttttcctaaagaacttgaaaattttataaaccaatcactcatcaagtagtataaaactcaggccttttatagaatttttttcctttcataggtaaaaagttgttagaacaaataccactttgaaattgatgcaggtacctggaatgaaagagttgaaactagtagttttgtttttggtttttggttttggtttttttgagacagagtctagctctgttacccaggctggagtgcagtggtgcaatctcagctcactgcaacctccgcctcctggtttcaagtgattctcctgcctcagcctcccgagtagctgggattacaggcgcccaccaccacgcccagctaatttttgtatttttagtagagacggggtttcactgtgttagccaggccagtcttgaactcctgacctcgtgatccccccgcctcagcctcccaaagtgctgagattacaagcatgagccaccatgcccggccgaaactaatagttttaaaaatgtattctagatgtcgactagtaaaggctttgctgttatctatacctaggtaatgttctagactagatgacaagtcgagtccacacctgagtgttgattttgactttaaaaaattaaatagaaagttaaagctattggctaaaattgtgagtttatctctatatttgtagatccagtcacacagtttagcatcatattatatcatgacattagttctacttttagaaaagtgtatcttttagctagaatatgtgctctttgtagtcagggaccatgccttctaaatctttcagagattaataaatactcgtatatttcgtaagcattttggcctctctttttgtctctactcaatataggtggtaataatactctgtatcaggaactttgtatgtatcatctcattgagttcccccaaggatatttcaaggtaatattatccccattgtatagaagaggaaacagaggttccaaaaagtgaagaacttgtgtaaggtcacatacttagtaagtcacagaagtgggactgtaaacctaggcctgtttcactgattatacctcctactcttacctctacatcaagatcccttgagagctttggaattgtcactagaagtcttgactattctcatcctcatttttggtaaatatgaaactcatttgttctgttgttctagaaaagctcttaatgtttaaatcaggatcatggactactatccccctcttctaagagcttagattaataggggcagtataacatagtggttaagagtgtatataggttctaaagccatgcagactggctttgaatactggcctcaccttgatgaccttgggcaggttgcataaccttgctgtactttaagtgccttatgaggcacttaccataaaatgaggatggtatggaatactactcagcaataagaaagaactattgatacatgcaataacctaggtggatctcaaagtcattctgctgagtgaatgattccagttacatagcattctggaaaaggcaaaactgtggtgaccaggaacaagcatgattgccaggggttggtggtggggaaagcgtgtgactaccatggggtagtatgaggtgatttttgaggagatgaaactgttctgtatcctcattgtggtagtggttacatgagttagtacatgtgttaaaactcatagataatacgcttccccaaggaatccatttactatacattaatttgttaaaaaaataaatgtaaaaagggccaggcgcagtggctcatgcctgtaatcccagcactttgggacgcagaggcgggtggattacctgagttcaggagttcgagaccagcctgaccaacatggagaaaccccgtctctactaaaaatacaaaattagcagggcatggtggcacatgcctgtaatcccagctacttgggaggctgaggcaggagaatcgcttgaacccgggaggtggaggggttgtggtgagccaagatcacgctgttgcactccagcctgggcaacaaaagcgaaactccgtcccaaaaaaattaaaaaataaatgtaaaaaatggggcagtaacaaaacctacacatacctgtgtactacctactatacagtacataactatatactaaattatttttattattgttattttatcattgttattaaaagtatgatattaaatatggtgacattcatttaaagtaggatagaataaactttcacaccatctgcatgggtatggtcagtaaatgtgagaaaaatgagtaactgttgagtcaggtggagtatgttttcacatgatttggcaggggatctgaggttttctggacagtggaggattaggcctagtatttctggagtatcttgcaactgacttcttgtctggctgcatatacagttcccttgatagtattcttcaacaaaatagctttggtcttagaagccacagctcttttcactggcttcagattagatctgaaatttggactgagcaaactggtcaaagaaggagctggaagtggttcttatacttggaagatggtagctgttctgtataacagctgtagcttccagaggcatttcttcctgccagccatagtctctggattagacagtgatagcagtagggcaagcattattcaacagctaaaaaaaaagttaaggtcgcagtggcattgtagttacactagcagtgaaaaagaggttctaaagtgaaaccatgacctttccatcaagtggggtggtgcttttgtagaggaactcacaacctgaatcaaaacaagttaaataaatggtaaaaaggattctgaccttagaatgcttgctatgttagttggcacttactggtctgtatattcatttttacctaatgacgccagaattcaggaagcaggggggaaaggggaatgtttgtggttcctggtacagggcattggtttagcagtgacttaacttttcctaatttctttacaacagtgacactaaatttcaagcaaagctccgtcgtcattcagtttgcttcttttatagcttgttgtacatatgtgactaagttattgattgctgttgaggaacatcactcttttgtggctttgaggagacaatgccaaattgactagcctattgttttattttggttttgtgttttagttctcgttaattatgctaagagtagtttgttaggacagtggtttaaaatatataagagaatcagtattttcttttcttttttttttttttttaagtatttattgatcattcttgggtgtttctcgcagagggggatttggcagggtcacaggacaatagtggagggaaggtcagcaaataaacaagtgaacagaggtctctggttttcctaggcagaggaccctgtggccttccgcagtgtttgtgtccctgggtacttgagattagggagtggtgatgactcttaatgagcatgctgccttcaagcatctgtttaacaaagcacatcttgcaccacccttaatccatttaaccctgagtggacacagcacatgtttcagagagcacggggttgggggtaaggttatagattaacagcatcccaaggcagaagaatttttcttagtacagaacaaagtggagtctcctgtgtctacttctttctacacagacacagcaacaatctgatttctctatcttttccccacatttcccccttttctattcgacaaaaccgccatcgtcatcatgacccgttctcagtgagctgttgggtacacctcccagacggggcggctgccgggcggaggggctcctcacttctcagactgggcagctgccgggcggaggggctcctcacttctcagacggggcggccgggcagagacgctcctcacctcccagacggggtcgcggccgggcagaggcgctcctcacatcccagatggggcggcggggcagaggcgctccccacatctcagacgatgggcggctgggcagagacgctcctcacttcctagacgggatggcggccgggaagaggcgctcctcacttcccagactgggcagctgggcagaggggctcctcacatcccagacgatgggcggccaggcagagacgctcctcacttcccagaaggggtggcggccgggcagaggctgcaatctcggcactttgggaggccaaggcaggcggctgggaggtggaggttgtagcgagccgagatcacgccactgcactccagcctgggcaacattgagcattgagtgaacgagactccctctgcaatcccggcacctcgggaggccgaggctggcagatcactcgcggttaggagctggagaccagcccggccaacacagcgaaaccccgtctccaccaaaaaaatagaaaaaccagtcaggcgtggcggcgcgcgcctgcaatcccaggcacttggcaggctgaggcaggagaatcaggcagggaggttgcagtgagccgagatggcgggagtacagtccagcttcggcttggcatcagagggagactgtggaaagggagagggaaaggggagaggggagaggttagtattttcaaaaatcatcatatagtacgtggttacacaactctgaatatactaaaacacattgaattgtatactttaaaggagtgaactatatctcaatatataaggggtgagttatagctcaataaagctgttaacaacaaaacaaaaatgccataccaaaaaaaaaatcatcatactgatctgtgaccttccaatggaaggaattaaactaaacttttcaaaatggggctactggcccttaggcaaggtcctgagattatcctaaaattatggatttagagtatttaatgacttttctgaagaattcttagaattcatctactaagcaaataaccattcatgtagttatgatgtagtcattgtcaatttttacaagggaggaggataaggatcatcactaagactaaaacaatgattctgaactgggtgattttgccccccagagaaagtctggcaatatctggagacatttttgattgtcatatctcaggcatgctactggtatctagtggatcaaagccaggagggatgctggtaaacatcctacaatgcataggacagcccccatgatgaagaattacgtggcccaaactgtcgttagtgccaaggttgagaaactctggtacaaaatgtacatctatgttttctttcaagagttttagcttttacatttagatctttgatccattttaagcttttttttttttttttttggagacagagtctcactctgttgcccaggctggagtgcagtggtacgatgtcaactcactgcaacctccgcctcctgggttcaagtgattctcctgcctccacctcccaagtagctgggattacaggtgcatgccaccacacccagctaatttttgtattttaggtagagatggggtttcaccatgttggccaggctggtctcaaactcctgacctcaagtgatccacccacctcggcctcccaaagtgctgggattacaggcgtgagccaccatgaccagctttaatttttgtatatgatatgaggtaggggtccagttcattgttttacatgtgggtatcgagttgtcccagcaacatttgttgaaaaggctattccccattgcatggtcttggcatccttgtcaaaatcaattgaccataaatggccctggtgtaaaatggctaatgtctgtacctatttctcctagaaaaagccttacacagcctccctgaggtcttagaaaatcttgatgactttctactgctatggctgcctaaagaataattcaggttgtttccatatgaatactgctacacctgagtgagaacaggttaaggattacagtgtctgtaagcctcctgtcatatattcaggcagctcacaccacgcagcttcagttctccaggctaaggcatggcattaaaattgtgaaggacttcaaaaatttaatccgactttctaccaagtactctaaattatctcaaatattattgttgttttatgataaatctcaatatacaaagcaggtaccctctcagtacttactttttcaaaaatttccttagctattcttatctgaatgttttaaatacattattttgtttaattatcaagccgaggaggtagggttgtgctattttctttgtcattttacagatgcagaaactgaggcttagagaagtttatttgctatggtcataccaggactgggattttaatctagttttttttttactccaaaggcattgcctttagagagcacataatgaattatatgtgaagtctccatcttcacatataattaagttcttctaataggaataaaataactgcaaaaatatatccaaacagaaaaatggtacataaggtttaagcttaagccaatatatacttaaggggaaaatctaaactatatttaagattcattggccttttataatctatattctgacttagaaaggggatatggaccgttctttgaatacttacttgttttatagctaaagaggtcctcacagtcatgggccacatcgtatgtaattttgaaaacattacaacatgcaaagacttcgaatgccgtatgtggttctggttgcagcatctaagaaagatatatatattttttaaatctgagaaaattttggagtggtaaaataaaatactttccagtcttagaatattaggatttaggaacataatcttcaaggtgaaattaggtaaaaggggccgggcatggtggctcatgcctgtaattctagcactttgggaagccagggtaggtggatcactgagatcaggagttaaagaccagcctggccaacacagtgaaaccccatctctactaaaaatacaaaaaaattagccaggtgcggtggcacacgccagtaatcttgctactagggaggctgaggcaggagaattgcttgaacctgggaggtggaggttgcagtgagctgagattgtgctactccactccagcctgggcaacagagtgagacttcatctcaaaaaaaaaagaaagaaagaaagaaagaaattaggtaaaaggaaaagttcttccttatgtagtagtaagtaaatttttaaaattttatacaagccgggtgtggtggtgcaagcctgtagtcccagctactcagaagcctgagacaggaggatcgtttgagctcaggagttcaagaccagcctgggcaacatagcaagacgcacatctcttaaaaaaaaagaaagaaagaaagaaagaaagaaagaaaaagaataaaaaattagctgggtgtggtggttcataccaaaataaaaattttatgtaaaacattggttccagaaggattgagatcaggcattctgatctgggatccagcaatgggcttcaggagattaatgaaccttctgaaattatatgcagatttgtgtgtgtgtgtgtgtgtgtgtgtgtgtgtgtgtgtgtgtgtgtacttgatcacctcagtgaaataatattaagaggtgaaataatattaagaggtaccactgtacttctaattctggacaaatctttctcctagctatagaaattggagtcctggccaggtgcagtggctcatccctgtgatcccagcactttgggaggccaagacaggcagatcacttgaggtcagcagttcaagactagcctggccaacctagtgaaaccccatagtgaaaaatacaaaaattagctgggtatgatggcacgtgcctgtagtcccagctacttgggaggctgaggcaggagaatcacttgaacccaggaggcacaggttgaagtgagccaagatcatgccactgcactccaggctgggcaacagagcaagactccatctccaaaaaaaaaagaaaaaagaaattggagtcctttcactgtgtttcttttgagacggagttccgttcttgtcgcccaggctggagtgccatgacgcaagactctgtctccaaaaaaagaaaaaagaaaaaaagaaataaattcgagtcctttcattgtgtttctctcctaaagagtcatttcaataaatttgtattgaatatcttttgtatgccagacacttgtgggtgctttgtgtaatacaaacatgatcactttaaatgagtgtgaagtactgttctgggcaggtgaagggtaaaaggagagcatccctctcaaaatgatggaaataggatgataggtttgggggagagcagggatctccagagggagagaatgatgaataggtaggttggattcatgttgtggatgcccttaaataccaactgagcaaggttactatatatatatacaattaaaggatacctaagaagaagcctgaagacttgagatatagactgggctttatcataattagctgtgttacccttaggtaagtgattttacctctcttgacctcagctgcactactcaaacacacacataaacacaaatgagacgggaaatgagctgggtgtctgtttccttacagctctaaattctgttattccccttaattcagttttaatagaagtgggaaatcattcattgaaggtttctgagcatgggagttctcttcaacagaattactgctgtttcactacctggttgctctatttattaatgctctttcttccacccttatgtgattgctctgggagggactgtctctttatttgtttttttgtttttttgagatggagttctgctcttgtcgcccaggctggagtgcaatggcgcaatcttggatcactgcaccctctgcctcccaggttcaagcgattctctggcctcagcctcccgagtagctgggattacaggcgcctgacaccaagcctggcttatttttgtatttttagtagagacggggttttgccatgttggccaggttggtcttgatctcctgactgcaggtgatctgcccacctgggcctcccaaagtgctgggattacaggcgtgagccaccgcacccagccggggctgtctctttagatagttactgatgtggccaaggaattggccattattattagcttatattattgagaacatggggatggtcaggtatctattcttgaattagatctgaagctggtcttgtttcctcatgttatcagtcactgacctgtgaactgatccatgtgtccacaatgtgggcagcaggtaagtgctgacattttgatggccacatcatatttcagggatctatgagaaggtctgtaatgaccatggaaagccagccaagaatctccttgccatggacaaatgggagaagttactaaatttagcggacattaagctgtaaattatttgaaaggtggaaaaggattctattcagagactatccagaatttccatttactaatcaggccttgtgctgtagaggctttcatcccaggaaaagtattgctttctctcttcctctttccccacacttttgttcctgttatagtgggaggatgattttcagctcttactataacatggacttcagtgcatgttgctattagatgccaagagcctcaggatgataaaatctgaggattctgattctgattctgctatttaaaaattagaatatgagctgagtttgaattttttaactacagaatgatagagacatatatgaaatacagtacatttttgctttttgaaaggaattgttatagtgatgttcacaaatcaccaaccttggcaaaaaaaaaaaaaaaaggtccctgtgagaaccggtgtaaatcaataagaaaaaagcagatttcccagctgggcacagtggctcacgcctgtaatcccagcactttgggaggccaaggcaggcggatcacaaggtcaggagattgagaccatcctggctaacacagggaaaccccatctctactaaaaatacaaaaaaattagccgggcgtggtggcgggtgcctatagtcccagctgccggggaggctgaggcagcagaatggcgtgaacccgggaggcagagttgcaacgagccgagatcgcgccattgcactccagcctgactgagtgacagagcaagacgccgtctcaaaaaaaacaaaaaaaacaaaaaatcagatttcccagtaggaaaatgggagaaagacttgaacagacattcacaatagaggatacctaaataatcagtaaacataagaaaaggtgctcaacttcattagtcattagggaacttcaaaaccaccatagaatactactacacatagagcaaaatagcaaaaatgaaaaagatacacaatatcaagtgatagcaaggatgtggagtaactcagactttcataccctaagggtaaatagggtaaattggaaagctggctgcatctacaagagctgatttgccagcaattacatttctaagaatatgcccagcaggtaatcatatatatgttcaccaaaagatgtttatgagaatgtttatagcagtgttgttcacagaagctaaaaaaaaaaaaaaaaaagaggaaactgcccaaatctccatcagaaataaaatggataagtaaaatgtgaaaattctcatagtggaatactataaataaatgagaattagtaaactacaatatcttacaacacagatgactttctccagcataatattgagtgaaagaagccaatccatacccaaaagactataaatcatgctgctataaagacacacgcacacgtatgtttattgcggcactattcccaatagcaaagacttggaaccaacccaagtgtccaacagtgatagaccggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaattgaacaatgagaacacatggacacaggaaggggaacatcacactctggggactgttgtggggtagggggaggggggagggatagcattaggagatacacctaatgctaaatgatgagttaatgggtgcagcacaccagcatggcacatgtatacatatgtaactaacctgcacattgtgcacatgtaccctaaaacttaaagtataataataataaaattaaaaaaaaaaagaagccaaaccaaaggagcttctacttcatgatgccatttatgtaaagttcaggcagagaaaatcagtggtttaagaagttagaataatgattatctttggagggattgcaactggaagaagtcatgattgggatttctgggtcctaatagtgctctgtgtcttgatctgagtgccgactacatgagtggttaggtttgcaaaattcattgagttatgcacttaatggtgttgtcttattagagctgatggaggagagagggcttcaatttgcacaactgagtaatcagctaggcccagtcactaggtgaacaacttactgctaccaatcagccttagagcaggaatcaaactcatgtctcagaaaagttattaattacagcttgtcttgggacttccttcagagtcactcttgaatagctgaaatagtaaatgttaaatctgtggatgcaagtgtgtaaattattttagtcatcagctctaataagatggcctttggggaaatgagtataaggtcacgaaaatgaaatggcaagaaggaggtctactatttcttctgtaatactgatttttaccccatcagggtcagtccccagaggttgtaaatgtgaagcttgttctttttctttagtaagctgagtttgtggctttttaaagctttgcttcactgttctcatttgtaagtgagatattgcttgttcacctcccatagctgatgaggagattcttgtgcactgtatttgttgagataaggctggtttggggttttgttttcatctttgttttttagttaaatcataacctagttatgatttttgtgtgtccttgtttatggatctggaatttaattcattattagttgtagaatgaaaggtaagattttgttttactcttctcctgaattttctccccattctagatctgttggcataaaattttaaccagaagctaatttagtgatgctgagttagtcctagaaattagtttcaattctagtgttaatatagtctgggtttctaagttgtagaaaaatctcattttttggttcttggttttcatttgtataatttagggaaaatacaaccaactgtattttaaacatatatagtcctcatcttttctgttgggcttgaagagttgtactgggtattatggaactggaaagaagccatgtggatagttacggtatttaggtggatttgttgttggtagaagtggtgaattggaaaagtgatagggtacatatgtttcgccttcaaggcaagtctattcttactgtttgatgtcagagtaaaaagtgtcagtagctgaaaaagacaaaagaatcttgacagagtgggaaaagtcgtgcctcatgttctattgatcaaaaggaggttatattttcaaactagcttcctaagatgaaattgaagctgtacatgtgccctacttatccttgtttttcctgattttggtttttcagattattcctattaaacatgatatgctgattagcactgaatattttaggtctgctacgcctgtattagttgagattcctcttaatttgtgttagatctctgttaggtcatttctactgctggcattccctagactagaggcctgcacgcacatttgtattctaatgagtataagcactaggtgtttttcttggcactaagaaaaccttgcagcatcattaacctaggagagatttggggtttacacattaactatgggaggttgatcagtttgtggcctatacaccaagactgttctttatcacccccaagccacatttgagcagggattgaggaaggggttgatttttctgtttattagaggtgacatgagcagtggggcagcggcaaagaggccatgttgctcttgctaaatatacatccctgacagttggataataggttccaggaagttcagtggaaaattaaaacaaagcaacatttatagctgattgaacttgaaaagccattttggtgttgaatggcaaatatgtggacttcagcattcctggagcctgatgcatcccgctggatggccctgttcctgtgtacatgatggcctggggactcagcagtgtgcagggtactctcctttagagggtgctttgaggaaagaagtttgctgccacttacagaagtccccttcccatacagtgatataacacaagtaccccatgtccagggagcatctttcctctgatggcttgaggacttatttattaaaaggacaggaatgtctggcaagaaacagaggagctcttaagtactgtaaatactcctagtcactctgcatcagggctgcaagtttaagcagattgctgtggtgtatacacatgattttagcatgataacacttctgtttaatgtccttagttgttctggggccaccactggcgtgagccttaagaaaggctaacgcggctgtgaagaaagggctttatagtctgtgtgtggagtggttaattttcttagaactaaaagagaagctgcaggggatgggaagggaaaatgaagtcatggtacaggaaatataggtgaagagagaattgagccatttgcaagtatcaagaaaagttgctacacattcccatctttttctccaggatgatcttacgctattgcttctatgtgtttgtcttttgagaagcaaggccagggtgtctgatgggaacttacgaaccttggtttgctaagggtgatgagaaaacctctgtcatttgaccctgtcagtcccttggtgacttcatccaaaccagcttggctgtcaggaaaatatgaattgtggctatgggcctaatttcttctgttcccactcaaatgaactgcctttgctagctgtagaatcaactattcctatgccccatgaatttccccaaagttgaactactccagtggaactgagggtttattggttccctaccatttcagggcatttccccagcaaataagagtctttcatcccttgtgttttaactgaaaaacagagacccagccataacaattccctcagctcctcctttacttaatgaagagcttgagtaggccccacttttaaatatctcttctataagtatggtgcactgttcacaaacttagaaaatgttaaatctcgccgggcgtggtagctcacgcctgtaatcccagcactttgggaggtcaaggcaggaggatcacctgaggtcaggagtttgagaccagcctgaccagcatggagaaaccctgtctctactaaaaatacaaaattagctgggcgtggtggcgcatgcctgtaatcccatctattcaatggaggccgaggcgggagaatggcttgaacctcgggggtggaggttgcggtgagctgagatcttaccattgcactccagcctgggcaacaagagcgtaactctgtctcagaaaaaaaaaaaaaaagaaagaaaatgttaaatctctctctgccctactctgctgtggggttgaggaacaatccacttaatgggtctcttctcttttgcttagctgtagccacggcagctctatgtgtaggttggttggcaagcatttataaactttggataacctggcacccagcccttggttcacttattttaatgctactaaagtttagttttcaattcaataatctttgttggtagggcgtaactattctagttagcaattccatccgttgtaagggaatgctgacagctgacctgctgtcgtctatgcaggttaaaagatcttagttaaaagatcttagttggagtaagcctatacttttggtgttcccagactatgaaactgctgcaggtagaaacaactgtttgttttggtttcttcagcagatagagctttgcccatgagacactgctcctggtgtttgcctcgggtacctgtaaagtcactgaggaagaaacagatcttccagtgaattgagcttaattgtggtctgttgctttctctgtctgtgtctcatactggcatcatgagtttcctttctgagtcagttaaatctgagctgtgccttgtcctgtggaaatctgaggcttggctaggctcatcttgatggtctccaaatggtgaaattggggctaaggtgtgtggaaatgcacaccttagccctgtgtgcagggctgtggtgtcttatagatacagtactttctagtgagtgctcacttaggcagggccaagaaagtagttctgaatgggaactccagaggcctaatccagatatagcatattataggtgctaatgaagaggaattgtgctgctgagcaaaggaaagcttttgtgacttgaaagcacgttctgtgtatcatggaggctgggttattttcccagctttaggcgagtggcactaactacaagtttcatgttcttctgagtacacatgagtcggtactgcagtcagtatacttcttttcctgaaataagaaagtgatttacgaggtgtgggcccttacgtgaaagaaaacaaaaccagccgctctgtgggcctgtaaaattcctgtgccatctcagtggtgtgggttacaggaggagaagatggagagggctagctggccctcccttgctggggctcagctgccccaaatacttgtgatattgcaggttatttatgagctcgtctggactgggattcactgccccacaccctggtaggtgaagatttgcaggcagaatgtagaagccctcattaatcttcctggtcttgttgaggatttcttgtcggcctgagctcctgttggagaatgaactggcttttccactgaactacaatggctcagattaatattaatccccttaatgctgcagttcatgatatagtcattaggtgacttggaactaatcctgtccacctaactagtgtgatttattaaatacacatggagatcgagtctgaatacagctaggcagaatcagcagcaaataaatacctctgtgtatctgtattaatgctggttgattgggacacaattgcaggctgggctagggagaaacaagggccaaaaggaggctgagctctcttaatcaacagtattttcccacctctaccctttaatttagatggcagaaactattaaactcttggtaacagttttaggagcagtgatgagagcgtatgtcaggaacagggattataagtaatccagttctgtgcatgtaaagtcaaagaagagaaaaaaagaaaccatatatgcatttgaaaaaatgtaaagacataagctcaaactaaggaagaagaaatcctttaaacatatctttttttttttttttttttctggagtcaggattacgctcttttgcccaggctggagtgcagtggtgtgaaaatggctcactgcagcctcaacctcctgggctcaagtgatcctcctgtctcagcctcccaactagcgggaccataggtgcacaccaccacacctggctaatttttaattttttttgtagagacagggatcttcctatgttgtccaggctggtcttgaactcctgggctcaagcagtcctcccgcctaggcctcccaaaatgctgggattacaggtatgagccaccgcacccagcaacctgtcaattatttgagtgacttttcctcctatactttcttcctttaagttttaagagtaacggttcaaatggagctttctctacaatttaacttccttagcttcctttaaattctttatcagtagacaccctaggccaggcaatgatctcactgttctattacttctcctggcttcaaggcttgaatttttctttttgaaatgggtaaggagatggagtagccatgcctgccatataacagttctcttctctgagatccttgcccaagttagcagaagcataatttctttggtaaataattgatgtttatcgtttccctttctcaaacctccttttcttccccttctttgctctttcagcagagatggcattaatatgaaaaacatctacctagctggcttcatttaatcaggcaagtctgacatttgtgaaacctctcattaacattttccccaaagagcacaaaatggcctcccctccaaatacagccacctcaaagtttaggcttctttccatcaccattggcaggctgttctcagagatgttacttctctaaactcacactcctggccaacagccactggtcacatatggggggaccttctgttcaggtgctgccctattccttgtaaacatcgcttattaccaattttcctggaaataacaagaaatctttgataggaatactggagtataggtttcttcagtacttacataggacctttctccaccaattcagaaacatcagttgaagactactatgttcatggtcctctacttcagggggtccccaaccccctggccacggacccgttaggaactgggccgcacagcaggaggtaagtggtgggcgagcaagcattactgcctgagctctgcctcctgtcagttaagctgcagcattagattctcataggagtgtgaaccctattgtgaactgcacacatgagggatctaggttacgtgctccttatgagaatgtaactaacactgtagaacatcggttccccaaccttttcagcaccagggactggtttcatggcagaccatttttccacagacagtggggctggagggcaagggaggtgtttgggatgaaagtgttcgacctcagctcatcaggcattagattctcataaggagcaccaacctagatccctcacatccctcacatgtgcagttcacaatagggtttgtgctcctatgaaaatctaatgtcgtcgctaatctgacaggaggcagagtttaggtggtaatgctcactcgcccgctgctcacctccttctgtgtggcctggttcctaatgggccacagactggtagtggtccatggccttggggttggggacccctgctgtaggtaacagaaaagcaaagaagccttgtccctttctgctttccaggagcttgcagactacaatttagcaattccataaaccagaatatgctatactaaagcaacagaactctatagaagttctaagaaggaagaaattaattctgatagcagactatataatactaatactagtaatagtactaatatagtactattagtgctatatcctcttaccaattcatatcaggatgaggacagtagtctctgtcatttacctttctgttttccttccctccacttttttttttttttttttttgagatggagtctcactctgtcgcccaagctggagtgcagtggtgcaatatcagctcactgcaacctctgcctcctgggttcaagcgattctcctgcctcagcctcccatgtagctgggattacaagcgtgtgccaccacacctggctaatttttgtatttttagtagagatgggatttcaccgtcttggccaggctggtcttgaacttctgacctcaggtgatccgcccgccttagcctcccaaagcgctgggatttacaggcatgagccaccacgctcggccttccctctactttttgacctgtctagtttttgactgagtacagtttaagtaaggacatggattgcttatacttcttggtaattttagtagtcctcttcctcttacctgttctccatctcatcacaatattagtgtctttttaacaagcattaggaacagaaccaccatttaggtcttcagtgagtcacagatataaaactgtgccacagttaacgagtagaatacttggcatgcctgacaatcagaaatcatagtcattgaatttctgagccatatggccatttccagtcctatccttttagatagatagacagatagaccaactgataaaataagacccagaaaatttgaagtttggctgtggtcataaaagctagtgtagtctatagtctgtaagcaagactttggattattcttctttgtatatccaatggctagcagtgccaggcccacagaaggtacaaaataatattcactgaaggagaggatgagggatttgaatgcaggaaggccagtattgtttcagtaatcctataaatgccattttaaataattattttaaattccctaataatgggagattatgctaaacatcatttttagctattcatgaacaacaaagcagtgctcatattaagttttgggaagtgagttttactaaaacttagtaataatagtcttcagactctgtgatttaggctgcccagtgccccctttttttttctaactggcttttaaaaaataacatttagtagtaatataagccaggcacagtggcatgtgttggtagtcccagctactccagaggctgagatgggagaatcgcttagcccagaagtccaagtctagcctgggcaacatagtgagaccctgtatctaaaaaataataatagcccatgtctacatagactattatataaatttaggaagatacaaaaaagtttaaagatgctgggcatggtggctcatgcctgtaatcccagcagtttgggaggccaaggtgggtggatcacctgaggtcaggagttcgagaccaacctggccaacgtggagaaaccccatctttactaaaaatacaaaattagccaggcatggtggcacatgcctgtaatcctagctacttgagaaggctgaggcaggagaatcgcttgaacccaggaggcggaggttgctgtggccaaaatcacgtcattgcactccagcctgggcgacaagagcaagactacatctttaaaaaaataaaaaagtttaaagagatggaaacaagaacctccatagtccaatcacctaaagataactattattttatctttttttagcgcacgcaaacacaatatcacccttagcaaaatgggaatcatattctatacatttttgcctcttcttttatcatgttatgggcattgtcccacatcattacacattagaaaataagatctaatgatattattcattgtatgaatgttacagaatttatttaagagcttcctgttgttggttatttatttatttatttttatttatttatttatttattttgagacggagtctcgccctgtcacccaggctggagtgcagtggtgtgatctcagctcactacaagctctgcctcccgggttcacgccattctcctgcctcagcctcccaaatagctgggactacaggcgcctgccaccacgcctggctaattttttgtatttttagtagagacaaggtttcaccgtggtctcgatctcctgaccttgtgatccgcccggcctcggcctcccaaagtgctgggattacaggtgtgagccaccatgcccagtctatttatttattttaagatagtgtctcactttgttgcctaggctagaaggcagtggtgtggctcactgcaccctcaacctcctgggctcaagtgattctcctgccttagccccccaagtagctgggactacaggtgcgcatcatcacacccggctaatttttgtaatttttttttgtagagatggggtttcgccatgttgccaaggctggtcttgaactcctgggctcaagcgatccacctaccttggcctcccaaagtgctgggattacaggcatgagcaccgtgcccagtggttatttagattattcccagtttttcaatattataagcaatgtggtataaatatcttggtacacgattttttgcttatcactcttaaggatccttataataaattccttctattatttttatttctctttaggtaatacatgtacatagttttaaaaagtcaaattgtgctgcaaagtccaacttcccccccttcaaggtcccctccctaaactcttttagctgtttattcagttgttttcttttctatttctaaataatatgttgatactacatttttaaataggatttttacattttaagcattatctattgacttcctactcctacatgtagatatagcacatttgcaatactcaccaccccattctcctttcctccatcctcccaatataattatcaccccatttggttaaaccagtactcattctttaccttattaagaccttatagctgggcacagtggctcatgcctgtaatcccagcattttgggaagccaagacaggaggatctgttgaggccagaagttcaagactagcctgggtaggctgggcgcagtggctcatgcctgtaatcccagcactttgggaggctaaggcagatggatcacgaggtcaggagatcgtgactatcctggctaacatggtgaaaccccgtctctactaaaaatacaaaacaaaattagccgggcgtggtggcaggtgcctgtagtcccagctactcgagaggctaaggcaggagaatggcatgaacccgggaggcggagcttgcagtgagccgagatcgcgccactgcactccagcctgggtgacagagtgagactccgtctcaacaacaacaacaacaaaaggctagcctgggtaacatagcaggactcctgtctctaaaaaaaaagatctttagtattattcatttgaattcattattcaagttttcccttccttttgaaaatatgctgttttctgttactattactgtttcttctcaaattctacaagttttaaaaactgaatattatttttccacgtggtcaaacacacagctcttctcttccatttttatctcttcctagaaactccttctcagagcctcccatcctcttcttctattctgtattggttactgtctagacctcaggcacagctgtccttctggaacttcccttcagttttctctagatctcctttttcttgtttatgctatgtccatttctttcttttttctttttctttttctttctttttttttttttttttgagacagagtttcactcatgtcgcccaggctggagtgcagtgatgtgatctcggctcactgcaacctccgcctcccaagttcaagcaattttcctgcctctgcctcctgagtagctgggattacaggtgcctgccaccacgcccaactaatttttatatttttagtagagatggggtttcaccatattggccaggttgatctcaaactcctgacctaaggtgatgtgcctctgccttccaaagtgctgggattacaggcgtgaaccactgcacctggcccatttctttcttgatttactgtctcacattggttttttattttttattttttacgtcatccagtagcttctaggaaaggacacctggggatgtatggtttttttagacattgcttatctgaagctatctttttattctatactgacactaattgaaggttttaccggatatagaattctagtttggaaatagttttccttcgaaacttgatggctctgcttctttttcttctcatttccagtgttgatcttgagtagtctgatgccatattgaatctcagtcctttatatttaaactggagttcttacaatttctttatcctcattattctgaaacacttggtgtgggtctcttttagttattctgctaggttcttagtaagggtctttttgatctgcaaaattatatcatttgattttgggaaatgatcttatattagttcctcaataatttccccttttcccccttctccattttttctgttttctcaattagtccccctgttttctgttccatgtctcaccttctacctggtgcctccttccagagcttgtttcttattggtacttccttctaaagcaacttgctcttcagccttttctgctctgcttatatttccttttcttctgctaagaatctgttaatgaatctatgcttgattttagctgaaaggctgagaagcaatctgttaatgaatctcagacagttttcttttcacctcaagatcattttattctacttattatatattttagtttttatttttaattctttttttttttaaatggagtctgactctgtcgcccagactggagtgcagtggtgcagtctcggagtctcggctcactacaacctccacctcctagattcaagtgattctcaagcgtcagcctcccgagtagctgggattacaggtgtgcaccaccacgcccggctagtttttgtatttttagtagagatggggtttcaccatgttggccaagctggtctcaaactcctgacctcaagtgatccacccaccttggcctcccgaagtgctgggattacaggcataagccacggtgcccagcctatatttaattcttaaccactctgaacaccttgtatttcttcataacacttacaattagtgttaaaatcataacttataattagtcacaattataattagttaattgtgtgatcccttgcctaatgtctttcccactacacaggaaactccatgaggacaaggattgtgttgcattgttcaccatcatatatctattatctagcctggtgactggcacaaagttggcactcataaatatttaataagtgtattaatttgcatctttctttaatcaatataatttattctgtcaagtggactgaaataggaatttaacttttcccacctaacatcccatttattgaatgctctttatcatatatcatatactacatattgtcctacctattcttttgccaatagtatactgatttatttgttgtagtattataagacattttaaaatgatactgcagacttcctgaaattagttttttgtttgtttttgttttgagacggagtctcgctctactacccaggctggagtataatggcacgatctcagctcactgcaacctccacctcctgggctcaagcaatattcctgtctcagcctcccgagtagctgggaccacaggtgtgtgccaccacacctggctaattttttgtagagacggggtttcgccatgttgcccaagctggccttaaactcctgaactcaagtgatctgcccaccttggcctcccaaagtgccaggattacaggtgtgagtgagccactgcacccagcctgtttgtttttgagacagggtcttgctctgtcacccaggctggagtacagtggtgcagtcacagctcactctagcctcaacctcctgggctgaagcaatcctcccagctcagcctccagagtagttgggactacaggcctgcaacaccacgcccaggtaattttttgtattttttgtagagacagggtttcaccatgttggccaagctggtcttgaactcctgggcttaagcaatccacccacctcggcttcccacagtgctgggattacaggcgcaagccaagccaccatgcctggcctcattagttgtttgaaaaaatattctggctatcttcatctggttcttctttcacatgaagtacagagtcacttattcaagttctttttcaaagacctttaagattttgattcaaaaacataaattagtatggagagaattgacatctttataatatatttggcctccctaaccaggaacatgttatggcttctccatttagtcaagacttctctggtgaccttggtaaagtttgtagattcttctttccccagtttatgtccatttcttgttagatttattcctaaatatgtgtatgttcaattgctaaaggaaataggatttctccccactataaattccttttatctcacctaaaactgggtaagtttccctttattcctacaatacagtttacattatatgcccatgacaaaatactagtgttagtagttctccttacatgtggtgtctcatgcctgtaattctagcactttgggaggccgaggcaggaggatctcttgaatccaggagtttgagaccagcctgggcaacatagtgagatctcatctctacaaaaaaaaaaaaaaaaaaaaaaaaaattgctgggtatggtggtgcatgtctgtagtcccagtttcctaagttagcttcatttttaataagagccagttgtttcagcaagaatcgcttgaacccaggaagcagaggttgcagtgagctgagatcacaccactgtagtccagcctgggtgacagagcaagactgtctcaaagtaataataataataagaagaagacaaagaagagccagccatttcaatgatctattactgtgtaaccatttccaaactttgtggcttaaaccgacaaccattttattgtatcacaattttgtgggttgtccagggcccagctgaacacctcttctcacagtctctcctgtggttgcagtcagctgcggctgtggtttggatgtctggtaccatgtggcttcctttgacatgatacctcaatctccagggcttttcctcatgacctagctctcctgcagggtagcttagactgtgtacatggcagtttagatctccaaaattgaaaaaaaaaaaaaaaaaaaaaagaagaagaagaagcttcaaagcctttttagtgcctgggcatggaagtcccagattgtcattttctctgcattccgtatgtcaaagcagtcacagacgagattcaaggggagcagacacaagctgtacctcttgattggaggaggaacatgtgaggggtggcactgtaagggactacctttggagattaactgccataatggcatttgttcattggcccttgtcttcttccttttcttcttttattccaggtagctaccctagacttcagtgtagactaagttcttttaagcatgtttgcacttttttttctgtctttttttttttttttcctttatgtggagaacgggacctcgctatattgcccaactcctgggctcaagttatcctcccatctctgcctccctaagagctgggattacaggcgtgagccaccatgcctggccataagcttgtttaatccagtcaaatttcagtaccaaataactatattcattgtcataaataggaatctgaagggggtagcaagggaagcctttcttttaatgtttccatcttcacatttgttttcctggatgaagtttaactcttatggacagaaatacagagttcacttgagcatgaaataccagacaaagagacaggtgtaaattggccctgttcttctgaaccctgcctgcctactttctaggaaggctagccttcccctcttttccccagcataagtccaaccccttccctcattatggtttgtcataagaactctctcttatactggtgcaagtggaaaaaagagagtattattccttttctttttttcacaaaatacttcttcctaccctggatttgctaacctctggcttaaatacgcaccaagcaaagatgtatatatagtcttcctcccttcctctctctccccttagtctgaaggaaagcagcaggtgatggaatgcataaaggatcggggcagggctagagtcttttctcacacactatggacgttgctcaacagaatgggtgtgaaatttagtcagagccacagcatgtgtttcagttttccagggaatttcctcttcctaactgtaggtttaaccctttcttctgtgtagggaatgccaggggctacccaagaaatatgaaatgagttatttgtaagaaggaaaaaatgccaggcttttaccaggctcctttgggatctaggatctccaacttacttcttgctaaatgattgtggaaaaagacatagactttggagttggatagacctggcttcatatcccatctctaccattgggtggtcttgggcagtcattggtggcagttacttgatcttttttttttatttgagacggagtttcgctctgtcacccaggctggagtgcagtggcgcaatcttggctcactgcagcctccaccttccaggttcaagcgattctcctgcctcagccttctgagtagctgggattacaggcgcccgccaccacggctggctaatttttgtattttttagtaaagacagggtttcaccatgttggccaggctgatctcaaactcttgacctcaagtgatctgcctacctctgcctcccaaagtgctgggattacaggcgtgagccactgtacctggctgatctttttgaatctccattttctcatctgcaaaataatataaaaacttgccttatagtattcttgtgagaattacatgagttgatgtgtataaggtgcctagtacaatgcataccctctccacagtatgcactctacatatgattattttcttctccagtctttacctctggattctgaggctatctactcttcttttgtgccatgccatgttgggtgtttgccatggtagcagcttttcactaaagtttgttgcttttctccccgaatctaattccctaagtgcgttacagggaggagttatttcacatgatatgcagaatccctcttggggtcctcattaagctaaaggacaagtctctatacgaatgctgagaagggctgggcccagtggctcacgcctgtaatcccagcactttgggaggccaaggcaggcggatcacctgaggtcaggagttcaagaccagcctggccaacaatggtgaaaccccgtctctactaaaaatgcaaaaattagctaggcgtgatggtgggcacctgtaatgccagctccttgggaggctgaggcaggagaattgcttgaactcaggagacggaggttgcagtgagctgagattgctccactgcactccaagcctgagcgacagagcaagactccgtctcaaaaaaaaaaaaaaaagaaagaaaaaatgctgagaaggactatagggctttccttgcccgtctcatactggaacccatatgaacttacaaaagttttttttgtttttgtttttttttaagacacagtctcactctgtcacccaggctggagtgcggtggcacaatcttggctcactgcaccctccgcctcctgagttcaagcgattctcgtgcctcagcctcccgagtaggtgggattacaggcacatgccaccacacctaactaatttttgtatttttagtagagatggggttttgccatgttggcgaggctggtcttgaactcctgacctcaagtgatccacctgcctcggcctcccaaagtgctgggattataggtgtgagccactgcgcccagcctacacttataagagttctaaaatcatacagtgttagaactgaaatgaagtatagaggtcacctggcctattttatacggaaagaactgtggctcggaaaaggtcatgtcatgcaaggcctcataacggagtagtggcagctctggaactaaagatctgtcttacttgtctattactatggttataatttaatttttttgaacgctatctgagttctaagtgctcagggcctagtatgcaagtttacgccaagtatgtaaacttgcttctaaattggaatgctgatcatacttttagcaatggggaagtaaacactgttgaagacatttcaatatcattcccttggggagtaacagggcttcaatgagaatattataagctaccacctgaaaacctcatttttctacaaaggttgcccaaggggcactgaggtggcagttcagctggctgttgagtctctgctcccagactggtgagttgggaagcaaacttgtttcttctgttctttcttcattctcccaaataataccaagtaggggaagctcaccccaagcccccatctggctttccttttttttcaacttgaggtataattaacatacaataaaatatgcagatgttaggtgttcagttggtaagttttgataattgtataaaccatgtaaccagcatgaataaagaatacacagaacatttcatctccccagaaatatcccccatgcctctttgagtcccccaaccccacacatatatacaaaaccattttctatcactatggataagttttgtttttggatttcatataaatggaatcacacaggatatactctttcatagctagcttcttttagcttagcatgtttttggaatttatccatgttgcatatatcagtagtttttttctgttttgcttttctgagtggtagtcaattgtgtggatatataaggagaaaaggtagaggttggtgaagggctttcatctggcacgtagcctgactaccctttgctcaagagcatttggaccaccagaggcccccctccttaagattaagatgttcacttacctgctttaaatgtaccacgtcacagcatatacactattatgtagctatgtcttgtaaaagtctctaatcggcatccattagatgagccgaattctcctggccaagccttagcctctcagggggctggcaccaaacagggaggctggagtagggtttcaaacacctgtttcagctttttaagtgtccgattcaggccactgtgctctggcagcagggatcctcatgatgtggcttcttctctcctgccaaatcctcaacttaaagaacctaggcccttaggggaggaaaatatagagctggtggagaggggaggggtgtgcagcaacattgaagaactgtttcttttaaagttaaatgcacatctaccctgtggctgagcactttcgctcttaggtatttagtcaagagaaacaaacacatttacaaagagacttttataggaatgtatacagcagtaatagtaaataactggaaacaactcaaatatccttcaataagagaatggataaattctttgggagtgaaggacttacagaggattctctggcggccctcctctctttctaggaatcattcttgtttctattcttatttctttctggatttttctgaatttggttgtgttttaaatgccatgtaatggaatacccattatttgtaagttgattgagcataaagtattttattataaagtggtcatccgtcacaagaaggcatgtggctgtaaaaaacattaactctgcactctgggctggaatgcaactttaccagaataatggagcttttgtattaagtgtgcagttgggataaaacaagagacagacagacagacagtgttggggaaacaggtgttggctgggcccagcttctgtcccatgttttgtgaaattgttttccaaccctttgaggattgctcctccagattcagctgtcttaaaggttctgtcagcacctttcgagcaaataaggtgtgacttttcagggtactgctgcttccataagctttatttgtttactgtccagctcacagacatgtctagagacagcagtggcaagtgattaccatacttatcctagctccatctatttttgacgcttttgttttccccatcagtaaaatgggaaatatcccttatcataaagttcttgagccttttagcatgagggtggctgaaacagcataaagacttcttaatctggctgggcacagtggctcatgcctataatcctagcactttgggaggccaaggaaggaggatcacttgaacccaggagttcaaaaccagcctgggaaataatagcaggacctcgtctctacaaagaaaaaattttttttaattagccaagtgtggtggcacacgctttagtcccagctacttgggaggctgaggtggaaggattacttgagaggttgcagtgagccgagactgtgccactgcactccagccagggtgacagagtgaaaccctctctcaaaaaaaataaaaataaaaagaccccttagtcttgttgtcactaagaatttatgatatgctgctgtagtaactatttccagctcttgggaaaacattaactctgtactctgatagtacagtaagtgagagtgaataagtaaggtcctatacactgaagggatagggaaaggttacttatcagtcctgttattgagactggggactgtctgattcttctccaggagctttgactattatctcttcaggctttttcatcatctgtaaactttgctaatgtcagttcagaatttagttctttttaatttcctctttgtctttttcagggctggtagagaagacctgacatagttataattgataataaacctataatgctgctgttgaacaatgaaattttttactagactctgaaaggaatttgtattgaaaaagctgctccaagtgtaatgactgcataaagctggggtaaattgttctgttgtcaagtataccaacagaagtttttaatttctcctgggctttcagattgcctgcttaagttggggcttggtcttctacagtgcatgcagaaaacaacaaggcagagtgaagggccacagtagctctggtttgtctgtatgctatagctgaattgcttgcctttcaatatgtgccaatttcctctagaaagaagagaactagtatttaaggttgatacgcatcaaacttgtgctttcagtaagacagatggatcagtctgtccttgggtctctgagatatgattgaggccagtccctgtgggcctcatttatccctgccagccttgttaaaggggcctcactctccctctttggattaggagggaacctaggtaaacctgacacttaatttgtatggcagtactacaagcaataactaacaatgtttagtcactggttaggagaaggagaggtgcagaagaaacttcagttctaggatggttgagttttaaaattttttgttttgttttgtttttgagacggagtcttgctctgtctcccaggctggagtgcagtggcacaatctcggctcactgcaagctccgcctcccaggttcactccattctcctgcctcagcctcctgagtagctgggactacaggtgcccgccaccacacccggctaattttttgtatttttagtagagatagggtttcaccgtgttaaccaggatggtctcaatctcctgatctcatgatccacctgcctcggcctcccaaagtgctgggattacaggtgtgagccaccaagcccggccaagttttaaatttttgtcatccaagtcatgcagttaatatatctagtagtaaacttatacaataggccaggcacagtggcttatgcctataatcccagcactttgggaggctgaggcaggaggatcatttaaggccaggagttcaagaccagcctgggcaacatagcaagaccccctatctacaaaaaatttaaaaaattagctgggcatggtggcacatgccagtagtcttagccactcaggagttggtagtcttagccactcaggagtctgaggcagaaggattgcttttgagcctaggactttgagtttgcagtgagctataattgcaccatggtactccagcctgagcaacagagcaagactctgtctcaaaacaaacaaacaaacaaaaagccccctgtaccatagcatggtataatattgaagagtataatacagtggctttggagtcacaatagacctggattcaaattttatctcttccacttgctgtgtgaccttgggtaagtcacttaacctcttagagcctcggtgtccttatctgtaaagtgaggacagtaacactatttcccagagttattgggaggataaaataaaattatatatggtaattatgtttaataatataatgtagctggccgggtgcagtggctcacacctataatcccagcactttgggaggctgaggcaggcagatcacctcaggttaggagttcaagaccagcctggccaacatggcgaaaccccgtctctactaaaaatacaaaaattagctgggtgtggtagtacacgcctgtaatcccagctacactcaggaggctgaggcaggagaatcgcttgaactctggaggtggaggttgcagtgagctgaaatcacgccattgcactccagcctgggcaacaagagcaaaattccatctcaaaaaaaaaataaataaaaataatataatgtagctgttgctgatgtctgaggcaaattaaggttgttgttctggcaatgaaatgggattcttgtgagggtggtagatagcagctcctagcaacaagttaatctggctatttagcaggaatgcccaaggtaggaaactcattcctcttctaatcaggattcatacatcatattggacaaaatcatacaataaactattttcccatgtgtatgctgcctttaagtgcctgtcttatcttttgaaagtggaggctaaatctgacctgaggcagaccagggcagcctcactcagcaaggagacgatggcaaaaatgacgatttcaggagcagagatttacggaaagcagcctgctctgagatacacatgctgttagggattttgaccctgaaaaaatatatcctcttcctatcctctctctaaggagaggttgagctgctatagggatggagatgggggcaaggtcctgacaaaggtgttcaagccagagagcatatatagatggcaaaaataattttctgtcatggtcatcttgaacctttttgcaccaggtatctagggaggaggagttcttacataatctctgggttaggttggggcctcatgaacatgatgctccataaagtacttatcagtggcagttttggagaaaatataaaattatgatttctaatccctggggttttcagactttaaatgtaacctcaaggtgtatacattcaggaactcctcatgtttaatcagagagttaaggtttggggttttgattcattaaaaaaaacagattggggctgggcacggtgtctcaagcctgtagtcccatcactttgagggccaaggtgggtggactgcttgagcccaggagttcaagaccagcctgggcaagagagagagaagaaaaacagggtgggttgacctttgagggattgatcagccagaaaagtgaacactttccaaagggtttgtttttgttgttgttgtcttttgagacagggcctcactctgtcgcccagactggaatgcagtggtgccatcatggctcactccagccatgacatccctgggctcaagtgatccaccccacacgtcagcctccctagtagttgggactacaggcgcacgccaccatacctggctaattttttttttttttttttttttttttgagacagcgtctggctctgtcgcccaggctggagtgcagtggcgcagtcttggctcactgcaacctttgcctcctgggttcaagcgattcttctgcctcagcctcctgaatagctgggattacaggcgtctgccatcacgcccagctaatctttgtatttttagtagggacagggtttcgccatgttggccaggctggtttcgaactcctgacctcaagtgatctacccgcctccgcctcccaaagtgctgggattacaggtgtgagccaccgcacccagccttcccctatactttaaatcatctctagattacttgtaatgcctaactcaatataaatactatgtaaatagttataccatatttagggaataatgacaagggaaaaagtttgtagatgttcagtacagatgcaaccatccacttaatttttctgaatatttttgatctgtggttgatcgtgtacactgatgttggatccacagacacagagggtcaactgtaatttgcctttttttttttttgaaacagagtcttgctgtgtcacccaggctggagtaaaaatgttatgatctcggctaactgcaacttctgcctccccggctcaagcgattctcgtgcctcagctaccagagtagctgggattacaggtgcgcaccaccatgcccaactaatttttatattttttgtagagacagtgtttcaccatgttggtcaggctggtatctaacttctgacctcaagtgattcgcccacctttgcctaccaaagtgctgggataacaagcgtgagccaccaagcccagcctaatttgcctttttcaatgtaagtggttggtaccattatcttctactgctggccctaagtggatctatggatcctgatttttaccttgatgcagcaatgattaagccataatcatactttgtctcttaaaaatcataatgtcaaagttaatagccccctaagtctagaagcatcctgagaagctaagaatgtgtttgataaaaagaagcagatctgagaaactgttgtgtgatagctgagaaaagagccactgtgaagagcttagacaaacaaacaggacttgccttccctccaggctagactgtctgcattcatgtgcatttacttccaaatggtactttgcatttagaatcataagttttagggaccttaaagaatctagttaaattactatcaccaccaccaccttccccaggaaatcccaatggatgaggaaactatggcccagagaaatgaggtgtttttgcccaaggtcacacagttaatgacagaatcagaattgggcctagtgcatttctttatttcatatctcctgttgtatagggcagggtctatctgggtttgacccttaagcccaggctaggaaatacaggtatgggacctgtccgttgacagtgttttctggaatccgttcctgaaccaagcctaaattcccacctgtccattcataggtctggaaaactttgaagctgataaacgaaggtatgggaggtttggcagttattccagaggcttctggctttgccaaagtttagctttgattattctttggaccactacccctcttttttttttttttctttttgaaacagggttccactctgttgctcagggtagaatgcaatggtatgatcagggctcacctcagcttcctgagtagccaggaccacaggtgcgcatgcctggctaattttttcatattttgtgcagctgaagtctcactatgtcgcccaggctggtctcgaactgctgggctcaagtgattctcccacctcagcctcccaaagtgctgggattacaggtgtaagccaccacacctggcctggaccactactcttgatgtcctctagtgaccaaaaagaacacagcttcttcctacggagcttaccatacatcagacatttttgtagatcactatcaatcttgacttttgcaagaaatatattcctggggtgtacagcatagtcagaaaagtagcatatgagacctaacactttctcctaaaatggaatgtacagatacagacagaaaagcctaaaaccaaaaagcttttgtcgtctgtctctggatacagaaatgttagaggggtaaatgaactaatttctttttttatcatgctatgatttattagtctgttatacatgatccatcttgtgaatgatggcattctgtctccaggaacatgggccaatatttgcagggtaaagaacatgcatgggagcaggctggtgaccctctagaaagcaagaagagagaagtagactctgagggcaaaaaggtcgagacaggcatttctgaagccaaatggtgttgaaataacataccgcaggcctttttccttgtcagcgtaatccaattgagaatgcccaactgcccctgataagagtcactcaggagtgaagagctttgctaccagggaaagcagcttatgtgtgcattttggctcaggaatgtgccagcccaatgctggccaaatgagaaaaggctgctgcggcctggagaacacagcctcctgggaggatggtggctgttcccttgtagcttaggagagtattctgttttgtccaagggcagtgcttgaggccacatgttgaggcctttgacatagattatcagagatggtagcagctctgacatgagaagagaaaataatgtcaagattcagctgggcgcagtggttcatccctgtaatcccagcactttgggaggccgaggcgggcacatcacgaggtcaggagatcgagaccatcctagctaataacggtgaaaccccgtctctactgaaaatacaaaaaattagccaggcgtggtggcttgcgcctgtagtcccagctactcgggaggctgtggcaggagaattgcttgaaccggagaggcggaggttacagtgagccaaaattgcaccattgcactccaggctgggtgacagagcgagacttcgtctcaaaaaaaaaaaaaaaagtcaagattcatccccattttggagaggtcacctcatcatttgggaagacaagaggtgtgggacatctgcagattctcagacagacattgggccaaattgacacttctgttttaatgtcataatatggggagtgaagcaccctgcccagtcgtattgagtacagtatgagcagaccaccaccaagacatctccaaagggcttcactttgctttgggttgaagtgactcatgagcctctccagaaataatttaataattcttgttgtaatttgtcactgactgtccagaaattggatccggatttgattctggaaggatccgaagtgttttctccaatggggggttagatttcccctccttgtgccctttttcccccagatgactggctcatcttagaacatggaccagtcaccttcagagcacctctctacctaatctgcactctgtgtttactggactgtttgtgccttgaggttgacagtcttccagggcgggaattttggctgcttggctggggtgtcagatgtctccttggttgtgaaattattcagcctgcttactatgagcagaatcatggcacttttctcctgaaggactcaggcagttttcactcttctggagaagatccagacaattgaatctcagttcccagccaggctgaaccgtgagataggacaccagaaacctttctgttctagccttgtaggaagcagtaaagtcggatggctacgagcagagcttttggagttggatggacctggatttgattcctgtttccactactagctagtgctatgatcttagctggtggggacatctcgttatcctttccaagcctcatttttatcttcaaaatggggttaattatgaagagtgaaggtatgtaaagtgcatagcacttggcatggcgcaggtaataaatgttaatgagtactttaataattcattttattaaaaggaagcctgttctttctctgataccttggagaaagctgaagccctcagaaattaaaagtgctatcccaaattgtaccgtaaatatcaaccacccgttatctcagtatttatccttaacttgtgtttgttttatggtttaggagtcaaaggtagaatttttatatatatatttacttaaatcttaagaaatgaactggtggccaggtgcagtggctcatgcctgtaatcccagcactttgggaggccgaggcaggcagatcacaaggtcaggagatcaaaaccatcttggccaacatggtgaaatcccatctctactagaaaatacaaaaattagctgggtgtggtggcatgtgcctgtagtcccagctactcgggaggctgagccaggagaattacttgaaccggggaggtggaggttgcagtgagccaagatcactccactgcactctagcctggtgacagagcgagactttgtctcaaaaaaaaaaaaaaagaaaaaaaaaaaagaaagaaatgaactggtatacaatatagagaacactggactgctgtgactctagagctaaaaactagaacaatatcttagttatctttattatacactttattccatgcattgtaccaagtgttttacatgcatcaaatgagatagtgtgtaaattgcttaataccatgcctggcacatagtatacgctcagtgaatgttagttgctattattatttattttaaatgtaatttatttaaattatctaatacccatttacaagtaataaaattagagacccagaacacttaagtaattaaagtcacatagctattaagttgcagaactgggatttgaatcgtccacgaaagcccatgattctacctagagcccttagcttctagtcctggttccaatactaactggccttgtacaaattacttaacttccctaaatctcagttacctcattataaattattttcaggccctattttagctgtaatatcctaggatttggaggattttcctgaacagtcaaaaattatgacttatttttgtagggtatggtttaatctctgagtaacagttccctagaaaactgatgcagcctacaaactgctgcttatacacaaagagatatatacagaagttgaaagtattttaaaaattttataacaatgtgacagtagttacatgtatgttgattctagtaataaaaaaattggactttatgtttttaaaatttttctagtaattaactgtattttataaaactatgggtctgcacgggctgggcgaggtggctcacgtctgtaatcccagcactttgggaggccgaggtgggcggatcacgaggtcaggaggtcgagaccatcctggctaacgcggcgaaaccccatctctactaaaaatacaaaaagttagccgggcatggtggtgggcgcctgtagtcccaggtactcggggggctgaggtggaagaatggtgcgtgggggagcttgcagtgagccaagatctcgccactgcactccagcctgggcgacagagcgagactccgcctcaaaaaaaaaaaaaaaaactatgggtctgcagtggattgacataaagaagaaaaaactgctcttcatcacagataatttgacaagcactattctagataaccatctgaacatctcaccaggattataaattcaaatttgtttgtttttaaattacatgtttacaaaaagttaccccttaaattagaaatatccttactaaaggctggacgtggagactcacgcctgtaatcacagcactttgggaggctgagacaggtggaccacctgaggtcaggagtgcagtttgagaccagcctggccaacatgaagaaaccccatctctactaaaaatataaaaattagctgggcctggtggtacatgcctgtaatcccagctacctgggaggctgaggcaggagaatcgcttgaacccaggaggcagaggttgcagtgaaccgagatcacaccactgcactccagcctgggtgacagagcaagactctgtctcaaaaagaaagaaagaaagaaagaaatatccttactagtgatgccccactaggagttcaacttgcccccaaccccacttgttgcagagttgctcctgttagagcttctcttatgctcctggcaatcaacagttgaacctagagagcaaaactcttgttctccctagacaaaactctttaaggaaagttaactttatatatcatgattctcttttttggaagaggtagggaagtgacatgataatgaaggttcctggtgggctcattaaaaagtttaacccttctagtttttcatcagtaggtttctataaagcactgacttaccaaatgaaagtactggaatgaacatatcttagcagtcatagattccaacaaccttcttctttttttttttttttttttttgagacagagtctccttctgtcacccaggctggagtgcagtggtgcagtctcggctcactgtagcctctgcctcccaggttgaagcaattctcatgcctcagcctccaaagtagctgagattacaggcacgtgccaccacaccaggctaattttttttgtatttttattagagacatggtttcactatgttggccaggctgatctgaaactcgtgacctcaagtgatccactcacctcggcctcccaaagtgctgggattagaggtgtgagccactgcgcccagccgatttcaactatctaatttgacagatgaaggtcttgggtatcatatatctggctattgataggagtgagactagtccattgactgaattgtatgctgtgtgagggttacacacagagcctcggctgggtgcggtggcttacacctgtaatcccagcactttggtaggccaaggcaggcggattacctgaggttgggagtttgagaccagcctgacaaacatggagataccccgtctctactaaaaatacaaaattagctgggcgtggtggcgctcatcagtacagtgatgagagaaaccaagaagatctgaataatggagagacataccaagttcatgaattggtaggcacaacatagcaaagatatcatgtctccccaaattgatctatagactcaatgcaattcctttcaaacttccaacaaggcaagtttgtcttaaattgaaatggaaaggcaaaggaattggaacactgaatgatattggaaaaaaaaatgaagttggaggaatcacaccactgttattaagacttagtataagccgggcatggtggctcacgcctataatcccagcactttggaaggccgagacgggtggatcacctgaggtcaggagttcaagaccagcctggccaacatggcaaaatctcgtctatactaaaaatacaaaaattagccagacgaggtggtgtgtgcctgtaatcccaactactcaggaggctgaggcatgagaatcacttgaacccgggaggtagaggttgcagtgagccgagatcatgccactgcactccagcctgggtgacagagcgagactctgtctcaaaaaaagacttagtatatatcggcagggcacagtggcttatgcctgtaatgccagcactttgggaggctgaggcggacagatcacagggtcaagagatcgagaccatcctggccaacatggtgaaaccccgtctctactaaaagtacaaaaaaattaactgggcgtggtggcacgttcctgtagtcccagctactcaggaggctgaggcaggagaatcgcttgaacccaggaggcaaggttgcagtgagccaagatcgagccactgcactctagcctgggtaacagagcaagactccgtctcaaaaaaaaaaagacttagtatatatttataataattaacacagtgtcgtgttgtcagacttagacacatagatcaatgaaacagaacagaacccagaagagactcacaaaaatatggccaatttaatttttattttttggaacagggtcttactctgtcaccccaggctggagtgcagtggtatgatcacagttcactgcagcctcagcctcccaggctcaagcaatcctctcacctcagcctcctgagtcgctgggactacaggcacatgccatcatacctggttaattttttttttttttttttgagacaggatctcactttgtcacccaggctggagtgcagtggcacgatctcagctcactgcagcctctacctcctgggttcaagatattctttcacctcagcctccccagtagctgggactacaggtgcgcgccaccatgccccactaatttttgtattttttggtagagatggggtttcaccatgtttgccaggctggtcttgaactcctgacctcaggtgatccacccacctcagcctcccaaagtgctgggattataggcatgaggcatgagccactgctcctggtccatgcctttttttttttttttttttttttgagacagagtctcgctgtgttgcccaggctggagtgcagtggcacgatctccgctcactgcaagctctgcctcccaggttcacgccattctcctgcctcagccttcctgagtagctgggactacaggctcccgccaccacgcctggctaattttttgtatttttagtagagacggggtttcaccgtgttagccaggatggtctcgatctcctgaccttgtgatccgcctgcctcggcctcccaaagtgctgggattacaggcgtgagccaccacgcctggccgtttttttaattattttctgtagagatgatctcactatgttgcccaggctggtctcgaactcctagactcaagggatccacccacctcagtcttccaaagtgctgggaccagtgcccaacctggtcaatttatttttgacaaaggtgcaaagacaacttaatgagatatgttggaaacagtaggaaattcttaggcaaaggaaaaatgagcctcaatctaaacctcacaccttatgcaaaaattaactgaaaatagatcataggtgaaaaacataaatctgtaaacattttaggagaaaatgggagggtggaaatctttgtgacttggaattaggcagagtcaatttagacattaaaccaaaacacaatccataaaatattaataagttggacttcatcaagagtaaaagtgtctgttctatgaaagatgttaagggaatgaaaaaataagcttaagactgggagaaaatacttagaaataactgtatcactactgaaggacttgaattcagaataaagaagtctccaaactcaatagtaagaaaacaatttagtttaataatggataaaagacttgagcagacatgtcacccaaaaggatatacagacggcaaataagcacatgaaaagatgttcaacataattagtcattagagaaatgcaaatttaaaccacatggagctactattacatacatacttgaatcgcttaagtaaaaacactgaaatacaaagtactgaagaggatgtggagaaactagaattcttattgctagtgggaatacaaagtgataaaatgacattggaaaagagtttgacagtaaagctaaccacacctttaccttttgacccaggaatcctacccctgggtacttaccctaaagaagtggaaacctgtgttcacacaaacactgatacacaaatgtttatagcagctccattcataattgccccaaactggagatcccacatgtccttcaaccagtgaatggataaagaaactgatacatacaggcaatgaatactactcagcagtaaaaagaaacaagctattgatatatgcaatagcttggaaaaatttcagtcatcatgttgaatgaaggaagccagtctgaaaattggctgtaaaattacatgctgtataaatcattcatttaaagaaaagaattaattttaccaaattagcaaaaagaggctgaatgcacatcaccctagaagtgtggaccccatatataaaactgccctactcttttaccgtgaaggaagacatgaagcaagtatatagttgtagcaactaaatgaaatcacagaaaatctgtacctgtcccgattctcaaagatttttttcctctagacttttatatgtcaaatatacctcatgaccacttttaagataacaaaccaaattgtacataattcatgctcctaaagcagcaagactagatgactttacatttttttatgtacttttttttttttttttgagtcggagtcttgttctgtcacccaggctggagtgcagtggcgtgacctcagctcactgaaagctctgcctcctgggttcacaccattctcctgcctcagcctcccgagtagctgggactacaggtgcccaccaccacacccagctaatttttttgtatttttagtagagaccaggtttcaccatgttagccaggatggtctcgatctcctgacctcgtgatgcgcccgcctcggcctcccaaagtgctaggattacaggcatgagccaccgtgcccggcccttttatgtgctttttaaaagtacgttatgtatttcagtttttcacacacacgcacacacacacacacacactcacacacagacacacacacacgttcttctctaggttttttctgtaaattttacatctctaggtgggggtagtaggggaagagaagcaggttttttttacagctgatgtgatcactgtacagacaagcttggaaaatgctacccaatctgccaattaattaaagcgttaatctgaggagcagccgggcccagggaatgtttacccagggaggagtgggggtggtaggaactgagtaggcagctccctatatttgcatgaaaatgaaggtgcttaggaaaccctgcttccttttgtctctaaaggtggggcagcctagatcacatccctaaacacttttggtctctttaggaagccttttagggagctggtctctgaaagatgaaagcacagcacaatctagaaaaacaaatttaaattctggtcagagtaaggtagggagtaagtacagtgtagtattctttgacctagaatggaatcttctaaattcaggagtaaaatttcatctatttaggtagaatagatgaaggggttttacaagttttaaaaccacataggctgggttcaaatcccagctctgcatattagttgtgtgatttgggactaatcatgtatcttatctgagccttttctcatctgtaaaataaagattatcaattgccccttcatctcagagcagttagttctctgctaactctaggcaggaaacaggccggacagtggttacgaacttccaagattacagactgcctccatgactaagagactgctcagccttttgttcttgttaaacttttttctcagcaagggattataaacctcagagtttcctctcaccctcctggaatatgctgcactctttctctaagagaagtgaccctgaccataacagcaaaggacataaagacaggagcccaccttgggacctaagggtcgcattggctctacccaagatgacgttacctatttatatcacaggggagggtggtgaaatgggcatggaaaattgactcacaatatttgatgatattgaaaaattattgttaatttttaaaaattgtgataaaatacatataatgcaaaatttaccattttaactgtttgttaactctttaagcataatattgtgggccaggcacggtggctcgcgcctgtaatcctagctctttgggagggcaaggcagggacaattgcttgagctcaggagttcgagaccaacctgggcaacatggtgtaaccccatctctactaaaaatacaaaattagccgggcatggtgacagacgcctatagtcccagctactgaggaggctgaggggcttgagccctggaggtggaggtttgcagtgagctgagatcatgccactgcactccaaagcaggactctgtctgacaaaaaaaaaaaaaaaaagataatattgtgtttttgttctttttttaagattcctaatcttttagatctacatgctgaaaattttacagataaaatgatacagtgtctgggatttgattcaaggtaatccagagggaagaagattgacccaacaacaaagacctctagcctcatggcacaaacaagaaactttttccagggtttagttttctcttagatgatacctcttcatttctgtgtattttcttgcagaactctcagaaattgagcccaatgtattccttcgaccttttctggaagtgattcgctctgaagataccactggccctatcactggactggcactcacctctgtcaacaagttcctgtcctatgcactcataggtaagagctcaggctttgttgcatgaccacagcacttcatttcccacctttcctggggtgcccaggccttaggcaatgagctggtgatagtgggaaattttttccagtcacctcttttcttgtagaagagaaataggattgttgttggttattcatcatgctagctgactcacgttgtacagggtgggaagggcaagagaagaagttttccttggcactctggcttctctatgctttggaaagagttaagggtatggtaccttactcttggaagtttggttaggtttgtttgtttgtttgtttgtttgtttagttagagatggagtctcactctgtcgcccaggctggagtgcagtggtgtgatctcggctcactgcaagctccacctcccgggttcatgccagtctcctgcctcagcctcccgaggagctgggactacaggcgcccaccaccacgcccagctaattttttgtatttttagtaaagacggggtttcaccatgttagccaggatggtttcgatctcctgacctcatgatctgcccgccttggcctcccaaagtgctgggattacaggtgtgagccactgtgcctggcctggttaggtttatttttaaagttattttttcaaacataatgcatgcacattataagaagacagacaatagagatgttcaaaagaaaagttaattgtccttcctgtactttctcaatgttcctcctccttctttaggcaaatagtgtgaacagcctagtttgaatctttatgtttttctatgtctttataaatgaagtaccattcctttttaaaatgaaataaggccgggtgcggtggctcacgcctgtaagcctagcactttgggtggccaaggcgggtggatcacgaggtcaggagtttgagaccagcctggccaacatggtgaaaccccgtatctactaaaaatacaaatattagccaggcgtggtggcgggcttctgtaaccccagctactggggaggctgaggcaggtgaatcgcttgaacccgggaggcggagtttgcagagagcagagatcgcgccactgtactctaacctgagcaacagagcgagactctgtctcaaaaaaaaaaaaaaaagaatagaataaaatgaaataaaaataggattatgtgctacatattttcttttttcatttaatggtattaacttgaccaggcacagtggctcatgcctgtaatcccagcactttttgaggccgaggcggacggatcatgaggtcaggagtttgagaccagcctaacatggtgaaaccccatctctactaaaaatacaaaaattagccaggcagggtggtacgtgcctgtaatcccagctactcaggaggctgaggcaggagaatcacttgaacccgggaggcggaagttacagtgagccaagatcacaccattgcactccagcctgggtgacagagcaagactccgtctcaaaaaaaaaaaaaaaaaaaaaaaaaagcagatagtattaacttaaatgtacatgatataactattcatctgatttattcttttatattgtagaaaatatatataaaacttgctatttccatcagtttcagtttacaattcattggcattaattacactcacaatgttgtgcagccgtcaccaccatctatttcccaaacatttttattaccccaaatagaaacttaacataatggggagttaacattaaccaataactccccatttctctctcccctcagccccttgtatgattttttttactagctctataatttccatagtgtaatatagatataacacaattcatgtgctcattcttaatatttaagattgtttcctattgaagtcataaataatgctaatataagcatccttgatcacatgtccttattaataatttttttaatttttatttttagtagagacggggtttcaccattttgtgccaccacgcccggctaatttttgtatttttagtagagacagggtttcaccatattggccaggctggtctcaaactcctgaccttgtgatccacccgcctcggcttcccaaagtgctgggattataggcatgagccaccatgcccggccccttattgctaattttactcttgtatgaaagatttctgaacttggaatttctggattaaagaccacgtgcatattgcatttttatagctattaccaggttgcttccccaaaaggttacatcatttatacttccaccagcagtgattgagaatttctacttccttaccctgtcatcagcactgaatattatcagttttatttgtgccaacttggtaagtaaaaaatgatattttgtttttattttttgagacagggtcttgctctgtcacccagactggagtgcagtggcacaatcacggctcactgcagccttgaccttcgggctcaggtgatcctcccacctccgcctcccaagtagctgggactataggcacacgccaccacacccagctagtttttgtacttttagtagaagtggagtttctccatgttgcccaggctggtcttgaactcctgagctcaagaaatccaccaccttggcctcccaaagtgctaggattacggatgtgagccattgcactcagccttttgttgcttttatttcctggaggctgaacatttgaatttcctgtccttcacttctttttttaattgagttgggtttgtttttcatgtcaatttgtaggagttctttgtatggtaggaatattaacccattgcctttcatagcattacaattatttgctcctaatctaggccaaatatttcccttaatctgtagtttatctctaaatttcttcatggtgtctttctttggatttcttttttagttggtcttgacactcaatttgggaattcattttccctgattggcagcccatgtacaaggatgaagaatatagaaaacaggcagctgtctttgtttcttaagcagggagacaagaaaagataaggctcaggctttagctagccagaaaagaaaatagtcttcagttcagagcaagaaaaccctttattctagaaatgttggatttgcttagctgatgcattcaggatcctgagcaggaatcctgggtaccaactagcttctgaacaggtgcatcagcctctccgacaccctagtcccagcttcatacttttcctaaacaaaatcaggcccagccacttccagccttgccctgagcaccacctgcaggtcatctttcttcacagcctccagtggctgccgctgctgtgccttttccctctgctgtcttgttggtgttactctttcctcttcctggacttggcagacaggctggtcattggagacctcaggccacctggtcattggagtttcctgtggtgggaaaggagaatgctggaggtggttattgcagtgggcatgagaaaaggagcaggaaggagtgtatgaaagccaagaaagcaaaggagatgggattggcagatttccctgaagttggttccagagtagccagaagaggaggacattttaaagaagggtttaggctgctcttctagaagaaaactcctgtctcttgctcctatgatccaaggtttcagggattattttagatcctccaaggactagccttttgtttggccccatacagctgccagaccagaatttttgtgccatggatttcatgggttgctagcaagccttgcctatggttcttgtcaaagacctgtcactctagtctgcctttttatttttattttttattggtttttattgagacagttcgctctgttgcccaggttggagtgcactggtgtgatcttggctcactgcaacctccatttcctgagttcaagcaattctcatgcctcagcctcccaagtagctgggaccacaggcatgcaccaccacgcccggctaatttttgtatttttagtagagatggggtctcgctgtattggccaggctggtctcgaactcctgagctccggcaatctgcccacctcagcctcccaaaatgctgggattacaggcatgagccaccgtgcccagcccataactgcctgtttagaaaattaactttgctacttcattcaacctcaggggacaagaactacaaagagatcagtagagcttaaaccccattaatggagtctctctgaatctattctggttgggggatggaaggagtgtctgattcaaagtaataatttaaaagacaccttaacaagagagattactgaaagagaggaagaaatggatccccaggagccttgtgagatgggaacaaggctactattcacttatctctgaaatgctacacaacactgagaaggacctgggtttcctatgtgggccctggtggcctgggtagggactgtcaggcagggctatgagatagaggccctgagagtatgggatttttttgtgctgatcgggagaaacgtggagaggtggtgtgataggaggagctgggtcaccccattttattatatgtcatgaaactggcttccttctgcatgacctctaaagtaactactcccagtgctgagtagaaggacactgtaaataggacaaagaaagtcttgatgtggtgtcggaggctaatgaggacagaagaaaaagaggaaacattcacaattagtaaaagacttctggcttatcattgcaagagaaatgtttgggggccaggcacagtggctcacacctgtaatcccagcactttgggggtccaggcaggcagatcacttgagcccaggagttcaagaccagcctggacaatatggggaaaccccatgtctataaaaaatacaaaaattctcctggcatgttagcacacatctgtagtcctagctactaaggaggcttaggtaggaggatcacttgagccccagaggtcgaggcagcagtgagccatgattgcaccactgcaccccagcctgggcgatagagcaagaccctgtctatttaaaaacaaaaaaagaaaaaaaaaagtttaggttctcagccatcccctgagctttaggctcaggaactctctgatttcaggtaccaagaaagagaaaatgggctgggcacagtggcccaagcctgtaatcccagtactttgggaggccaaggtgggtgaatcacctgaggtcaggagtttgtgaccagcctggccaacatggtgaaaccccatctctactaaaaatacaaaaattgctgggtgtggtggcaggcacctgtaatcccagctactcaggaggctgaggcaggagaattgcttgaacccaggaggcagaggttgcagtgatccgagatcatgccactggactccatctggcctggatgacagagtgagactctgtctcaattcaaaagaaagagagagaaaaaataacaacaatcttataattcctgtgactaaaattagggggtgttcctgcattacaccatgccacctctggagcaactttctctgtcactcacaaagctttttcatatgcctgccctttccccctacttaggctccccctttagaactaaacagctctggaaaggatccttcagagcagacctagggcaggagctaggcaagacccttgatggtgacaacttatttggctatttctcgtggctatttaatacatgaatgggagctgagttccctgcttaatagcatttgtgttcatttccagcgtggtgccggttgtctgacctctagcttctcccctcttattctgtacagctgaaattctccctcctgcctaccccccagctagtcagcctccagtcctgtttagtttatcttttttctctcctaatgcctgttaagctggaaacaggattcttgctcgtcgtcatattattttaaataagaatgaaactaaagaagaggtctttgggccaggcatggtagctcacacctgtaatcccagcactttgggaggccgaggctggcagatacctgaggtcgggagttcgagaccagcctgaccaacatggagaaaccctgtctctactaaaaatacaaaattagccaggcgtggcggcgcatgcctgtaatcccagctactcgggaagcctcaggcaggagaatcgcttgaacctaggagacggaggttgcagtgagccaggatctcaccatagcactccagcctgccaacaagagcgaaactccatctccaaaaaaaaaaaaaaagtcttcaatctgctgtaatgtggcactcagatatgagtattggcggcagtgagtgttcatttcctcctcctgctcccctaattcagttgcgcctgaacacaaaactccaaaagcaaccagagagagaagctgtgttgaaagatgaaaggagaaaaggccacaagctttggccctacctggttcttgttctgagtcaaaaactcttgtttccaggcccctcgtctatgaaattagtagatttatactagtgattcccagagtatggtcccctgctcggtggtgtttaacttcaactggggtcttgttagaaacacaaattctcaggccccactctgggcatacaaaatcaaaactttgtggtatgggtccagcaattgagaaccacagttttacccagtggattttgtgttgaggagctcattaaaaccagttatggggccgggtgcagtggctcacatctgtaatcccagcactttgggaggccgaggcaggtggatcacctgaggtcaggagttcaagaccagcctagccaacatggcaaaaccccatctctactaaaagtacaaaaaaaattagctgggcatggtggtgggcgcctgtaatgccagctactcgggaggctaaggcaggaaaatcgcttgaacccaagaggcggaggttgcagtaagctgagatcacgtcattgcactccagcctgggccacaaagtgagactctgtctcaaaaaaaaaaaaaaaaaatcagttgtgggcaaaaattctcaggtagctcaaggagccacgggttagggaactgaagaggaaaaactgtctctcaaagctagacaggctgccttaccttttatctctctcctctccacatcacttaatctttcctttttcgctggagcagatcccacccatgagggcacagcagagggcatggagaacatggcagatgctgtcacccatgctcgttttgtgggcacggatcctgccagtgatgaagttgtcctgatgaaaatccttcaggtaagcgagagggaaatagcaattaggctaatggccaggggctggtgccgcagactctacttactctgcccacagcatgaaactgtgttttgactccactggggcttaggggagctactttgtttccagacaagcagctggggtacccaaagtaaaagctttttctaaggaaaatcagtaaaagctttatatgaagtgatgtcaaataccagaagccttaaatacacttgtacctctggccgactgtatttgtgccgtccatctcttgggctcatgggctagggctagaatcagttctgaaatatgtcagggtcataaaaagtgaagaaacaattccaaggacaagcttcttggagacctctctaccaagctgaggtgaggtcagcattcttgctaacccctctctcttacccttgagtacctctcagtaccttgtttatcacagtaattcctttttcttcctgataggttctacggactctgctgctaaccccagtgggtgcccacctaaccaatgaatctgtgtgtgagattatgcagtcttgcttccggatctgctttgaaatgaggctcagtggtaggtgcttggatattagccccttcaccattcctggggccagtgtctgagtatgaatacaggaggctgtcttcccagagagatggaaaattcaggacttctccatcatctatctcatgcgatcataggggtctagaagaaatgtctgtacttggctattgtgaagctagaatagagacctcagcccattatgccagggcaggagttgggatggatcccagattgacttagcccaggcaccaaatcaccctctcttggggtttctgggattgacaccaacctgcaaccccctagaacacatctatacctccccttttttccctgactcagtagtgccacctagtgggccagtgaagttctggctgccaggctgagctggagctggttttaataagtttggcataatccttggtaaacaaggtttggaggggagtctgctctgagaaccctcttgataatagcacagcaagtaatgacacctgtgttatttgtttttgcctgtgcagagttattgagaaaatccgcagagcacactctcgtagacatggtgcagctgctcttcacaaggtaaacctgctgctgtttgcttcagcccggctgcccaggcctcttgagtctgcctgcttccacacagccacgtcagggacctggccaaccccacagccgcatcagaggccactgggattatggatggggggtagttctctgggcccagggttactgagcaagggagaaggaggagggagctgatttggcctcacggggaggcagagggttatttaatataggccagcagacctcattctgcttcccaaatttgtgtctgtttctgtgcaggtagcagctgggaaagggaacccagagaggaagccaaactcaagggatcatgatttctgtgggagagggccaaaattagggtgactagcaattgtgaattgcctgggactgtcctgatttcagcactaaaagttctgcatcctggcaaacccccctcagtcccaggcaaaccaagatggttggttaccctttggtaaggcccttagcctagggcctaggaggccttttcatactaggcctgtttcctgcacctcctttcaacagactcacagaagagctgaggcaatggctttaaaccttcctctgggatttctttttgctctcaaatctatagataataatccttattatctacagactagactgcccttggatcctgctgcaaagaattttttgctcctcaggctcaaatttactggtttcaaaacttcaacctgcctgttaattcttctcttttgcccactctcctagggttttgatagactgccctccccccatctcttggcagcagtatttgccaagtaaatataagcaggaaggaatcagtctcaggataaaaagagcctccacactccaagggcacttaccttgctctcacaactacctccttttgtccatgtcacacatcccccgattcctgtggctctttgatgaagctctgaaaaggatgaaattagtctgcttctcttttgtagccttttctaagacacagggcatgctctggctcagagcacctttggtttgtggctggcatggagggagacatttgtcattatccctaatgacagttgatggattttctatcttataggttacctcagtttaaagaagaacccaagaactatgtggggaccaacatgaagaaggtatgatctgagagctgatctgctgtccctcatccaaaccttaatctcccaacttcagtgccttggggtaaccttgcttagcaaagatatgcttttgcctaaacaggtctgcttggaatctagaagtagctctcactcctttcgtgagaaatgtattctcttccagatatatcccttcctcagcttttctgctctggcctatctttgaaccaccatgtaagctggtgagccagttcttcatggaaactgcatggtacccatcagtcttggctaaaaatgtctgttgacaaagatgaaagtcctgccatcccctcaagacttagccttatccgcaggtagaaggcctagagaggctatgtcccaaatcctacctcaatgctgaattagactgggctcttgcttgtgctagtctgtattgaagagattagtcaagttaagaaccaaagggttcttaaactgctaggagaagaatagtggtcaaaagaatggcttctttctatcttgaactgaagccctggacttcacgggcctctgatgaggattccgcttgcagccctaagagggtctacctatggagatgacccttagctgtgtgatgcatgcacctgaccttctcctctcccctgtcatccatccccattcctgccctgttccctgttggtatgtgtctgagtttatttcactgttaaatcgtgcgtttgcctgtctttcgcagatatctccatgtctcctcaacaaactggagctaagtagtggggagcagaccaaagccctgaaccagttagagagggtactactctttaagaacctcaaggtctctctccctctctttcccttcccctttttatttctttcaatgtttattttttatatataacacctgggtcccatttccattgtgtagagcacaacttactcctccctagtaacacagcacggctttggaagagttgcacgtgattgtagctttgcagtgttgggaattctcctggggcatctggttgcctggatacaggagaaggaagacttgaacatcacatagttagcctagaaagcctggggtctgctgttaccttgtggggaggcttaagatctaccatttctagggaaaccgtgagggaccttcaagcaagacccttcccccttctaccttatccttgtctcagagctggcatagagagcttaagcacagtcctcagctctatctggattacctggactgggtttggagggaaagggtagtccatctagttgggatcttttttttttttttttttcttggttaccattaaagaggtcattccaaggattagaactctagattgatggaaagaagccaggtgccaggatagcccaggacactgggaatactttgggatctgtgaagatgccctctgtcctctaaaagtcaaggtataggggagcttaggggagggatccaagctaaagattaccctaatctgcatatacctgccttaggaagaaaggggagagaaggaggtgtgggctgtctgggctgtccatcacaagagtgtgcatgctgaaggtgtggttgtggacatacaggtcactgaaagtaaaaaactctgtgtatgtacacctagctagatagtccattggcccgtgttctctttgaatgcattgtgtcatttcatttgtgtgcttgcacagtctcaagctgcagctctcattagtggctatccagcatgttgccatgattattaacctgggacctgctccttttttgtaaagcttacactgtcctttggagtacagagtcatacagataaggtggcgtagaattccatgaatacctactgcccaccccacaccttcagaccttaggagagggagaatagctataccttttaagggctgaggcattcgtgagaactggcagcctcttggcccctactccagccagcaggctgagaacactaattgaaatgatcaggttggagcaagctttgcagaagatagagaaggaaacgtgaaaaactgatcctcgtatgggaaggaatctcaatgactgactggcttctcagtggaagtaggactgcctggagtccctgaaatgggggagcctcctggagagaaaggctacctcataaaagtagatccagttcttagtacttttgggagctcaatgataactgccagtagagccaggaggtctctcattgatctcttggcctcttgcccttttgcatgtttggcggactcttctcccataacattttttactatgaacttgatccagttgagctccagtggttcctggggagagaatccttttgcttcctccttagctatagcggtcagtacgcctgaagctcagttctaagcatatgactgcaggcattttggagatggatcatctagaagtataaatccagtatgaggctgttgctatgttactaagagctgggggaaggaagggctcagctgttcagcctcatctttattggaaggagctatgggtaggaatggaagaattgtgtggtttctaagcaaggaatcaaagattacccaggttctgagagcttgggggagcttgaggaagggagtcaatccctcactatcaaaaggaattgaacaggccatggacaataggatatattcagcctttaggaagaggcagagagaaaaagtgcttctgctctctttagagtcattctaatggtttctggaagagtgttgccattgcccaatccaggaatggtccaatccaagaatggtctatcagtctaggaatagtttagaatgactttgtagagggactgagttcaaacccaactgagaaaacatcagggcttaaaaaacaaattgggccgggcacagtggctcacacctgtaatcccagtactttgggaggccaaggcgggcggatcacgaggtcaggagatcgagaccatcctggctagcacggtgaaaccccgtctctactaaaaatacaaaaagaattagccaggcttggtggcgggcgcctgtagtcccagctactcaggagactgaggcaggagaatggcgtgaacccaggaggcggagcttgcagtgagccaagatcacgccactgcactccagcctgggtggcacagtgagactctgtctcaaaaaaaaaaaaaaaaaaaatggggcctaaacaaagtaactttgaacttagaatggaggaaatacataaaaacacagatcctagggaatagttaacaaacaggtgatagagattgtcccttgccactaaaagtaagctataggaagaacagaaatacagcaagaggggagtgcaacagagcaaggagtcaaggaatcagtggccttaccatctgacaacataaaactgcatctggaaagaccaatagtgagagggccagagggacaggtagtctcattgatataacaaattgggagcagcagagagcacagcagcagcgtgacatgaccttctatcctgaactccacaaagaaactgggaggccactccttccttaactccaaggaatgagcttttgaccaatctgatacagaaattccagagagtaagagatatgttagctgggtgcagtggctcacacctgtaatcccagcactttgggaggctggggcaggcagatcacctaaggtcaggagttagagactagcctggccaacatagtgaaaccctgtctctactaaaaatacaaaaattatccaggcgtggtggtccacacctgtaatcccatttactcaggaggctgaggcaggagaatcacttgaacccaggaggcagaggttgcagtgagctgagatcgtgccactgcactccagcctgggtggcaaagctagactccatctcaaaaaaaaaaaaaaaaatatgtttatggcttaggcccagctcacataccagtaagaaaaccaggacaggaaggaataggctcttatagttggataaaactacaagtaggaggctgctctacaagctagttgaggaggaaagccgagagaccatgcacctgtagaactgagtgtcagggcaaaggaaaccctgcccttacactttctgcaagagggtcatgcatcatccatagggctcgggatttcctgcttaatgtaacactcaggacccagagaagcagagtgataagtgtgaggactggccctaccaatgaccagcccagaaacagaatgtcaccttctacatggaggctgccatgccaacctgtgaagtggtaaatgtagaagccaagttagaagagtaggaatgtgaactgatggtctagagtcttactttagcaaagatatggggtatagcttgttttctagagatcagtaggactaaatgaagggagattaatagggatagagtcttagtttgaataccattgctaatggggtatgatatttccagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtgagtgccctggactacttcctctgattagacaaaagaagagctcctttctctcttagggattttgaaattgaagaccaaccaactgaggggctttggtcttggcgctgagaacaaaaagggaaactccaggtcaaatcagagtgtgaccattcagcaactatgcagtgacttaaggttgttctctgacaactttagagaccaatatatgcaaagataagcatgtaatctgggaaacagagaccctagtaccatagagggtttgttttgcccacagcctctttcttctccttcaagcgtcacatacttttcttggcaggtggcatgcccttcattgatgtgcccactcccatctcctctgcaagttcagaagctgcctcagcagtggtcagtccctctacagacagtggcctggaattctcctcccaaaccacttccaaggaagaccttactgatctagagcaacctggctctccagggtacagcacagctacagagcctggaagcagtgagctaggtgttcccgagcagcctgacctccaggtatggctttgatttttaatgtccctcttcagtattccactgtgggaaatggcttgatcctttggatcctttatgcaggacttggctcgaaagaagcttggggtaacttcaaaagaagctctgatctttcctgcttctcagaattggttgtactgccttgaaaacccacagcatgactcactgtgagagatagctcatgagatttatcaagttatgcatataggtagtacttgacaaaagggaaggagctggccattgctttttctggaaggtaatgatccaaatcctaagcctgtgagaggctctgtgtctctaaggttctagtcattgtaggtcagtgaagcctcaggagatgtttttctgagtccttcatcatactcctacctgagccatcttgcggtgattcataaaccactgagttggccctacatctgtagcccattagagacagcttggaagacagctacttcaggggagtaagttccaagttgctcttgcctcatccctcttcccatatctccctgctactggtcatagcaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggtgggtattctggtaggctctgccaattcacctcccccatcctacctactaagctgcctgagcctagaccgtcttaaaccaagatattggactactgcctgttgctccaagttctaggctattttctagtcaggaaatggagtcaagccatagactgttggcatggagggagcccttccctaacttatactacagggaggaagtttgatgggcaataggaagcaagaaggaagggaaaaaagcttaggacttttaacagaaaggtaggatcatcaattctgatttcctccagaagtagactagtcccctcatgtccccaggaaaaaaaaaaaaatccttttcctttttttttttttttcctgtcgcccaggctggattgctgcagtggcacaatcacagctcactatatcctcgacttcctgggttcaagcaatcctcccacctcagcctcccaagtatttgagactataggcatgcaccactgcacttggctacttttaaaaaatcttctgtagagatggggtctctctgtgttgcctgggctggtctcaaactcctggcctcaaacagtcctcccaccttagcctcccaaagcactaggattacaggcatgagccatcacgcccagcccttttcttcaaagagaatcacttacctaaaattgccttgtgtaatgcagagcaggctaggcaaagccagcagactagttgttttatagcagtctcactctcctcctggccttccccaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccaggtaagacaagattgctagagggtctcagagcctctttcaagggccaggggaacacagggaggtctggctgattacgcaaagagtataggacctaggaaagcatctccctcccagttggctagtagttttagtaagagggttccagtagttccccagggactctggcagccagagagaaatataggaatggctagatgtagagttccctggaagcaatggacctcagtgacaccttcactcagtttgcctcttctgcctctcttggttgagccatagtcagcttcagaaacctcacagccgggctgggtgcagtggctcacgcctgtaatcccagcactttgggaggccaaggcgggcggatcacgaggtcaggagattgagaccagcctgaccaatgtggtgaaacccagtctctactaaaaatatcaaattagctgggcatggtgacgtgcgcctgtaatcccagcttcttgggaggctgaggaaggagaatatcttaaacccaggaggcagaggttgcagtgagctgagattgcgccactgcactccagcgtgggcaacagagtgaaactccgcctcaaaaaaaaaaaaaaaaaactcatggcctaccctgctctcatctccagctactcagcatagagcgactaaacctttatgctgcttccctgcgagtatgcttcctactgtttgagagcatgcgagagcacctcaagttccaaatggaggtgagtttcttgatgtggaaagaaaagggggaaaaaaaatagggagatatatggcatcttcagtggggccagctctatcatgctacaggggtaggatttagggacttcctataggagagtccttttagcctccagagttcggttcaatcaactggcctcttttgtggaaaagttaaaaggagaccaaaggaaactggctgaccccaaatatgagaactgccaggtaaccttaccatgaatagggacagctcttctgcccagcagttactctgcaacacaggtaggtaagtcaagccagcattgtcactaaattgctaaaaggaactctaaataggaccaggtcatgttcacatagcacaaaagggcaagaggcaacttgtctgggaccaggtatgtggtagagagccaggccttatcccccaacatggaggccaaagaagagatatatttaggggatggaatacctttgggtgtctcttaatacatgcctctaggctgggcttctgcatcctgtttaatgtttttcctgtctaattttttctcttcctatcttgaatcctttccccacccaaatggcaattactgggttattgccagatgtacatcaaaaagcttatggagatcatcactgtggagaaccccaagatgccttatgagatgaaggagatggcactggaggccattgtgcagctctggcgcatccccagctttgtcacagagctctacatcaactatgattgtgactactactgttccaacctctttgaggaactcacaaagctgctgtccaaggtgctgagcactataactggcttctaggaaaaaacgcattataaaggaaatctccctggtggtagtgaggatgttacatacagagaggggaacacttgagagctgggaaatagaagaaaggcattttcttttcttttcttttttttttttttttttttttttgagatggagtctcactctgttgcccaggctggagtgcagtggcgcgatctcggctcactgcaagctccacctcccgggttcacaccattctcctgcctcagcctcccgagtagctgggactacaggtgcccaccaccacgcccggctaattttttgtatttttagcagagacggggtttcaccatgttagccaggatggtctcgatctcctgaccttgtgatccacccgcctcggcctcccaaagtgctgggattacaggcatgagccaccacgcccggccagaaagacgttttctaagggcaatgtacaagttagaagaagttttggaaattttagaaaatgatcaaagtgtaaagtgttctcctaactacaagtccaattgatctgtttactttccagaatgccttccctgtgtctggtcaactctatacaacacacctactatctcttgatgccctattgacagtgattgacagcaccgaggcccactgccaggctaaagtcctcaacagcctcacccagcaagagaagaaggagacagccagaccaagctgtgagatagtagatggcacccgagaagctagcaatagtgagaggcatttctttctttgatgaacccagtgttctatgcttatcccttctctactctctgagtcgtttttcctgtccccatatcacttcccctgggatgctcccaattctgtttctgggctttggcagtttaaatcacaggccagtcaggcagattagtagaactcatagccttctccctttttcctcctccccactttggttttttacagaattattatttctttatggcaagagaagagaacagagattaaagaatataggatttctgtctctgaaagctccaggtcccaccatccctcatccccaatatctgcctccactctaattagtcctctctagctcccccttgaaatttgaggttgcagaagatcagggaaagtgactgggtaatctcttcattaaattagagaatctaatgcttggctgggacagggactacttattttggcttgggtttgtcctgctcagggctggcgccctgtgcaggaaccatgcaggtcttctgggcttgggatttgatctatcctgcagctctgcttggcttcataccctataagtcttcacgtatcttcttctctcttaccagctgagagaactgccagcgatgggaaagctgtaggcatggcctcagacatcccaggcctgcatctgccaggtggagggcggctgccaccagaacatgggaaatcaggatgcagtgatctggaggaagctgttgactctgggggtgggtactgggtgtccatgaccctaagctcctcacctggagggcctggtgaagagcagagggagggagcagacacctaggatagtaactaagcaagccttggtagcccgcctcgccttcagactcagagagagggaagcaaacatatggaccctcagttgataggacttccagggaagtggaagactggtgaggacaagatttctgaggctccttcttgaaactggggagtatattggtgaccttccaaaagtccttatctgggtaaaaaaaggtgttacagatatttcccccctcttcttcctactcctagctgacaaaaagtttgcccggaagccaccccgattttcctgtctcctgccagatccacgggaactaattgaaattaaaaacaaaaagaaggtacatacatgtattccccagcctctgtccacctctgtctgggtgtccagtgttgtagggtttccatctcagaagatgaaggagagtctagcacctcattgtacagcttcctgaggccagtctttgggcttgttgggacttcagcaactcccatttgaagcccttcccttactcctaagctatgtagttgagcataccctatgtatgcccctgcgcaaatgctgtaccagttgagagccaagtgtcactagtggcagtgacaggagccttgggagttggtgtcttgtgggtcattgaaggttactgtcatctccagctcttgcaagatgattggcaataaagggaaattgatattcattctggtgctttagtaaggttcaaatagtaaggttcaaataactgtttgtactttggatttctttttttttttttttttttttttttcagacggagtctctctctgttgcctaggctggagtgcagtggcatgatctcagctcactgcaacctccacctaccgggttcaagcaattcttctgcctcaggctcccaagtagctgggactacaggcgtgtgccaccatgcctggctaattttttgtatttttagtagagacggggtttcaccgtgttagccagggtggtcttgatctcctgacctcgtgatctgcccaccttggcctcccaaagtgctgggattacagtcgtgagccaccatgtctggcctgtactttgggtttcttaacacaaagaaaacctaaccctttctggccgggcgcagtggctcacgcctgtaatcccagcactttgggagatcgaggtgggcagatcacctgaggtcaggagtttgagaccagcctggctaacacgatgaaaccccgtctctactaaaaatacaaaaattagctgggcatggtggtgcatgcctgtaatcccagctactcgggagactgaggcaggagaatcagttgaacctgggaggcagaggttgcagtgagctgagatcacgccactgcactccagcctgggcaacagagtgaaactccatctcggaaaaagaaaaaaaaaacctaaccctttctttctcttattgccagcttaaatgactttggttcatgtgtgcccttgagtacctggccgtgactggacatacagaaatatgagttgcctccacagttagtccactttgtctttcaaacccagggcattaagctaggcaaccaaagaagctaagctaggctaaaaacaagaggctggctatcaacaaatgtcagggatggatataaaactggagagaagaattacctagtttctttcttctacttttcccccaatcctaagttagagaagaggaactgttttatgtatcttgagcactcaggaaaggagtaaaaaagagctcgtaagccaattcaattagacatgaagatgggggaagctaaggccattatgatctagccttagttctgtaatcactaagaaccacatcctaggagctttttagctgaccaactgtgggtgggctatggtggactccaggctggccttgtctaatttagaggcaaagtagcttctatacctctagtttttctcatgcagctgctaatcactggcacagagcagttcaatcagaaaccaaagaaggggattcagtttctgcaagagaaaggcctcctcaccatcccaatggacaacacagaggttgctcagtggctccgagagaaccctcggctggacaagaagatgattggagagtttgtgagtgaccgcaaaaacattgacctgttggagagctttgtgaggtgaggaagctgtaagaaatgtgggatatagccaggtatggtggctcatgcctgtaatcctgacactttgggaggctgaggcaggcagatcactcgagctcaggagttcaagaccagcctgggcaacatggtgaaaccctgtctctacaaaaaatacaaaaattagctgggcatggtggcatgtgcctgtagtcccagctgttcaggaggctgaggcaggaagatcacttgagtctgggagttcgaggctgcagtgagctgtgatcatgccactgtgatagagtgagatagagtgagatagagtgagatcatgccactgtgatagagctgtgatagagtgagaccttggctcaaaaaaaaaaaaggtgggacatggttagtgatcagtttaaagggacagaacatccctacctcaaagcggtctctataaatttcttctggagaccctagccaatgttcttcctctacccatcatttatatctattggacctgaaagggactccaacgagatagtttggggagccccctccattctgcatggagtccattccaaaggggtagagcagggttccagggggtgagggttctaggcaagagtccgtggatgtgaaaagtattaaggctaggggttgtgttagggatgaacaggagatactgcccctttactagagacctcagcctcctctcttccagtaagagtaggttaggaggacagtgactaaaagagcctgacatgtgcagcttacacattttcagcctcttcttcctttctttccctatagcaccttcagttttcagggtctgcgactggacgaagccctccgcctctacctggaagccttccgtttgcctggggaagcaccagtcatccagaggttgctggaggcattcacagagcgttggatggtgagtttgagtgtcaggggctgagcccaggatccaaggtcagtttgactgagggctgaagaatccagctgctgtctcttttttttttttttttttttgagacagagtctcgctctgtcacccaggctggagtgcagtagcgcagtctcagcacactgcaacctccaccccccgggttcaagcaattctcctgccttagcctcctgagtagctgggatttcaggcacctgccaccaagcctggctaatttttgtatttttagtagagatgggttttgccatgttggtcaggctggtctcgaactcctgatctcgggtgatccgcccacctcggcctccctgagtgctgggattacaagcgtgaaccaccgcacccagcctgctgtctcttaaaaagtcagagagcaaaattagtgacctttccacaaagagatcagcttctgttaaggagttggcaagagactggccactttctggatggtacctctcctctgtactagcactgaccagtgggttggtagtgagggtttaattggccagagaagggcattgacacaggcgggatctttgctttttcagaattgtaatggctccccatttgccaatagcgatgcctgcttttccctggcctatgctgtcatcatgcttaatactgaccagcacaaccacaatgttcgtaaacagaatgcacccatgaccctggaggtaagcttgggtcccagtcaaggcaaagaagacccagcacagcttgggaggtagcaggaaggacataggatttccagtgggcatgatggatggggttctgtccaagggaatcaggaagggctggccaacctagaaaagggactggggtggggaagtgggttttttcgcttaccttttcctaagtcctatttactgaaaacccaggagttccttaggtggggcttcagtgttgacacaaggggaaaaaacttactggcctgtctctaggagtttcgcaaaaatctgaaaggtgtgaatggaggcaaggactttgagcaagacatcctggaggacatgtaccatgccatcaagtgagtatacatagagaatagtgcagtatctctgttaagaagaagcacattgcttcctttcccagtttttagagtcatgtcagactgcagtgactcacatgccctggatttagcctcaggacttagttgggcagccccctctctgccaactgtttcttccttaaagaagcccaaatgatattgggactctagtactctaagccagggtccaaagtgctgctcttaagtaggatatcatggccccattttctgaacttaaaacaggtacattttcctgtatagattacaagatgctggctggtagagaacccaagatgggcactggagtgtgaggcccaggttacaggtcagaaatgggccacttagttttttactgtaaatcagaaaaggtagaattgttcattttatcacacctagtaagaatgtgtgatcttactatagaactaaaggcctcacttacagatagggctttgagattatgggacacttcctttctttctgtctgctcccactggtgggtggaaagcagaccactgagctgcagttctgatgacctctcatcagtggagagtgctagtatggatgaactcctagtcttggtttggaactagtcaggttcaaagcagtgcaactgctccttcccttacctcctgacaggaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggtagcccagctttggccttggtcttcacctcccactagctctgtgagctaacatggttttctccatgcctctctgactcctactgttacttcattagaatggggttccccctgagtttttggagggaggctgaagcttgggtaggctcagtcttaaacagaaacaaaattaaaaggtttcttcctgggactgactggggaagagccccatgcaagctcagggacttggaagggctgcttggccttccagtgactctgtttctgggatggggggtaacattacaggaagtgcgccatgatctccgcccactatggcctcagcgatgtgtttgacaatctcatcatctctctatgcaaattcacagctctcagcagtgaggtgagcaggtgcaggaactgtgtacttggagctccaaaggaggacctctcttttagccatggatctacccttatcaacagacctggttgccctcagcgtcttccctcactgcccccacttgaatataccagagcttaggccatttctgtcttgcacactctgggataaaactagtgttacttcatgtaatggggatgggaaaggagatacaggagtggggaaggccttaactaggttaacccactcccaccagtattatgggggattgaagcagagccaacaaaaggacctgagggaaccatcataggcagagacctaagagattttcctttccagacattagctcggccttaagtctgttctcttcctcttttccagtctattgagaacctgcccagtgtatttggaagcaaccctaaagcccatattgcagccaagacagtattccatttggcccatcgtcatggtgacatcctgcgggagggctggaagaatatcatggaggccatgctgcagctcttccgagcccaactactgcccaaggctatgatagaggtaattcttagtaggagactagtgagcgataacaaggcaagagctgcaacattgtatgctacctgtacatagaagtaagtggttgagagtaatgttgggcctgatgcctgccacagctcaccaggaatgcctcaaatgtaagaccacagatcttgggggatagctgtaaaagaaggctggtagatgccattgccagtcaccaattggcacaatagcataggggcagaagactagaggaggaaatccagagaactttggtgggtggaggcgggcacaaatgcaaaggacacatggaaagaaattattttgacttacttttccaggtagaagatttcgtggatcccaatggcaagatctctctacagcgggaagagacaccatcaaaccggtaagagcagaccagaggctcaggggcttggggagggagagtcagaactttggggctcaccaggccatgtgccctttttctacagaggagagtcaacagtgctgagctttgtgagctggctaacactgagtggtcctgagcagtctagtgttcggggcccatccactgaaaaccaagaggccaagagagtggccttagagtgtataaaggtaactgcccatccacccctggtgagaaagcctaaacaccttcctattagatgctacttggtgaactgaagaataaatcatccaggatttgtaaccagggctgactctgccctctccccctggctcttggggacattctgttctcttcagcctttgtcaaagaccccctctctcttttgccctctctagcaatgtgacccagaaaaaatgatcacagaaagcaagttcctccagctggagtcactacaggagctcatgaaggtaaaggatgaagaaaggaaacatggaacaactggctgaatctgggaggggtgacagggacagtattatttctgtcagggcagggccagtggttggcttcttttccatgcctactttcctgctgctgttccccttcaggctctggtctcagtgacaccagatgaagagacatatgatgaggaagatgctgctttctgcctagagatgctgctaaggattgtgttggagaacaggtaagatgagcgtagtctttaggcagaccccatgctgggcttgtgccaaagggatggaagccatcttgctgagtgggctctggggaactgtaggcagcaggggagaagcttactcatcatacctgtctacttagggtataataccaatgagtcctgaaaggcctaggggacctgttgcccagtggcccctctggctgagactatcttcattcctttatgtctacacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtaagcagaatgcatcttggagagtgggcaggtatgcaagggattaaggccacagttgtcaattatgaatatggcctgagacagagagtacatttagtgccccatagcatgagtccagtgaccaaccacagggctggtgcagtctagcgggtggtactgggagtgagcctggaatggcctcaggcatggagcttgtgtttggcacctcagcctcctatgaatctgctttgtaggactggcctgctactgccttataatagtctcagccctatacctggtttcctgtcatgcttatgaccctcttgagatctctttgcttaactacaaaaaacaacaagcatagaactaataagtggattcaacaaggtcacaggatgtgagatcaatacacaaaaagtaattatatctctacatgctaacaatgaacaatatggaaactgaaatttaaaatacaataccatttacaagggttccaaataaagtgaaatacttaatatatagctgacaaaacatgtataagatttgtatgatgaaaactacaaaactacaaaataaattgaagaagatgtaaataaatgaagaggcatactatgttcatggattggaaggctcaacatagtaactttgtcacttctccccaaattgatctgtaaattcaacataactcctataaaaatcccagaaaggttcttgtagacataggtaagcttattctaaaatttagatggaaaggcacaagctctagaatagctagaaagaataaagtggaaagaatcactctctctgggccggttgctgtggttcatgcctgtaatctcagcactgcgggaggccacagcgggcagatcacttgaggtcaggagttcaaggccagcctggccaacatggtgaaaccccatctctactaaaaacacaaaaattagcagggtgtggtggcacacacctgtaatcctagctacttgggaggctgaggcaggagaatcgcttgaactcaaggcggaggttgcagtgagctgagatcgcgccactgcactccagctgggtgacagagtgagattctgtctcaaaaaaaaaaaaaaagaatcactctggtattaagacttactgtccactttggggggctgaggcgggtggatcacgaggtcaggagatcaagaccagcctgactaacgtggtgaaaccccgtctctactaaaaatagaaaaattagctgggcgtgatggtgagcgcctgattgctactcgggaggctgaggcaggagaatcgcttgaacctgggaggcggaggttgcagtgagccaagattgcgccactgcactccagcctgggcaacacagcgagactccatctcaaaaaaaaaaaaagacttactctcggctggacacagtggctcacgtctgtaatcccaacactttgtgaggccaaggcaggcaatcacctgaggttgggagttcgagaccagcctgaccaacatggagaaacctcgtctctactaaaaatacagaattagccaggcatggtggggcatgcctgtaatcccagctactcaggaggctgaggcaggagaatcacttgaacctgggaggcagaggttgtagtaagccaagatcacaccattgcactccagcctggacagcgaaactctgtctcaaaaaaaagacttactgtatagctatagtagtcaagattatgtggtgtcgatggagggacagacacgtagatcaatggaaaagaatagagagaccagaaataagctcaacacaaatatgttcagtggattttttgaccaagatgtaagaacaattcagtggaggaggaatagccttttcaataagtggtggagtgattaaaatccataggaggaaaaaccaaatgaaccttgacctaaacctcataccttacaggaaaattaactccaatggatcatagatttaaatgtaaagctataaaaactttagaaacaggagaaaatcttcaggatctagagctaagcaaagaatttttagcatgtttggcagtcctgtggatctgtctcttgcctcaacactgtctggatggaacagatccgggggagactctctttcaaaaaaagtaataatttttagacttgacattaaaagcacaatctagaaaaggaaaaattgataagttgggctacattaatatttttaaaagttttgttctatgagagcctatgtgaagaggatgaaaagacaagctgtagacgaggaggaaatatttgcaaatcacatatttgaagaaaggtatctgtaatataaaaactctcaaaacacaacagtgataaaacaatccaattattaatagaaaatggacaaaacataggaacagatgtttcaccaaagaacacatacagatggcagataggcacatgaaatgaagatagcatcattaaccatcagagtactgcaaactaaaaccacaatgaggctcacacctgtaagcccagcactttgggaggctgaggtgggtggatcacctgaggtcaggagtttgagcccagcctggccaacatggtgaaaccatgtctctaccaataaatacaaaaattagctgggcgtggtcacacacacctgtagtctcacctactgaggagattgaggtgggaggatcgcttgaacgcaggaggttgcagtgagctgagatcgtgccactgcactcctgcctgggtgacagagcaagactccaaaaaataaaaacacaatgagacatcactacccacttttcagaatggctgaaataaaaagtagtgacaataccaaatgctgaaaggacgtggagaaactgggtcattcatatattgctgggtgggaatgtaaaatggtacagctactctgctggcagtttcttataaaatgaaacatataattaccatacaacccagcaattgcacccttggacatttatcccagaaaagtgaaagcttactttctcataaaaacctgtacatgaatgtttatagaagccttagttgtaatagccaaaaactggaatcggcccagatgactttcaataggtgaataaactgtggtacatacacaccatggaatactattcagcaatttaaagcaacagacatctccagggaactatgctgagtgaaagaaaagccaatctaaaaaggttatgtaatatataattccacttatataacatttttgaaatgacagaactttagaatttgaagacaggctgggcgcagtggctcacacctgtaatcccagcactttgggaaactgaggctggtgaatcacttgaggtcaggagttcgagaccagcctggccaacatggtgaaaccccatctctactaaaaatacaaaaattagccaggcgtggtggctcgcacctgtaatcccatctacttgggaggctgaggcaggagaatcacttgaacatgggaagcagaggttgcagtgagctgagatcctgcctgcactctagcctgggcaacagagtaagactccatctcaaaaaaaaaaagaatttgaagacagattgctaaggattagggatgggggcaggaaggaggaggtgggtgtggttataaaagggcaacatgagctgggcatggtggtgcatgcctgtagttccagctactctggaggctgagacaggaggatcacttgcgcccaggagtttgaggctgctgtgagctatgatcataccactgcactccagcctgggtgacagagcaaaacctgtctctaaaaaaagaaaaaggcaacatgagggatactgttgtggtggaactgttcagtatgttgttttgtggtggatacccaaacctacacaggtaataaaattgtatagaaattaatacacacaaaaatgcaagtaaaacaggaaatctgaataagatcagatagtatcttgattatgatattatactatagttttgcataatgttaccattgggataaactgggcaaagtgtataagggacctttttgtattatttctttacaactgcatatgagcctataattttctcaataaaaatttgtatttgaggctgggtgcagtggctcatgcctataatcccagcacttcaggaggctgagacgggaagatcgcttgagcctgggagttcaagaccagcctgggcaacatagcgagaccccatctttccaaaaaagaaaaaaaaaattagccaggtgtggtcacatgcacctgtagtcccagctactccagagactgaggcaggaggatcacttgagcccaggagtttcaggttgcagtgagctgtgattgtgctactgtgctccagcctgggagacagaccaagaccctgtctcaaataatataattaatatatttctatttgaaaaaaaaaaaaaagaccagagcagtatcctaaattgggtcctagccaaactgtcttcactggcctaaggagactggtgggaaagaaaactagacaggaagctgtgtgcccacacagctccccgcttccccgctccctgccctaaccccactccaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggtaagccctttcccagggagactcaggctggcagataaacagttacaccccaggagttgggacaggaaaacaaaacacaggttactgtgttcagcagattaaacagccctggctcctgccatcacttccagagcttccagtgcccgctggctagtacccataagttaaatagcatgagggcaaataagcaatgcagacggctgtgaagccaggcttcctactgtcctgaggactgatttgtcctgaggactgtttcccagtttctgtttctgagctgtcccgaggactgttttcccagaattctgggaaaatagaattctgtgagcagactttatatcactaaatcgatacatcactaaatcccagaaactgggaaaacagtcctcaggacagtggaaagcctggcttcatagccttctgcattgcttatttgtccttgccaccactccctagagtggtgctacagctgccactagatgccatcaggaacccagattagcctgccaccttatttggtcaacagagaaactgttccggccatcctttggccctctggtgacagaaattaaactatgccagagagaggggaggccaggcctcagcatcttttttctgagagcctgatttatccctcatcccagtgccccatccccaccctgactctgcccttctccctgcctaccataggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggtgagtgacaatatgggcagcaattgagtctctcctgcttgacctgtgggaagaattcctggtcctctgcaaggacattcacacaggggccaagcctgtgtccccagctcctctgtgtactttacaggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcattgtgcgtgatgctgcccacatcacacctgacaactttgagctctgcgtcaagactctccggatctttgtggaggccagtctgaatggcggtgggtcagctgatgagggggcagctggggagtagccatgcaattatgcaggggagaggctgagaggggagaaaaggcagggtatctatgcctatatagacacagaaatgtgacctgagtctggctctgctcaggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacgtaagtatggcaccctttacttcctctcctcccctgcacctgatactgggagcctggggcggccagggaaagccagggctgaggggaagggcccatgtgtgccagcccaggccctggaccaccatcttcacaatattcccttacccaaaaccttacctgtaagtctttatttgcttaaatttatttatttatttatttttatttttatttatttatttatttatttattttttgagatgtagtctctctgtcacccaggctggagtgcagtggcgtgatctcggctcactgcaacctccacctcccgggttcaagcgattctcctgcctcagccttccaagtagctaggactacaggcgcgtgccaccatgcctggctaattttttgtatttttagtagaaacggggtttcaccatgttggccaggatggccttgatctcctgacctcgtgatccgcctgcctcggcctctcaaagtgctaggattacaggcatgagccaccacacctggcctttaaatttatttttaaactaagatttacttattttttgagtaggttcaaaatatacaaaagggtaaactgataaaactaagtttccaatccattcctgtccccagcttctgagttcccctcactagaggcagccactgtcaccagtttcttgtctatccttccagagttaccctgtgtctattcaaaggcatataaaattaattatgtgagcagagtttatatcactaaattgatggagaaccaattgccttaaatagaataaccatacaaaaatgacaaaagtggctgggcttggtggctcctgcctgtaatcccagcactttgggaggccgaggcgggtggatcatgaggtcaggagatggagaccaccctggctaacacggtgaaaccccgtctctactaaaaatagaaaaaatagctgtgcatggtggcaggcgcctgtagtcccagctactcgggaggctgagacaggagaatggcgtgaacccgggaggcagagcttgcagtgagccgagattatgccactgcactccagcctgggcgacagagcaagactccatctcaaaaaaaaaaaaaagaaagaaaagaaaaataacgaaagtaaaaatgtattaaatctggccagacactattgcccaatcaaagcctctgagcctgaggttttctgttttaaaaatgagattaacagccaggtacagtggctcacacctgtaattccagcactttgggaggctgaggcgggaggatcacttgaggccaggagttcgagaccagcctgggaaaaatagcgagaccctgcctctacaaaaataaaaatgcaaaaattatctgggcatggtggcacacattgtagtcccagctactggggaggctgagtagctgagtaggtgggaggatttcttgagcctaggagatccaggaggcagtgagccatgatggtgccatgcactccagttttgcacagagcaagaccctgtctcaaaaaataaaataagaaataaaattaggccgggcatggtataatcacacctgtaatcctaaaactttgggaggactattgcttgggcccaggagctcaagatcagcctgggcaacatggcaaaaccccatctctacaaaaatacaaaaaattagctggctgtggcagcgcacagctgtagttccatctactcataaggctgaggtgggaggatcacctgagcccaggagttcgaggctgcagcgagccgtgattgtgccactgcactccagcctgggtgacagagtgagaccctgcctcaaaaaataaaattaaattaacaacatgaggctttctctgtcatcagcaggtgtgaaatagaattgaaaagaaagtatctttctcactgtgagtaaggattgtgaaatactcagtccacacacctcctaaggctctctctctcatgagtaatctctgacttggagagtcctttacaaggactggaacaaccaggaagtcaagtcaagggaaagagtagcgagggggtgaggtatggcatgattggtgctagggacaccttgaggacttagttagggacagtgagtggggagggggaaagggatccacgagacctaaccccactcacatcctgccccctcctgtgatcctagttgctagacctgatgcacaccctgcacacgcgggcagcctctatctacagctcatgggcggaggagcaacgccacctggagacaggtggccagaagattgaagctgattctcgcaccctctgggcccactgctggtgccctttactgcagggtaaaccaggaggggcagaggtagggagtttggggagcatcaggatcaagatgcctgaaggatcctgaccctgctcttgctctcaggtattgcctgcctgtgctgcgatgcccggcgccaggtacggatgcaggcactgacctatctgcagcgagcactacttgtacatgatctgcaaaagctagatgccctggaatgggagtcctgttttaacaaggtgggacttcctactggtcttaagataaagttcaaatcctaagaaaaggaaagccaggcagcctgaagagcccctaatgtgagtcttcagcctgcatcataccttcccttcagctctatgcccatccagttcctggcttccttggggcaaggctgcctagctgaacctcatagggagacattgcacatttacccccaccaggtgctgtttcctctacttaccaagctcttggagaacatcagccctgcagatgtgggtgggatggaggagacccggatgagggcttccacattgctctctaaggtactgctcaccaccctatacccaccctctctcccatacctgccttttcccgaggagggaagccagggcttctggcaggacctagagatgcactgtaggtgctcacaaccccccagctatggacactaagcaggacctagggacctgagaggattctgaatcttaaatcagagattcctccatctctgatctaagattctcatgcaagataggacaggcttagctacccagcctcagagaggggtccagaggctcctacagtcccctcagctgaagggggctggtgggccataggtcttcctgcagcacctgtctccactgctgtcactctctacctttgcggccctctggctcaccatcttggacttcatggacaagtacatgcacgcaggctccagcgacttactggtatgttctacctcagctctgctgcctgcctcctgtcccacctgttggaaggacttgccctttcccccttggtagctacctccctttaccatactccccccatgccctctttcctattctcatggtcccactgccacctgcagtcagaggcgatccctgagtctctgaagaacatgcttctggtgatggacacagcggagattttccacagtgcagatgcacggggaggcggcccctcggccctctgggagatcacctgggaacgcattgactgttttctccctcacctacgagatgaactcttcaagcagaccgtcatccagggtagggggctcagcccagctttatcaaaaagagtctcctgcctgggcacaatggctcacacctctaatcccagcactttgagaggccgaggtgggtggatcacccgagggcaggaatttgagaccagcctgaccaacatagtgaaaccccatgtctacgaaaaatacaaaaattagccaggtgtggcggtgggtgcctgtagtcccagctactcaggaggctgaaacaggagaatcacttgaacccgggaagtggaggttgcagtgagccgagatcacagcctgagtgacagaacgagattccatctcaaaaaaaaaaagtccccaaagctgaatttattgtctgtgccctgggtgggtagaaaggctgttgggtagctagggctctgctggagagagaaagcactaagaggtgccatctcaattctctaccgtctccagaccccatgcccatggagcctcaaggccaaaagcctctcgcctcagcccacctgacttccgctgctggcgacactaggacacctggccatccaccgcccccagagattccatctgagctgggggcctgtggtgagtctctctagcctagcctgataggcactgagtagcaagcagggggcctaagaggaggcccaagggggcgtgggaatgctgctgagcagggtctgtgagccgagggaagaaggccactagagagaactgttgccgctcttcccatgggaaatgacaggaccataagctatgaggaactagctgcttgcagtcttcaggcttgggaagagaaggctgggtcagggacttggaatgaatttgcagaggtttcctttcagggattctagtagagagtaacctggcggccaggcgcagtggctcatacctgtaatcccagcactttgggaggctgaggcaggtagatcacctgaggtcaggagtttgaaaccagcctggccaacatggtgaaaccccgcctgtaccaaaaaaatataaaaattagctgggcgtggtagtgcacacctataatcccagctactggggaggctgaggtggaaggatcgcttgaacccgggaggcagaggttgcagtgagctgagatcatgccactgcactccaacctgggtgatagtgagaccctgtcgcgaaaaaaaaaaaaaaaaaaaaaaaaaagagtagcctggcaaaggagatagaaggtagctgaacattgaaatgagttttgaggggagactcccaactttttaggctggtggggggccgtgttgcttactggaacaaggaggaacagagactctataagcagccagctgggcaatgtgagagttgtcttgtaccaacaagggaatctgactgtaaccaccttgctttccctacagactttgagaagcccgagagcccccgagccgccagcagcagctccccaggatcaccagtggcctcaagccccagcaggctgagccccacccccgacgggcctccacccttggctcagcccccactgatcctgcagcccttggcctccccactgcaggtgggcgtgccacctatgactctgcccatcatcctcaaccctgcgctcatcgaggccacctcaccagtgcccctcctggccacaccccgccccacagatcccatacccacctctgaggtcaactaaggcaggtcactcagagatcaggaccagtgcttcccaccaggctttccttgaccccacttctggctgtcctgcgggccacaagctcttcaggccaagtcagagctgctgttgctgccacttggatggggacctgaaaaagagaatgttgatagccccagctaagacccccaatcagctgtgggacctttttcctcctctgcgctccattcctgggggttcagcctgagagtgaactcagctgtcatctgcagcctctgcctccagcccggcagctctggggaggcatccgtgtgccggccctgcagtgcctgcccacggtcaggcattgaaaactaagcccaaccactctgcactttgtttcccactcccattagccctgggccacctcctccagttcttcctcttttactaattagttggtcagtttggagagttgactggcaccatggagggtaggcaggtgggggctgggtgggggactgcccacaggagcatgtacatatggaaaaacagaacaacagtggactttttatgatataataaatgtcttagtaccagcatca

SEQ ID NO: 457 - DNA, 3948 bp, Homo sapiens
acacggtatgggtgtagactggacccgccccctaaatccaggagaccatcaactatggaaaggagatctagggaacaccgtcttgaacccgccaggggttttgagtctcggacccaggagatccaaccctgaccaccctcccaggatgcagcagggggatgttaaatcagacttcaggaagaacttccttgctgcctgagttaggtgtcgtcacgcctgcccaggggtaagaggttagacgggatgaactagggaccggaagacgtgggggaccggcaacccttgtgcccttggccagggtagaagggggccctgctattttaagaaagagccgctggagttactatggcaactactctctttgggagggccagggcgggcagatggtgacctcggaaggaagaaggggtctgttcgggcagtcagggggcgcgaggacgtgcgaggcgggggcgcgcggggctcaccgcggggaggggcggcgcggactccgcgtggtgctgaaggggacagcgccagatttgtcgcactgcgcaggcgcagaggcgcgaacaaagaggggagggggacgaggcgcgcggccggaggtggtgcgcgctcacgtggctctatctttgcaggggtctgtcctcccagctaccccctccctaagcaggctgaggaagaagagatagcaagccctcacctaacttgacccctttcttgtctctccccgctgctagcttctcccttctcgctgccttgcggggtggggaaacgtggaaggaattctgggaaaaccagatgtctgggttctctattcccgtctggcttgattctggacaaggggcttcctctccagggcctcggtttccccatctttaaaatggactgatagcatagacctgcccacctttcagaggtgcccgaagccttgacgagataacagatgagaagtggttttcgttgtgatgagccagctgaagcggttgcaccggagcgccagaccgtcagcggtgcagtggctctcgcgtccttcacatccccccacacccatcccgtggatgatgggggaaggcactactcctggggttccccgaagcggatcctgggactgggacctggggacgcggtgagaggcagccctgaagctgagtccagaggtctggggcgtcattgtcccagggcggacccagccccagaccctacaactaaacccaaggccagccgagaagcactaccactggcgggctgagctgagctctcattcttcttaggactctggacctttggaggaaatgaaagggacccagttggaaatatagtctttcttcgcgccccctacatctctctcccccggcggaaacgcggcccaaactgttacgaagtggaagaggctggatagctcttcataattaatcaggaatgggaggtttgagcaggtttacttgatgagggaaacattatagcctcgccaattcattcattatttcaacaattacttattgaacacctgctacgtggcagacagtaagagcctggatagtttctccccgtttttcaaagtcgctaaacgcgaccagagggcagaggagaggccggtaacctaagagtcctggctccgccccctccgcgtttggccttgcctgctcctcccaccaccacttcgctcagaggcggctactggctcaagaggacgacagaagccagtctctgatgcccaccgcattctccagcttcaggcctcaagccctgtagccgagaaggcgaggcctaatgttacaccaccggtctgttccgcctccgtttcggggtccacccgaaaagctttcagatcggatcctcggtgagacggcactcgattaaataggtctgtctctacaggccaaggaggcgggtttggtgcggccactccaaggccaaagcgagaaaatcttactgcgcacgcgcaatagacagccgatggagccaccgatggagccgtccggaggggagcaagagcccggagccgtcaggtaccgagcaccggaggggccgagagggaagaggaacctgagggaggggagccgagccggggctgggtctgggggccgctcttgggagctggggcgcaggaacataacggaggcggactcgcaggtaatagtggccccgggacgccagtgccaacgcccctttactcgcaggttcctggacctgccctgggaagacgtgctgctcccacacgtcctgaaccgggtcccgctgcgccagctgctccggctgcagcgcgttagccgggccttccggtcgctggtgcagcttcacctggccgggctgcgtcgcttcgatgccgcgcaggtgagccgggggctgaagccccgcccctgcctgggtaccgccccgcctctagcccagcccccagccccgcagtatgcccttctggacccccttgggccgccggggctgcccggaagggatccacgcaccaaagggcaaatactcggtagcgactcagagggaaagtggggtctctcctgggagagcaggaggctgccagaaaagaactcaggtcaggggtgcataggcggctgaggagtgcgggacgggctgagagttggggtgcctccccgcccgcaggtgggtccgcagatcccgcgggccgcattggcccggctgctgcgggatgccgaggggctgcaggagctggcactggcgccgtgtcacgaatggctgtcagacgaggacctggtgccggtgctggcgcggaatccgcagctgcggagtgtggcgttgggcggctgcgggcaactgagtcgccgggcgcttggggctttggccgagggctgcccacgcctgcagcgcctgtcgctcgcgcactgtgactgggtggacgggctggcgctgcgcggcctcgctgatcgctgcccggccctggaggagctggatctcaccgcctgccgccagctcaaggacgaggccatcgtgtacctggcgcagaggcgcggcgctggtctccgcagcctctctctggccgtcaacgccaacgtgggggacgccgcggttcaagagttggctcggaactgcccagaactccaccaccttgacctcaccggctgcctccgcgtcggaagcgacggtgtcaggtgcctgggcctgatagggcgggaggagggcagtcacttagcctctgctggtatggggcgggctgtagttgttaaaaggccggactgagggttctgaatcttcctgcaaaccacagcacccccattctgaacagaaagggcctctaggattgcctaggccagagagcccatagtttaaaaacttttttcaaccaatgtttacacattgggagatttcacatagaaagtcgacttctggcttttcttcaacaagggggagatcttgcaatcctaggcggagctgagggccaggttccccccttaaatgagacaggaagtctccagctcactggaagccaatccaggcgcctcccttgtgtagggacggaaaaagtatgcccctgccccgagctggagggagaccgggattttgccggagccagtccgaggctgagtgagcccgggcctccaccttaccccaccaaaggtgtggtggcctcatgtccctagcctcaccctgctcctccctcaggacattggccgagtactgccccgtgctgcgttcgctgcgggtgcggcactgccaccatgtggcggagtccagcctgagccgcttgcggaagcgcggcgtggacatcgacgtggagccgccgctgcaccaggccctggtgctgctgcaggatatggcgggcttcgcaccttttgtcaacctgcaggtctgacccgcctgccaatcggagcacagctggactgtgtggctggggcctgacactgagctgtagggaaactgaactgtgaggacctctggtgagaggccagtgccctgccccaccctggagcttcaaataaagagctttttaccccc

SEQ ID NO: 458 - DNA, 267017 bp, Homo sapiens
gcgagcgggcgagcgcagcgcggcggccgcgcgggagtgaaggggcgcgcggcaggccggcggggagtcccccggggcgcacggagcccgcgcgccctccgggaccctcccccgtccctgggccggacctgtgggcgccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtgagtacagcccccgccgaccctgctgggggtggcccgaggtcccgggagggccccggatggccccttgcccctcccagctgtgaggtcgcgaagctaagcgcccactgggcagccagcagccgtggagtttcttcgcagggctgtgatctccagggaagcctcttctgtccttcctccttcgcacccccgcccccccggtttctttttttggcattggaattggcaagtggctgcccttgtctgttacaacggtgaagtcatctgtccgcctttgatggatggtggggggagctttcgtcaacccctcacagagcagccccgtcgggaaagcgcatctcctcggccctccccaggggccctgggcgctcacgctcacacagcccgagatgctttcagagctcgccctggagaaggaagcctcgcgccctgcctcccacgccagctctgtctctgccttcctaggcctggggctgggggcagaaggaagccgccgcccccttgcccaacctccaccctccgcgctaagctttgatttccctcataaagccattgtgtccgtcggtgtgaggagaattgtggcttttccttttatccctcctctggacgtgacccttaaccgggttcatttcctcttaagtgatgctccatctccagacacgaggaggcgaatgtttgctgtggtctccgaggaaccgcccctcccccttcctcccccaaactttaatgagaaggggttaaggttgactggggcagctccagagcctatgtgacagttcccctttcatctcagccggtcctgtcttcccatccctcacaccttaggaagtaaacacggtgtccttgacccctctgagcgtctgtgctcctgtacttgagatagaagagacccaagcacagaggactgcatgttatttgcaaattgggtatttagaggagcagttccagtgctcaaagcattaatcttaacagttaaaacaggcgctggttgctgccctggattgtacattgatctctgaagtgccttttcttccactgttgcaaagggactggggtttgtggcaatgtcagcctcgggctactctttttgcctttgtcaccagtgtagctctgaactttgagtttctttacagctgagcaaatgcggctgggctcatatggggaggaggtaaatgtggaggcaggttgactaggcagggaggtgggtgcctgtcgggtccagtccctgacacccttagagagttgtttcttttgtgtcatctggtccagcaagcattttctgctgctgttacaagaaagctctttttggagggcttgggtcaccaggtggtcaacctgctctgtggacagatgtccctttgtatatcccagggtttatttttctcaaatgttgcaggctaagttttaagggttctcatttgtagtcctcagctgagcttggcactgcattcaacagatggcactctgctctgagacccaggcaggtgcgtttccaactctggattttaaatgaaacatcacatttcagctcccaccgatggtgcccaaggttgcagatgcaggacacactggtaacaaactagaaccggggcccactgcagacaggattgaaaggcaagattgcgtgctggggttctgaagttagacggtcttgctcaaagcctggcatgcagccagtaactagctgtgccaccttggcaagttatttaaacctcccccagcctcagtttactcaatttcaagtaaggataataatagtatgtacttgttgggagaattaaatgagatcatctatgtaaagcacttagcccagttcctggcacgcagtaagctcttattaaatggtagcttattattggtgagattctgactaagaaagtatttttgaaaagcagctattaatggtctggcaaaaaggaagaaagattttgggttttaagattgataataacttgttctatgtgaaaaacacaaaagaagtcctgtccagttccctcgaaatgatcatttccttcctttttacagacaaagtgtttcccgggacatctccgcttcccgagtaagaatcgatgacattatgtttgggggggcagggagtgatgtcactgaacagatggggccatgcagagttctgaactagagttctggaaaacactgagaggagaaagtgttacatgttgtggaattgtggaacgggcagagacccgaagactcatctggctcaactccttcattttacagatgaggaaatggagagccagattgggtaaagtaacttgcaacacagctgctcacagctgggtttttttcattgcatgtaccctaagtccagttgggtttggctaagaggacaaataactggtggtcaaaaagtttctacccatttggggcattgtatatattaatacataacataagcatatccaataattgaaagggggaaagaaagcaatagaaagggcctggtgggacagacaggggcaggaggagcgggtttggggaggctgcagcctcttcctctcctggcccttgcacggtgaataccacacaccaaaagctcaagtgttgtgagtaaggccctctggtgtggtcagctggcaggacgtgctgcacccattgcctgtgttctggaaaccctctacactggaggagcaagcctccttccagcctttcctctgctgatggtgaattctgagtctgtggtttggtaaattgcagagcagagaggttttacgggatgtgcgtgttagccagagctagccgatgagaggcctggggcccacgcaggaggagctctgctggctccagagtgctgggaacacactgcaaaggttctctcaggacattctgcaaagggtttgctcatccccacggggagggggagctgcctgaacacgaagggtcctgtgctttcggtcagttcatgaaggcacgcaagtagcttccatcatggggatggcactcagccctggcttccttcttctctgccaggcccctgcttggggtggggttgagaagggcaggcagctgctactaaggtcaggctccctggcatgaagctaggctcctttcctggctttctgagctgtgcctggggagaccctaggtaaactggctttggcctctgaccgcttgtcttgaaaatggtcctgatgatgctggatgcagaatgcagattccttcgtttgaaagtttttcagtaaagatttgaattcaggtccaccgggttctttgtgctcacaggcaggtataggtatatatcaattcatgtggtagagaaaagctcgtttatctaaaacaaacaagaaattgtatctatttggatttgggaggtattgcactttcacagttgttttatttcctgattgtttatttcagacaaataccaatcatgaatgttctgatcctctgcaggactctttggggaatgcaaataatagccagtttagcagttaccatcgatggtgaaacatacttaacactcgtgttttcgtgtgattcctgcaggtcattgaatgtaccctaatgtggggtaggtttttggattctgttttacagatgaattaactgcaacttggagcaattcaccaacttgcttagggtctcgcagctggcacagggcagagctagggcaatgcaggtcaggttagctccaaaggaggatgtggatataaggtggggcccttctcttcaattagaatccgggcaggaaggccaggctcagccctgttccatggtgacagagcagtacagggttgtctttaggactgcctcactgtagagacatctaccatgtgccctgcaggtgagttcatggtgggcaacgcaggcgggtcactgtgaggcaggaggagtagagcaacttcaggctggtatctggtccccagtaatgcttagggtaataaattaagggttgaccttgtggacataatatattcttcctctgtttagatcatcccagattttattcttggtcctgggagctacatgcttaggaattggccccaaactcattcatttctgtgcccttctttttttttttttttctcagcccttagattgtgactccagccccacaggaatgagaatgtgcagccacagcctgcaagggtctttttcagggccagttccattatggaatgagtatggtgttgggcagatcagtgcttgaatcctacctgtggcacttcctagttgtgcaaccttgggctgtcactctgagcctcagtctcctcacctgtaacttcacagggctcttgggaagttggcctgagataatttggggtagtgtctacccagtgcctgacctcaccatggacatgcaccatatactagttgccatctgctgttcctgatcaccaaggcactgcaggtgatttaggacccaatcggtcaatctgagagaaaaggaaagactgaggcaagaaggacggcccagcttttcacagtctgatggggaagtgggttacacgccccatggaaaacacccagcctccaagaggaacagataaacacagagcagctgttcagacctggaggggttcctggagctgagcattgggatctggtggtggctttctggtaagctgggaagaaacagaggttaggagagaaggaaagaggttgctctgggtaagggcaaggtcaaataggatcctagccccaaggtcagcaccacacatgggttaacactcttgcctgctctctctgtccctctgtctctcttacacatgcacaagcatgggaacggtttcttctctggggagggaagtgatcgaggggtgattcacgggtctgacaaggctccctgctcatggaacaaccaaccacacccttcaaggctgttggaacagggagcacagccagccatttatcgcaaccctgtgttgagctgagtgagggcttttggggggcaaaccagggtagaaattaccatgtgtggtggcaggcagaggggaagggaagagaagggaaaaataaacctatttgatgtcagaggagaccgattccagcccagaaatacaagccccagctgctgcattttccaaagagatattccggggccagcatgagttaactgaccgtggaggctatgaattagggaagtgttgttaggacttctgactttgggtttgcacagcagttccctgtaaattgccttctaattgcctcagcctgagtcactgaccagactatttcttggccagaaaaagtctaatgggcaactgtgttctcttttacctcttaattaaacaaaatgaaacaaataatagagttatacacatggtagtcccacttactcctctcgagttctgagaatccaggaaagggatagtagattaggatagggacccaggggacaggaaggacaaggggtgtgtgtgggaaatgaggtggagattctggctttggaaataggttctgagtgagggccagaggtgttctctgccatgacaattgccaaaaataatggaagcgcccaatagagtgatcagggcttccagaggcggattcccagagcagcgtgctacttcctgcctggcccgggcttctgctgcctgtagtgcagccagtcacaggtgggcaggtgaatggaaggtcaggagcctagctgtgaaggggatgggggtcacatgaggatccctcttgtgcctctgggtaacccccaggcaagtcaccatatcagccgcagagactgagcccctgctgtgtgcatggtgccggtcagagtccagcaaggctgtccagaccccataagaagggggagaactaacatacaagcacctactatgtgccaggcaatgcagaagatgcctttagaggcgattttacttgaacctcataacaaccccatgcggttaggtaggtgtttttattcccattttatagatggggaaattgaagctcggagggttcgtatcattctactcagagtaattctgtggcagggctgggattctcaccctggtctctgacacccacatctgtgagtgccacttcttccccatcagagctggcttggtgagagagaaaataaccagtgagtccaggcagcaccacctggggatgaggggtgcacctgggaggctgtgttgtcccagagcacctgtgtgccgtatcccttggctgagcattgggatatcctggccccaccactcgctgccgtgggatacagtgcaagttacttatgtctctgagcctcagtttcctcatcagtaaaaaaaaaaaaaaaaaaaaaaaaaaaaagaatatatggggaaagttggacctagctcttagggttatgatgaagatgaaatgagtttgtaattgtaaagagcttagaccggtacctggcgccttatggagctcagcataagtatttgctttcacaatcactaagtcctgaagctgttcagaggagggagagcactctgtgaactggagtttccagggaagaccgactggagaaggcagcttcatgatggaccttgaggtgtaattaggatttggctgggaaagagtaggatttagatgggaaaactggggaagggcattccaagaaagagaaaagcaaaggtgctggaggtggaacgtgcaaggaaaagctgggcaaagccgagggtggatgagggagagaaggatgacaggaaagctcagggccagctctgagaggctccgatggcagcagagggaattcagtttattctgtagacaccttggaaccttccttttctcccaagggcttggcagggagagggagctaaatagtcactttgaggtcctcccggtgggctccagcgctgtttttgcgactgtgcctggaacagagctaagtaaggactggaacctttttctagctctgcctgggggactctttagttggccagctgggtcccacccctcctgtttacagctctcactcctaggggtctggcttccccataaaaagttgattgcacccaggctcctggggaggaagggttgaggaggaggaggaggaggagagggagcagcaggaagtgaggtgtcagctgctttgggtcttaactagcttgggagggcctgatgcagcagcgtttcaggtggagtaatttccatccacactcccccagtggcaagagcgagaatgcgcccatcctcgtaggttctgggggccaatacctcacagtctgaggggagcccagcatgtctgtgtcttctgaaccatctacactaatgttgccttctacttcaggatctctctgaacttgttttagttggttttttttttttttgagttggggtctcgctctgtcacccaggctggagtgcagtggtgcgatctcggttcactgcagcctccgcctcccgggttcaagcgattctcgtgccttagcctcccaagtagctgggattacaggcatgcaccaccacacgcagctaatttttgtattcttagtagaggtggggttttgccatgttggccaggctggtctcgaactcctgacctcaggtgatccactcgcctcagcctcccaaagtgctgggattacaagtgtgacccgctgcgcctggcctgaacttgttttagttttaaatgcagtgcttcagctgggcatggtggctcatgactgtaatcccagtgcttcaaaaggccaaagtggggaggatcacctgaggccaggagctcagaccagcctggacaatgtagcaagaccccatctctacaaaaaaattaaaaaataagccagaataagccaggtgtggaggcatgcgcctgtagttccagttactcagtcggctgagatgggaggatggctggagcccaggaggttgagcctgcagtaaaccgtgatcacaccactgcactccagcctgggtgacagagtgagaccctgtctcaaaaaaaaaaaaaattctaaaaagctaggcatcgtgatgaacacctgtagtctagctacccgggaggctgaagtgggaagatcacttgagcccaggaattggaggctgcagtgagctatgattatgccactgcattccagcctcggcaacagcaagaccctgtctctaaaaacaaataagtaaatgcaatgcttcaaactacctcttcatttatttgacctctaccacactcccagatagtctagtaaaccttattcttagggaaaatgtaacaataaaaataacagctgacctttctaaatgttttctatgtgctaagcatctcatatggatgttctcagaacagccccacgcagcatgtagctcccaccagcatccatactgtacaggtgacagcacaaaggctcagagagctcaaatgaattgccagatgccacgcagctgatgagctgcatgtggagaggcctgcactgacccaggtctgctggctccaaagcctgccctgtccccacagagaccgcttaatgacacattacacacccaggatgcctgggctccatggttccaccttaggcctagttggttggctcctcaagccgtgagatcttccacatgtcacctcccccttctagaactacatttgcccatctagaaaatggtgcaactgtttcttttcaggcttgccttgcagagcggagggcaggtataacagctgctttggaaagcactgagcccagagatgatagctgtgtgaggaggtcccttgatcccccagtctgggttcttaattatctagggcagggatgctatacaaagtgagttgttcctgaccccagggaatttttaaacaaggttcacctgcccagccacctctcctgagaagcctcatagacagagtcgactcaggagtacttaggctcttagtgaagatctcttctagaaaacggcctctggttttccttctttccaaaccaatcatttttttgtgaacaggaaaagacagagttattcccagtcccatctctccctgctgttacctgagcggaggaagtgatatctaagtggctgagttagcaaaggggaaacagctgtggtttctgccactccactgggctgctttctctgtccctgtgctgtcatttccctttggctggcgaggaagccaccctccccaagcctgggcggaggcccatggctgggtcggggtagactctgtgtgtgtgtgtcaatgcagcataaattatgcagtggggcgggtgggacaatttagcctgtttctgggatccctggagcatgaactttagacctgttggaaactgatcactcttacctgatctgaccacaacttcagggagtcaggaatggaagtaatgccccatgttgagaatgaacttgcagggtgtaccaggtggggtagggattgatggagtgtgggctggtttgcacttttgcctatcactgtgtggtccctgatggagaacctacgttgttttccttttttgaggcgtactctcactaaaggagaccttggcacgtattgtatcaccatcatcatcatagagctgttacaggaaaggggtcccgatccagacccccagagagggttcttggatctccagcaagaaagaattcagggcaagtccatagagtaaagtgaaggcaagtttattaagaaagtaaaggaataaaagaatggctgctccatagacagagcagccccgagggccactggttacccatttttatggttatttcctgatgatatgctaaaccaggggtgtattattcatgcttcctcttgtgagaccatatagggtaacttcctgacattgccatggcatttgtaaactgtcatggtgctggtgggagtatagcagtcaggatgaccagaggtcactctcgttgccatcttggttttggtgggttttagccgtcttctttactgcatgctgttttccctttttttctttttctttttcttttttctttttttttttttttgagatgaagtctcgctctgtcgtccaggctggagtgcagaggcgcaatcttggctcactgcaacgtccacttcctgggttcaagtgattctcgtgcctcggcttcccgagtagctggtattacaggcgcacaccaccatgcccggctaattttttgtttttttttttttggtggagatggggtttcacagtgttggccaggctgatctcgaactcctgacctcaggtgatctgcctggctcagcctcccaaagttctgggattacaggtgtgagccaccacgcccagcctactgcatactattttatcagcaaggtctttatgacctgtatcttctgctgacctcctgtctcattctgtgacttagaatggctaaacatctgggaatgcagcccagtaggtttcagccttgttttacccagcccttattcaagatggagttgctctggttcacatgcctctgacacagctaccacatattgaattcccattttgtgccaggcattgcatggcctttgatttataacctctggccccagggtggccatgaaggtatgcatttttaaccccatttgactcatatggaacctgaggtttggagagtgcaggtagcattgttaagaaagcacaaacccaggcagatgtgacctccctccccttccccagcctgcgcctggttctacaccatcactgtgtcttacacacttggtcccttttcagggcacccagggctacaggggcttctgtgagaaggtgctcctcatggggaacttgccctggttgcttttgcccatctaagtgttcagagcatatagggattgtccctgtcctttgaagtgactgctttgtaaactctttcatgataggcccaattctgacccagcgttatcccatttcctgatggcccagacccaaaaggctattttaagggacttgcctgtgtgggagaatttctctctgtaacaacagaggaggaggcctggccggcctggcatggggctggcagtggagctccgagagggtgaaactctgtcctgaattctgcctcctgggctggaacagattagttgagccctcagcgcagtgcctggcacccagaagggatagaatcacttcttgatgagtgtgagattcccagaggtggcagcccagggatttctgctggtcagagcctcagtgggctggcaaactgatgcttctcttgcagagttaaggtccgtaatagaacaatgtctgcactttggtctcaagctgggattaattactgactttagtcatcactcattggcaacttgaagcaagcagcctcatgttttttgttatttctgaacgtggcagctcccaggcaggggaagtggggatgtcaggttagagaatgtatgggtggagtccattttagatgcaggcacttgtctcatttaatccccacagcaaaccctggtcatcatctgtgttttataggggaggaaactgaggctcagggaggtgcagcatcttgccccatcactggcagcaacagtgggagccagggttgcatcccagatctcttcaggaacaaagcccgacggctttatctgacagcttccctaggggatggggagctagggagctcgtcacataggtcctggataaaaccccaaagggctgaattaaaccccaggtcacctgcccatgtgaccctccctctgagcccctccctgaaaacatgatgtggttggagcggatgttaagatatgataacaagcttgctataggaacagatctgtgccaaggtctggcctctatttgcaggttcaaatttgtattccccttgaactcttgcccagggccacttttgaaggcctggcccttcagagggttcagctgccagtctccacatcctcctcttggggatggtggatagcatggcactgtggtagggagcatggaggagtttaagttcctggtattttcagccccatgcttgcttaggcaaaaccaggctctggaaaccagagtaagcactaagagagggacttgggtgccagcagttggaagttgagggcaagaggataggggcagagcatcggcagctgctgtcatgggctgtggctctgaagctggctatgaatcacagccctgccactcattagcttgtttcacttggccaagtttcttcacctcctgggcctcagtttcctaagtaaaatgggtataataatactactacctaacccatatggttgttactcatatgataactgttccataaacggcactattgctatcaccagcgttatcatccttcttgattttgctcagtttctgccatctcctggaagcttccctgacctctcatcttaaaatgacatttccagtctacgaatttttataatgttaactgttttacctctcatttaacacttaccaagaatgaccttggattgttcagcctttggcaagctgatacttactcatattcattcattcattgtttcattcagtcaatatttgaatgtttactatgtgtcaagcgctgggaacacagcagggcagataaaaatccctgcccgtttagagcttacattctggtgtgggaaaggaaacaataaacaaacaaatgacaccctgtcatttgcagcaacgtggatggaactggaggtcattatgttaagtgaaataagccaggtgcggaaagacggaaagacgaatattgctgtcctcactcataggtgagagctaaaaagagtagatctcacagaggtagtgaagagtagaatggcggctaccagaggccaggtgggaggaataaagagaggttgattaatgaatacaaaaatacagttgggtagaaataatacgttttagtatttgatagtacagtaaggaaattgtagttaacaataatctattgcatattttacagtaactagaagaactggaatgttcccagtacaaataaaagataagtgtttgaggtgatggatatccccatgaccccgatttgattattacacattgtatacaggtatcaaattatcacaggtacccccaaaatttgtataactattatatatcatttaaaaataagaatacaataacaaaataggtcaaaaacatagtgtatgagatgggggttgaatggcgtagggaaaactaaagccaggtgagggagacaggcatgttggtgatggtgggagttgctgtgctttttttttttttttttttgagacggagtctcgctctgtcgcccaggctgcagtgtagtggtgcgatctcggctcactgcaagctccacctcccgggttcacgccattctcctgcctcagcctcccgagtagctgggactacaggcacccgccaccacacccagctaatttttttgtatttttagtggagacaggatttcaccatgttggccaggatggtcttgatctcctgacctcgtgatccacccgtctcggcctcccagagtgctgggattacaggcgtgagccactgcacccggccttgctgtgctattttatagagggtggccaaggacagccccactgtagaggtggcttttgagtaagacttgagggaggtgaggaagtgagccctgtggctatctgggggaaagtggttgagggagagggaacaacaggtgccaaggccccgaggtggctggtgtggcctgagtggagtgagagaggggagagcagcaggtcatggggtcagatagggaaaagggtcacgttgagccttgtatccctccccaccctgcacagcatgctctgctcagcagtgaggcctcatgatgacctaatggagactgaaactggccaaaacactgccagagaggtggcttcaaggactgcttggggtttgaccctgaccccctttaaaagagacctcctggggaaacacagtctccatcagcagcgtcatgggtaggaactccagggccccaaaggcagggtacacaccaggaagcttcactggctgaacattatttttgtgcctactgtgtgcaaggtgctgtgttgaaagcagtgctccagctgggagccaggaggcaggtaggggcgtgaattcctgcaaaagcagcgaccacatcctttcatctttaacgccccctcctcatgctagcagagggtctggatcatggtgcgtcctggatcagtgtgataaatccctggacaaaggcttcattctactaaagccccttcccctccgacctcatactcctatttttactgaagcttctaacttacagttgctgaagttagttgttagaaactcaaaacacatgttcctatcagtattgtatcgtaaatggtgttaagattctcaagtcagcccaccaaaacttttctcatcctcagagtagatttgtatccctgacaaccagatatctctagttcacctacagcataggctaacctgggagcctaaatgctgtgtgtaacatccagggaaactgtcttccattgttcacagtgagaaggaaaccctaaggctacataacaataacaaccgtaacaacagcagcatgaacgatgtgcccgccactaagcacatcactcatttaatccttgcaacagactatgagaaaagcactattatggtccttccattactcagagagaacagaggcagagagagatgcatgagatgcatttaccaatggtcacaagctaggaaggggcagagccgggttcagagccaggcagcgggactccagagtccttcgcgaaacctcttgtttcctggccttccgggaatcccgccagccagccttgctgcagcccagggtggctgtctgtagaccttacgttcaggacacttgtcattaggtgttaacaagtgtcagggtgagggaacaaaagccacgggtggccagtatgagcagtttctctttcttctcccagacaggaaaaaccatttgtttctggaacctgacactgcagggggtgggcttggtgtatgtggccgccttcctgggccatttacaagtgcagcacatgggtctggggagggggctgggccggggtggcgatgtgtttattggtggaagctagattagggtgtctggcaagatgtttttgacacctagaccattccactcagtgaaacccaacaggtggccaggctgttgctttagctggaagcggggcaacctccccgccctgccctgttcagtttattgttggaatgagatgggtcctaaccagtccttcctctcttccctggccccaaaataaacagcagctgttgttggcgccatcatttctgcctctgccagtctgtcagcagcgctgggctcttgcctggccttgccctttttgatttgatggcactgggcgttgggagccctttacctttgccctacggagcctgccctgctgaccagctggtgtgccctaacatgccctctcccaggcctggtggctgcccactggcactgtcctctccggccctgtagtgaggcatgtgtgcatggcggttgcaaactcggactccagaatctgacatccatttgccccctggttcggctgcttagttggtgactttggggaggtagtttaatgctgagcctcaatttccttctctgtaagggcagctgttagtatctgtatcatgggatgttgtggagattatgttgaggcagccagtgggaggccgactgcctgacgggaatcccagccttgccactcaggggctgcgtggcctctggggaggggctgcgtggccttgggggtggggctgtgtgggcttgggggaggggctgtgtggccttgggggaggggctgcagctttctgcacctcggttttctcatctgtaaaacgttgataataaaagcatctctcaggctggtgatgaggatggcacgggttaattaacgtaaaacagaaaacactcaaaacactgccaggcacagagcaagagctcagtgactggaatagcatatgctctccgtcagagaaggcggagcatcccctgaaagaatccttcgcatgtgcatgttcagagctgacacaattgctgttctcctgacctgacttttgggtctgtactaccgagctaatttgcttggcctcgtgtcgaacctgtgattagaacttccacttcagggtgtaggggtgttggtggaactagtgatgaaggaggctggaggcatgaaaaaagagagttgggatttctattctacttgctagtggttctgctgatgtaatgtaagaaatggaaagaagattatgtccacagccaagggccgccttcagagctggtgagcagatcccacgcggggttgaccatttatctgtgctgatgtgcacgccccaagacgttcttctaggtctgtatgtatgttgatgttctggacaccctccctgtgggctggcagctggggccagctcattttggcctcttcctggctctgtgctctgggaaactcttgctgtctttggcttttccttgctttttctctccattttggaaagattgtactgggaacccccattagaacatccaaatggaaaaatctttattctcaaaaagaaaaaaaagtcattggccctgattgtgttgggccacagtgccagatgccgccgtgggcacaccgatgcctggtaaagatcccccacttaggaccgagctgttacacggtctccccaggagcctggtcctgtaggagaggtggctgcctgtgctgttttgcctccctggcctttggcagtccttgtccaaggagagagggcaatggtagctccattcccaacatttggggtgctgccttctgacacattagtgaagagaatggtctgaaccttagagaggaaagcagcaaagtagttcagagagggggttctgaaaccagactgcctgagttcaaatttcagctgtgccatttattgctgtgtggccttgggtgagtcacttaccccctcagtgcttggatttcctcttccgttaatatgaggataatagtaccttccccatagggtcgttaggaggattaaatgccgatgatggcaaaagccctgctaaggtgcctggtgcagagttagtgctccatgttgctgccatgatttgcacccacaccgcaggtgagtctgcttcccatcagcccagagcccctggggcctgacaggtatatatttagagcccttgagagggccacatggtgtttgtgacagaggtgtcttggatggaacctgtggcatgttctagaggaagggcgagtgtaaagattcaggccagcaggggatttcctagctgagttctgtgaggagtccttcaccctgggggctcagtttccgcagctaaccatgcccatgcctcccttgttggttggctgcagaatcagagacaccatgaggcatccggtagtcactttccttcacggtggctgttcaaacagctgtgaggcttggcgagggccccaagaggcggctcagtgggctctggcctttcccactctttcctgcactctcctctcgagagcagccctgagttgtgcagggctgtgggtgcagcaggtgacggtgtcttctgcaggtactgtgtgtgtcctagtttgcagagctcctcacatccacaacttctctgaggggtgctgctgggaagtgctacagttctcctgcctatttcacagacaaggaaaggctcagagagggtccgtgactcctggaaatatggtgggcactgttgatgcctgccccacgtcccctgggctcacctgagttcacctgcagtgccccagctgtggcatccagcacactgacagctccccacctcacctgtctgtgtgagcactccctcctgggccatggccccagggaagcttgctctgcccaagtgggtgcacctgagaaagacttggggaaggtagggggctaattgtcatccctggaacccaccctcaagtggtggggaatgggagttatcagcctggatccaaggccttgtcttagggtcggcttcaggaagaacccaactaggatagcaaacttctcctgctagcaagtggtagagctaggactgaaaacctctgtctgggactcccaggtccccacaccaggctgcctgtccggtggtgcctgtctggaggtttatgggtttctcgttagagaggagtcagataagaaacttgtttgatgaggtcttcttgataataagagggcaatttcctgagtaggtaaaagaatagagggctgaagaatacttgataagtacaacagcttctaggggcccaccagggaggagctcagtcagtgcaaacacgataggcgggccttggaaacaagggaacccggccttatgtagacttgcctcaggaaacaaacgagagacttagggataatagaaatctaatatcttcatccgtcactcatcaggctgggaggagcagcatcagtaagtgtctaaggaaacggagaggggctgccggctcctgtgcccaggtgcaaggtgacatatatgagcaagacgctctgcttgtttgtagtaaaattccctctgtaaaatcgggctagttggcagagcattggacattatgaacatgaaagcttcttgtgatggtgtttcaaattgtggagacactagtgtgtttttagagatggtgagaacatctttaagaaaacaaagggagaaaagaaggggtgtgtgtgtgtgtgtgtgtgtgtacatgtctgtgagtgtggagtgtgtgtgcactcgtgtgttggggaatgttgcatgtgtatggacatgtctgtgtgggggtttgagtgtggactgtgtgtgttggatgtgttgtgtgtgtatggatgtgtctgtatatgagtttgaaggtggaatgtgtgtattgggggatgtgctgtgtgtgtatggatgtgtctgtgtgtgagtttgtggagtgtgtgtgttaggggatgtgttatgtgtgtatggatgtgtctgtgtgtgggtttgagtgtggaatgtgtgtgttggggatgtattgtgtgtgtatggacatgtctgtgtgtagctgtgagtgcagtgtgtgtgtgcatgtgtgtgctggaggatgtgtgtgtgtgtaataaaagctgttggcatattcctggggcaatcttttatccttgagagccccctatgatcaggctagggggtccaagaatacttagattttagtataaaagggtctcatagatctttgcatatacttacaataaccacctttgatcttttcctccattgcctctttggtgccaggcaggtgcccatagacctcatttcatgctctcaaaagagactgtgtttctcccctttatagataaggggcctgagaatcagaaaggctgagtcactcactcaaggtaacacaactaggaagacgcggtactgggatttgaccagcctttagtccatcctttgctggttcctcgtccagtgaagggggagcttggtgagattcagccaagcctttgctcatgctgaaaggggcctccctctccacttggggcacttgctctagaaacgtgatttctggcttcagtgaaggccaaggaggaagtatagggagcagaaggctctgaggcctggctgcatgaactatagagtggtgcaggtgtgctgtgaggacctgcttcagggaaaagttgttgtgacccagaggagggtagagctgcacgggagactggaaaatcagcgaagacttggtgaggggttgggggggcggccaaaagaccaggacgtccttgagttcacccccctgggcctccaggagaagagactgtagaaaattctagctgggtaaagaactttatgtctagttttcataccctgtgagcatctgtcaacctgtttgtttacatggtctgatttctccaccgtgtggagattccatatccaggtgtgtgaggatggggcaatgcagatccatcgttgtctgctaagcgatttcacttcgaataagggaatggcagagaaacagaccttcccagtctggattcctggaagggatcgcgggtggacatttcgtcattgtgagttcttggcagacagaggcaatggggccacccgagttgcctggctgctcccacccctgcgagctcacgtcagagcagtgggaaatcccacggaagctgcaatcccagatgcaagtctgcatggggcatttgggatttactcccagcctgggcctttcgtaccctttggtttccagagctgctgggagagggcttcctggtacctagccagcttgtgactccaaacaactgcttgaaagcagacagcttctgccagtgtccccaagaaccttaaagggccacctctgccccacctgtgtgctccaacatcagccaagtctgggaggcaggcagactcattcaaggcagcctgagcagcacaaatgttgaaaaattatcctgcaataaattcccaggcccagaactattaagataagtgtgaacctactacagcattaacttgcatgttggttcagctgtctactgacttagattaggttgtagcggcccacatagtggttacaggccgcagggctgcttgagagagttggagttcaccaccggccatgtgactttgggcaaattacttaatctgcctgggcctcagtttcttcatctttaaaatgaggatgataaagtagcaccaactcctagagttggtggctggcataaaagcaacgttaatggtaaaaataccagagacagcaggtgcttggcatccccactgtgctccctgagtggtggcccatgccgaagcagttggctccctccctttttggaacagctttattgagatataattcccataccataggaccaattcacttaaagagtatgattccagagtttttagtatattcagagttgcacagccaccacagtcaatttcagaacattttcatgtccaccaaagaaaccctgtaccctttagccatcacctgtgaccaccaccctaggcagctatgaacctgctttctgtccctgtggactggcttgttctggacatttcatataatggagtcatacactacctggtctcttgtgactggcttctttcaccagcataacattttcatctaccatcagccccttcattggctcgtagggtgagctggattccttccatgtggtggccgaggggtcctggacacagccactccccatggcccttgcagggctggcctctgctcctgagttcaggttccatgagagcatttcctcttgccaccttgcagagtgtgtggattttctcccctgccccagcaccttaaagctggccagagctgggtctttcaggaagtgttgaactctcctgcagtttattcccattgcttcctctggcctggttagagacgtgggggaggggtggaaactgggcagagcctttactgatctgttccccagggactctctttccgggagggggaggggagagacagacaaaaaagcatctttatttgtttttaatgttgactaactccccagccctcttaccaagttctggtgaaagttgctgggttcctggtcacgctgtcctccctcaaaacacagggtcataggacttctctcttgggggcagctaatagggaagtggccaagtgttccacacacaagagtcaggctgcatttcttttcctctagcaaaggagatccagtgcaaaaccagtgaatcgttaggaggcgttcagttgcaagcaacaaaatcccagctgaaacaatctcaagccatgtggaaatttatcatctcactttcaagaaagttcgggtagataataaggaattataacttttaaaaaaagattcctctgttaatgaacatttagactgtctctaactttttcgccacttcaaacaatgctgctctaaacatccatatataaatataaatatatagatataaatatatatatatatgtctttgggaacttgagctactatttttgtaggataaattattgaagtgacattaataaataagacaggttaggatttatgtcagatgggtcagttcacatttaatctgttgtcctataccatctgtatctaaatccatcaaatgagaagtgatgtttacagtgaagaccattgtggatccctcatacctatggaatcacttcatggacattgtattattttgcattttttcccacttatggctgggcagcaggctaaaataatgcttagatggaaaagacgtaacataaagggcttcctggttaaccaccagatatttagaatattctatacccttgagtgccatagttagcaattttgttcaagagagtttgtgattctctgttagaaagtacaggatgaaaagcctaataatgctaagtgttggtgagaatatggggaagtgggaacacttacgtagaattttaagtggtgtaaccactttggaaaacaatgtggcaatatctagtaatttgaaggtgtgcttatcatgtgacctggtggttctacttctatttttttttctttttattatacttgaagttctagggtacatgtgcacaatgtgcaggtttgttacacatgtatacatgtaccatgttggtgtgctgcacccattaactcgtcatttacattaggtatatctcctaatgctttccctcccccaccctgccccagtgtgtgtgtgatgttccccttcctgtgtccaagtgttctcattgttcaattcccacctatgagtaagaacatgcgatgtttggttttttgtccttgcgatagtttgctgagaatgatggtttctagcttcatccatgtccctacaaaggacatgaactcatccttttttatggctgcatagtattccatggtgtatacgtgccacatcttcttaatccagtctatcattgatggacatttgggttggttccaagtctttgctattgtgaatagtgtgtagtattttagatattatttagagagtagatagaaatttattatttcctccagatcagctggttgaaccttgttttcttttcttttttttttttttctttttaggttctacttctaagtgtataccttagattctagggtgtagagactatctcccaagtgcacatgagaagacacgtgcaatgatttttattgctatgtatttgtaagacagacaaattggtttatcagtcagaatgggataggttaagttacaggaacaaacagcccccaaattctatttcttgctcatactgcctgtccattggagtcattaggggctgctgctcgttgtaggcacttgaaaactgagacttgcaaaggcctagagtgcttccatggtccctggggcatggggagagagtgtagcagtgtccggcagtggcaattaaatgcttctgtccatgaaatataattctgccataaaaatggaatgaagtgctgattcatcctgcaacctggatgaactttgaaaacattatgctaagtgaaagaagtcagacacaaaaggccacaggttgtatgattatattcatatgaaatgcccagaacagttaaatgcatagaaacagaaagttggttagttgtttccgggagctggaagtattgaggaatggagaataactactaactgccatgaggtttctttttggggtgttgaaaatgttctggaattagatagtggtgatgtattagttgcataattctgtgaatatactaaaaaaacactgaattgcacactttaattagttaattaattaaatttatttttgtagagactgagtcttatgatgttgcccaggctggtcttgaattcctgggctcaagcaatcctcccacactggccttccaaaatgctgggattattgagccaccctgcccagccaaattgtacacgttaaaatggtgaccttaatagtatatgagttatgcctcaatttaaaaaaaatgcttctgtccaaaaataacacatcccttggccaaagaggtcacctggccacacataccttcaggttgttgaggaagcacaattctaccatgtgcctgggaaggaaaagaattggtatattcagtgaacagccctaatggctaccacttggaacagtacaaatgccaatggttggataaataaggtataggatattcactgatggaattctgtacagttaatatgaataagatctgtaagtgtcaacatgaaaagatctccaaaacagtattgaatgaaaaaacaagaagtagaatattatctctgataccatttatgtaaatattatttatggaaatatcgatccatttatgtaaattaaaaattattcacaaaacaatagtgtgtaatgtatggttacatatgtttgtagtaaaagcatgcaaacacagactggaaggatgcttcgcacctgtcttgtattatgactgttcccacctaaaaatgtagatcatgtgttggttcttctgaccaactggggaaattcatcctatttttcaatttattgcgtattctcaccattgcaaaccctcatcctgacttatttttattttttcttttagccctaatcctcaatcctatcccttttcctcttagccatcctctctaatttgtttaacctaagcctgtgtgtcctcagaaaataggttatgctgttggtgtgtgtggttggtaatctatatacatggtgttatgctattgattttgtttggtaatctccctttttactcaatactatatttataagatccatttaagtggttgtatgcctctactttattgcttctgactgctgcatggtattccatactcatgtccaccacacttactcattctccctcttgatggacgctgaagttgcttgcctccaacaccctctactgcaaacattgcagcagcagacatccttatatattgcagccctaaaacctccacaaagatttctccaggagtgggattgctactgaaaagccatatgacagtatttacttaaatgcagtctgtgtgcatgagggttcccagctctcctacatcctcatcaacacttggtaatacccggaagaccttccagcctattggcacttctccctaaggaccgattcagcctacattggaagacatagtgagttttaatctcttcctatcattccttcctggcctgtctcccttgtctggaatgaaagttctttttataatttcctacccagttctcactgataggaccagaaacccgaaaccttcctccattatcttaagaactcagccagtttttcaaaactaagcctcctttgtttttttacttaatccgaaataaacctctcttatcttgttttcccctctttgctcagggcctggaagcctcactggccattcttgtggattgctccagaaatggcccctgagaggtattgcttcacctgagtctacctggggtgggggtggagctgcagaccttccccagatgtcacccattcacagaagccagttttgggatttagctctgtttaaattgggacctgtagctttgcttgcaagtggaaataagttggtcttatttgctggggataattatatgtaaaagaatcctacctaatgcaacccgacttttggcctgagccattcaatggataattagtcctaactgtattgctggagtggaccattactgaagtcttaccttttttgtccttgcttttaccttgccttgttccagcaaggcttaagcatagctttaggtcctatgttatgcgcatgttatgtgattgtctgattgattacattataaactctgcacaggcggcatcacggtctttctgccctttcctgcctccctccgtccttgcactgccttgcttcatggagctttgcacttagcaggtgctcagtaaatacttgctgggtggttgacacaggattacatgttaatccatcatcttcaaaggctagaaccagacctatttaaaaaaacaaacaaaatccttccttttaaaagtggcattaccttcttaccctcacaaatgttcattttagtcgcctttattgctttctggggtagggggtcttaagggagtaactcagagagcctctttaacttaaaagaggcataataaattacagtctttaagagaagatcggatgcctgcgtgcctcccagaagtgggttaggagcacagaattctagatggctcctttgtttgcaccccaccctgtctgcagggctggcctcccacagcagtgtgtggtatcctacagatcactattaaataaacagtcccttgaaatcacaacattaaaaagtgctgtctatgtattgtaccaggagagccaaatattatggaaaaggccaaatatttccactgtgttaagaaaataagaacccagcagcatggaacttcccactcagtaggcaaaagatgtggtggagacttcaaaagggtggaagaaccatcaagacagcttgagctgcaacgggtgactgccccattaaaaaaagcaagtgtgtgtgtattccagatgcagctgcagaaatcgcaacaccacctttcaactgggaaataaatgaatgcaccaacgtatgtatcgtggctcacccaagcaatcgtccaactgtgactagggctgggggagaggttaggaggagagaggacgaagtacagaacacaaacagtctttgttctccaaagacccaaaaggcagattcacaggaagagattcctcatcctggtctgaaatgaagatagacacttggccatagggctgatggctctagcagaggccctgcccttgggatctcggcagcatctcagccaggagggctccctgactctggaagtggaatattgagtgataagaagtttggcttctcccacccactttccaccaccaggtagagcttgtgaagcctgaaaagtctgtagggccaagcagcctgactttcatggaaggagacccaggagtcaacttgttttaattaaaaagttaggttgggttatctcagggccacccccagggagggtgatgcttccaagctgaccaaattctgagctgctgagctgcttactttaatgagcttggggaagctcatttgaggagtggtggtaaaatcgctcactggacttgcaacatgagaatgttgttcatgaatcatcaggaagaactcccaggtgtggagaatggactcttgttccttcagctgatttgggacctggcactcacactcgcttactaactttctctccctagcgtaagcattcgcttcctgcctagagtctggctacctacccatcatccccattacccaaaatacaaaaacagagaactgtagcatcttattacgtagactttcctctctcccaaaagatgtgccagtgcccctgcctgccgtgccaggccctgcagggatgatgatcatggtctccagcatttaccgagctgtaattctgcacagggaaccaggccaggctctgtgcaccttcctagagcctcacagcagtcctctgcggggcacgactgttctcatccactcttgtcatccccgttttacagctgaggaaccagtggctctggcaggtgttgggacgtctgcccatggtcacgtagactgtgtggcagagccggaattcaaatctaggccccatgacttcagtactgctctatctgaggactatgcagagatggcatagcccctccttcaaaagctcatagtctagttgtagagagcagagctccttgcatggacaaataatccaccaggcccagcagaactgggtaccacaaaccgcatgggatgtctaggaaggggctggaaggaagtcacggtgcactgagaatgtggtgtgccaggcggtgtgctatgtacctatgtgtccatgacctctttaattctcaaagcactcctgtgaggttcactttacaaatacaggactgaggctcagagagtcatgtagcttgcccaacaccacacagctcatgggtggtggagctgggcctgaacccacatgtctttctaactccaaaccacattctctttgcatgataccatgatagacactccatttccgtagtgttaccgggagtgaaggccttgaaggatgggtgagaggtgagaagggagaaaggagggagtgggcattccaggctgagggaaaggaagaggagtgggcctgaggagcagcaggaattccaccagccccgcccagaagtggcccagtttttatcaccatcccaaatacatcgccttggtgtacatgaacttgctgagggcctagtttccatggctccgaagaggtgacatctccctcccacccctcatccaccctgagctccctggctgatttattcaatgtggtcatctgcaatggttgtggacctgtcaggatgacagattcgcctggggacatcctcctgtggaaggaactggattcatcccttgatcacttccatgccctgtgggtctctccctacctcttgctcattctacgagttatccctccattagccgggccgaagcatcctccaggcagggtttcctaattacctaatggtgaccatgctaccctttgccaaccttatgaaaagcatggccatgtccgttatctcatctgatcttttgctcttccaaccagcatttattaagtgcctactgtgtgccacacaccatatcaggtgctgaagattcacgggtgaaccaaaacaatttcatgcctggagagaagggatgttacagagtagctgagatgactgacattaaccagaattacaaagtgcccggctctaaaatgtgctccgggacctggaaggaattacactcactagggggaaaattctagcatggacagccagttccatcagaatcctgggatcctctgtctcctaggatctgcatgtttctcagtagatctgaagctgtttgatcacctgcaggagctggggagtctgctggaggcctgggatggagttctgggcttagtctggagagaatatgtaaacaggtgcagcctccttaaggaaacctgagaggcagcaccacacagtggaaagaacagttttggagtccaacagacctggacatgcatctgggtttatatctgtgtgaccttaggcaagtcaccgaacctctctgagcccaagtatcctcacttggagaatagggatgatgatagcatggatgtgcctgaaatgcccagccaggagcccaacacatggtgacctgagcaaacatgggcatctttattagctagaggtcatgaaactctggatgtgcaaagcaggccaatttgtgatttgtttaatttacaagatttctcattttatgagaaaacttgctgacaatactttcatattgggagctcctcttaggtttgaaaaataaaataattggccgtgcacggtggctcacgcctgtaatcccagcactttgggaggccgaggtgggccgatcacgaggtcaggagattgagaccatcctggctaacatggtgaaaccctatctctactaaaaatacaaaaaattagccgggcgtggtggcgggagcctgtagtcccagctactcaggaggctgaggcaggagaatggcgagaacccgggaggtggagcttgcggtgagctgagattgcgccactgcaccccagcctgggtgacagagcgagactccgtctcaaaaaaaaaaaaaaaaaaatttgttacggatgctgtgttttacccaggagcaccctgttctcagcttcatacagaactaagccaagtgtgtcagtgctgtccggaaggagagtctctaggggcatgccacaggactctatgctctgtctctgacctggaatgttggtcagtgacttggatgatattttgatggcatcctgttcacatttacaggtgaccagggaggaaggagagagagtgcttagaactgaacagatgtaaatgtaatgagtttcgaatgaacaattcaaagaggaaattaagaaaacaattccatttttattagcatcaaaaagaataaaacacccacctcttgcaaaattgaaactgtatcaattaaataataactcccctttccctcctccctgcaacgcctgttaacagccattataccttgagtaaattctcaacaaatgatactgtcctaggaaaagaaaatgtaatgggcgctgatgaaatcagcggcccaagtgtaggcagcaggaggtttggttttcatggaagcaggtgtgtgaggtgtcagggttggggttgtttgggagccagcagaagccagcagtataaatgcctctccaaatcctagggatgcattcacagaattcacatttcttggaatgcatttgtagaggtttaggatttagaaagtttagagagaggctgggcacaatggctcagcactttgggaggcctaagccggtggattacttgagcccaggagttcaagaccagccaggataacttggcgaaaccctatctctacaaaaatacaaaaattagccaagcttggtggtgcacttctgtaactccagctactcagggggctgaggcacgagaattgcttgaatccgggaggtggaggttgcagtgagcagaaatcgtgccactgcactccagccagggtgatggagtgagactgtatctcaaaaaatagagagatgacatggcaagagttgcttccattctgccctctctgcctgtctacacctggtctacacaggtgaaggttggattcaggtcctggtgtacattttatgagagcagggtaggagggcagcctggatggtggagacacaggactggtcaccagaagccacaggaagtagggctggttatcctcaagccgaggggatgccgggagaggggctatgtgaaatgtcctctttcaggagaggattttgatatgttctctgtggccccagaggcagaactagtgggtatgggcgggcattagcaggaagtagattcagatcaggataaggaaaatgttctcagaggctcggtggatgctgtgtggcttcccctccgggttgacccagcctctgtgctggaagctggacttgcctgggcaagggctgagttcgggactgcttcagcattcctccaaataaacctcccctggccacagaaaagcccagagaacagagaatattagaagctaagggagagcttgcagttatttcccaactctgcccttcctcatgccttcccattttaaagacgaggaaatcaaagctccaagccaccgaaagaaacaaactccatgcctgcccaccctccccttggggccacctggaggtttctgcagaaggagggtgcttggtctgagccagtcagtggatgaggggtttcccaggggagtgccaggtcaggcacattcctcagagcttcaaaatagccccgcaagccaatacatttcctcccaggggttggggagtggccgtcagctggcaagggacaatatgagggacacatctcaggggacactctcgagtgaggcattagggtgtgggtgctgagatgtctcttttcattgttctgcaggagtgagtgcggccttgacacgctgactggcctggcatggctgtcccagctgaagcctgtcccctgcccgctgcccttctttccctcatctcagccatgtctgcaggcacctccctgcctcccactccctaggctcaccaagctccctcagctttccaaagtctgtgagttgtagtgtgaggccacgccatgaggcagggacaaaacacagggtttggaatcagtcccaccgggactggaatccaagctctactgttaatacatcccagctgtgtgaccttgggcaagtcactgatccttttggaccctcagcatcttcttctgttagatgggcttgtacccatcccaaggatttgtatatgggttacatgggcttaatgatgtatggctgtctccagtgcagagcctagcacatggaacttgctagggtggcctccctctgtgcctcagttgccatgaaatggtggagcccagtgatgaggccagccagaataatgctcccaaccctgtaagggcagtggttaaagccagtctcaatcaaggtgggtgttaagggtcaactctggcctgaatcaggaatgccaccttcttacacaaagccagcattgccttcaaggtgacttctgcaaaagagacggatttttctgcacgctgcttttctcatggcatccgtggcacatcctctctccctgtcagcaaacctaggctacctagattttgagacagttgcaaagtatttattctgaggattcccaggacaacttgatggatcctgccaaaaacatctttgaacatataacttgacacacttttgtgaatttattccccaagataaattcctagcaggggaattggtgggtcagtttgcatttctcattttgatatatgttggcaaatggccctcctgaaagaattcagctccctcccacgaagtctgagacctatctatttcctcataacttcagcacctatctgaccaaacgtgattgtttctgtcagccagatagaaaagaaataacatcttgtcgttctgatttggcttttttcagttacacatgagatgatggagtgtcttagcatgtatgggttagccatatgtatttcttctttggtaaatgcttatttatattcttggtccatttaaaaatttttttgggtggttcagcttattactttgggtttagaggattgttccttggagagagggggtattctctaagggggcttggtggtggtattcagatcagtttcctttgaggctgtgagttagttagaagtaagcttcttcaccctccctgggaagaggctgccctgagcttgctccaggcttcctggggtcctcgttaacaggcatgaaagtgctgctccccccccaccatgccctcatggctgagtgctgcatcagggcagagcttgtgtgaggctgaatgagaagtttggtgttagatttagggaatggggggccatggcaggatgccagggaagaacctgtgtatgtgtgcagctgtgtgagagctccagaatttctgcagggaacttggacagctaggggttacatctgcataggaagcaccctgtctttgcttagagtgtgtattccaaataacaaaaaatagcaagtttaataaagttgcttttgtgcacagtatgtataacatccagaaaaggtcaatggcctattactcaagagaaataattacacaaataagtcaaatgagaaggatgaaataaggccaggcgcagtggctcatgcctgtaatctcggcacttcgggaggccgaggcaggcagatcacctaaggttaggagtttgagacctggtgaaaccctgtctttaccaaaaatacaaaaattagctggggatggtggtgcatgcctgtaatcccagctactcaggaggctgaggctggagaattacttgaacccaggaggcagaggttgcagtgagccaagatcgtgccactgcactccagcctgggtgacagagcaagactttgtctcaaaaaaaaaaaagaaaaagaagaaggatgaagtaagaataaaataataacaacagggccaggtggagtggcttatgcctgtaatcctagctctttgggaggccgaggcaagaggatcacttgactccaggaatttgagaccagcctgggcaacaggatgaaaccccatctctacaaaaaatacaaaaaattaacccagcatggtgatgcgcccctgtagtcccagctactggtggtggggggcaggggagctgaggcaggaggatggcttgagcccaggaggtcgaggctgcagtgagcagagatcatgctattgcactccagcctgggtgacagagtaagaccctgcctcaaataataataacaagaacaacagatctcccacttgtgtctggagctggctgatggagattgtcaaggtggggattaagcctcccttggcactgccactggtgttagaattcccaggaaatctaggaaataaaaagaatgaacgccaggtgtggtggctcacgcctgtaatcgcagcactttggaaggctgaggcagacggatcacttgaggtctggagttcgagactagcctggctgacatggtgaaaccctgtctctactaaaaatacgaaaattagctgggtatgtaaaattagctacttgggaggctgaggcaggagaatcgcttgaacccaggaggtggaggttgcagtaagccgagaccgcaccactgcactccagcctgggtgacagagcaagactgtctcaaaaaaaaaaaaaaaaaaaagaatgaacgaccatacattaaatgttttctgtgggccaggcacgtgctaagtgctttggatgcattatcccatttaatcctcactgaaaccatcagaggcataccctcttattaccctcattgtctaggcgaggaaatgcagggtcagagaaactcgttgatttgtccaagatcttacaccagttaagaggcaaagctaggattgaatccctgaattggttttggctgtacacattgggcttccctgtgtttctccccggccctgaccccttggttaaagctgggggagatgccacttagagggtagaagacaagggaagttctggccatgtgcgccagcccctagccaccctctggagcccagttggcatctcagaagacatggctgggaggggcgcccaacccccccgccccttatctgggggctttggtgtgcagcctgggagggctggaatctatagctcacgcctttccctgcatgggcctgggtgtgagcaagggtgtggggaggggacaggctcactgggggtgggctctggccaagcaaaacaggctgaggtcagagggagggggccgccctccccagggaatgcttggatgacgtgactttgagggggcactgggggaggagggctggctgtgtgtttctcctctcacctcaacctcagcctgatgaggaaccggggaattggggcgggaagcccgaccagatgcagcccctggcaggctgccctggccgctgcgcaggactcttctccagccagcttggcaggtcccttcttcccctcctgaggggacctgggagcaaatgacgtcctggagttggctgtggcagagaggagggtcccctctggccacacggaaggaaggggcagggagaagcagcttgggggctcaaaagaatcccctttcctcattccagttgctccacattttgagccaagtttgggagcaggaggggagatttaaaaggtttgctctcagatccggtgcctgggagcgaattgagcgtgaaacaaagtcattgacttctggcacttagtttctctcatttttcaaaagtcgctaacgctccctgcattgaatgcctcagggtcttagtcactctgaactgtccaaaaatgagcaggtgaagcaccctgtgcccctccaggaactagggtctccctggggaacccactcccactctgagatctattctagtcactccactgcatcctgagtgtggaccatctgggggcccagagcctttggggtgagatttcttgatctctaagcagcccctcctgggctcccatctccccccctcctctagggaccccacgcatttcactgcccacactctctctcattgccaagcctgcttcatcgtcctgcctgccccctgctccagggccctttgctccttctgggctccctcacatgctcatctattcctccttcagcccttagatctccccgacacctgttctcgcctctctctccaatcccaaactatgccaagttctccaccgaagaaacacttcagctggctttgaccttgtgcttcttcgcccccttgccctcctccctcttctgcccccatcattccctcgagcctcagagctgggactcagtttacctcctgcctctcactgccttgggctccaggctccagtcaccccagctggccctggctctcccagggaactcaggctgtgtcatgccccctcccctagccctcagcctttgcttatgctgtttcttttgcctagggtacccttccaccaccacaaccctcacctcttcacccagcctaccttccttatctgtcactctggcatcacctctgctaggaagccttccagagtggtgcctctcctggggttccctgggaacaggcacagctcttgacctagccttacagcacattgtcccttagtactgctctttctcaccacaccagagctccctgggactggagctgtgttttatttgactttgtgttgccagtgtctagcacagagcccagcacgtaataagcgcccaatccttcttgacgggactggactgaattttatcagacaagtaacatggctttactgaggatctaccaagtcattagacgttgtagagaaaacaaaggaagcccggatcaaatatttgctttcaaggactttgtaatccagtcaagaatgattctgggaatgggttgggggaacggtcaggcatgaaattggccatctgagtctccagtgctgcagtgggcactatggttgcaggtgccttgtaaaggtttcagagaaggggagaactgtgagtagagggggacccagtgaggtctggagaaggggtggagggtgggtgagatcacatgggagaaggctggcccaaacccacagtcaggactgggaactaggggagaaatgtgtttccagagaaggtgagccgatttcacctagccataggatcttccagtgtcagaacagggttagtggattttaagtgcagtttctctatcctggaggccaaacaggagctgatggcattccccgttttgccgcatgattgggaaatttttcctgcacatcagggtctaccggggccagtgatctctccaggcaaagagagcaggatattttaggaatcagttctttccaattctcagtgttaaagagccggtttctttgttgctgagcctggggaaccaggtgtgttctcttaaagtcagcctttctccttaaccagccaggcacagctgctgctgtgtgccagagttggtgatgggcaatgtgatcactgcagagatgattgcagaggtccagcatacatttccccaagattaatggacatagcatggcgtctacccacacaagcatgctgtgcaccggaggagggggcagagggagcaccagggctgaggcagcccagggagatttctaggaggtggtgggtcttgattggctcttgcaggaattagacaggctgagaagatggagaaatagagttctttctgacaagaaccccttaaccaagaggtacattgtctcccttctaactttttaaacaatagctttgctgaaatggaattcatatcatacaatgcaaccatttgaagtgtacaattaaatggtttttagttcattcacagatagtgcaactctcaaccacagtcatttttaaacattttcatcatcccagaaagaggccccattagcagtctccttatccctgacagccacccacccaccccacagctctcggcaaccacaaatctactttctccctatatatgtttgccttttctggacatttcatataaatggaatcatataatgtgtggttgcttgtgtctggcttctttcactcagcataatgttttcgagattcatccatgttgtagcatgtatcagaacttcattcttttttataactgaataatattccataacacaggaacagaaaaccaaataccatgtgttctcacttgtaagtggaagctaaataagaacctatgaacacaggtaaggcatggtggctcacgcctgtaatcccagcactttgggaggccaaggcaggcagatcacatgaggccaggagttcaagaccagcctggctaacatggcaaaaccatgtctctactaaaaatacaaaaattagccaggtgtggtggtgcacatctgtgatcccagctacttgggaggctgaggcaggagaattgcttgaacctgggaggcagaggttgcagtgcgccgagatggcaccactgcactccagcctgggtgacagagcacaagaacttatgaacacaaagatagaaacaacagacactggggcctacttgagggtggagggtggaggagggagaggagcagaaaagacaactgtcgggtactgggctttatacctgggtgatgaaataatctatacaacaaagccccacgacgtaagtttacctgtataacaaaccttcacatatacccctgaacctaaaataaaagttaaaaaaaaaaaagaatagaccgggcatggtggctcacacctgtaatccgaacactttgggaggtgggcagattgtctgaggtcaagagttcaagatcagtctggccaacatggtgaaaccccatctctactaaaaatacagaaaaaaaaaaaaaaaaaaaaaattagccgggtgtgttggcacacacctgtaatcccagctagtcaggaggctgaggcagaggaattgcttgaaccagggaggtggaggttgcagtaatggcaccactgtactccagcctggacgacagagcaagactctgtctcaaaaaaaagaataatattctattgtatagataagtcacattttatttgttcattcctcatgtagtggacatttgagttattttcatgttttagttattacataacattacataatgtatatattttataatataatgctgctacgaacatttgcatacaagtttttgtgtggatgtaagttttcatttctcttaggtagatgcctcagaatagaattgctgagtcatccggtgacgctacgtttaaccatctgaggagctgatagactgttttccaaggtggctgcactattttacattcctacccacggtgtatgcaggtgtgaatttctctacatcctcaccatcacttattatctgcgagtttgattatagccatcccagtgcatgtgaaatgatatttcactgtgatttgatttacatttccctaattgctaatgactttgagcatcttttcatgtgcttattggccatttgtacctcctctttggagaaaaatctattcagatcctttgcccattttaaaattggattacatatttttattattgagttgtaagagttctttttcaataaaagttgcatgtatttcaagtctacgacatgatgttttaatacacaatacataatgaaatgatgactacagtcaagcaagtgaccacatccatcaccttacgtagttctttattttgtgtgtgtgtggtgtgagcactaaaatctactctctgggcatacctcttgcatgcaatacggtattagtgatggtagtcctcaggctgtaccttagatgtccagacatattcactctacatactggaaatttgtatcctttgaccaacatctgccattttccctacctcctcacccctgtcaccacccttctcttctctgcttctatatatttggctctagaatccatatatgagattatacagtatttttctttttctttttctttttttttttttgagatggagtctcgctgtgttgcccaggctggagtgcaatggcatgatctcagctcaccacaacctctgtctcccaggttcaagcgattgtcctgcctcagcctcctgagtagctgggattacaggcgtgtgccaccacacccagctacttcttgtatttttagtagagacggggtttcaccatgttggtcaggctggtctcgaactcctgactccgtgatccgcctgcctcggcctccccgagtgctgggattagaggcatgagccaccgcacctggcccagtatttttctttctgtatctggcttagttcacttagcataatgtcctccaggttcattcatgttgtcaaatggcaggatatcttttgttaaagttgaataatattccactgtgtgtgtgtgtatattatatatataatatatatagtatatatattatacactgtatatgtgtgtgtgtatattgtatataaatacatatagtgtataatatatacactgtatatattatacatatatataccacaatttctaagagttctttatatgttccagatataagtcctttgtctagaatatttgcaaatgacttgaaaatattttcccccattctggggattctccttttactttcttgctgatgtcttttgaaacacaaaagttttttattttgatgaagtccagtttgtttatttgtctttgagctgtggttttggtgtcatgtctcagaaacccttgactaattcaaggtcatggagatttgtgctatgttttcttctaagactttaatagttttctctctcgcatttaggtctctcatctatttcaagttaatttttgtgtgtgatctgaggtccttctcattttgtactgagtcaaactgaagagccccccacctccccagttggcctgccacactttgccttctgcatttgggtctcagctcaaacatcctcactccagggaggcctcccctgtcaatctaaagcagctgcctccctgcagtttcagtcaccaccccattttattggggccgtcagaaatggtctgacatgttgtctgttgcctcccatataagctccatgacaacagaccctgtctagcttactgccttcgtttctagcacctagcgcagtgcctgacacttagccagagctcagactattatttgaaagcttcttttggttaaaagaaacattcccagtggattttgcttaagactttgtaagtgtctctggcctcatggagttggagggctgagtgggaggggatctaccagcatcacagtcacaggtggtcactcgtcccttgccccagccatcccattacttcacaagacagccccttccatccttggacaactctgatgattagaaaattcttcctgatgttggacagagacctgcttccccatcgctggcactcgttatccactgccttcctttagggacaactggagttgaacttcacattttgacagtcctttaaatatttgaaaccagctatcgtatgtctcttaaatacctcctctgggctgagtgcttctaattctctcagctgttcctcctggagccgagaagggctggactctgaccccttagtcgctgatgaaggcctgcagacatggggtgggcacaggctgccaaagaaagccccagcacagccacagctcagaacgaaggaactcgagtctccttgtttgctttccccactttgagctgatgaattccaaaactggaagcagaactttgagaaaaagcacccagtacaaactccctaactagatatcttaaaggcagagctgactcttagtagtacaaattactctgtaatattgctttctattaaaagggtgtggttttttttttgttgttttttttttttttttagctagtccagtggtctttttgatgttggttcagcttagtggttctcaaccctggaacaacccgtagacccacctggggagctcttaaaattatcagtgcctaccccaccttccaagattctgatttaaatcctgtagtgtttttaaggcaccccaggtgattgtaatgtacagccagggttgtagaccttggcttcaagagctcagcattgaacctgaaattccctacagccccacaagaatgagcaaatgctggatgtcagcacaacatccaggagctggcatgagccagaggactggctaagaggactcaattattttctaagatggagattatgaaagctatacatgttcaaaagaaatgaaataatatagaaatgttggccaggcacggtggcccacacctgtaatcccagtactttgggaggctgaggcaggaggattgcttgaggcctagagtttgagaccagcctgggcaacatagcaagaccccatctctacaaaaaaattaaaaaattatccaagcatggtggcacatgccgatagtcccagctactggggaggctgagcggggaggacttcttgagcccaggaggtcagggctgcattgagctatgattgtgccactgcactccagcctgggcaagagagcgagactctgtctctaaaaagaaaaagaaaaaaagaaatctataaagtagaaagcaaaactgttcccatttctcctctctctcattccatgcaaataaccatgattatcaatttgttgtatttttttctttttaatgtgcatagacacacacatatgcaaacttccccccatacaatccatcccccagatagatttaatcatatggtatacatagcattataatcttttttttcttttctcaagatactataaaccttttcccataatgatatagaaaagtccaccttatctttagtaggtatatgaaccataatttatttgacctttttttatcaatagacattcaatattccttatctttatatacatacacacacacatatatacacacacatacatgcatacacacaattgtgtggataaattcttagcggtcaaattgctgagtcaaagggaatgcaagtttggcgacagaaattgccgaaaagctctccaaaatgattgttcttgtctctctcaagcaacgaaatttctaatgacagctatttgccttgtgtcaaaagttgagctttgctgagcacagcagagaggaaggtgtgagtgtgtcagatggtggggaggaagcccaggggtcatttcccctgcaggctgtgtgtggaggcggctgctggcctctgactgctgtgtttcccaggaaaaggaaaccaagctgtgtgtgttaacctttgccattctctccagggtgtgacgatggagtggggcacattttcaggatgtgtgtgtcggggtcagtaggcctgggtcagtcattgatttgggagtgtgtggaatgagaatcccattttctgaccctttcctagacccactgggttgtttccaagccccttggaagcccaggagtgtaatttttttgatggctcaggagaggatatatttgtttaatttctaggactctggctcctgaatgtctgggagcattgagcttttccccctgatttccattgcaaggttagccttatcacctcagcctaggcacaccatcgccctctctgggctcctgggcattacccaagatgtccactgcccactgctgggcctctccattggagtgcctgctggctcgaggtgatcagacttgtttgctctgccaagctgacttgggaccagagggtggtggcaggattggaaggaggaaggtacaaaggtccaaccgcatgctctcaggtactctggagaatgtcccagtggtgacatgcccagaactctgtgattgcaaagtgggctcttgccaggcccagcacttattggtgccccagaatcttctaggggaagagactaaaattcataagtgcaaaagactgtgctaggcactttgcaggggaagggaagtcacatttattaagcgcctacagtgtccaaggcactgtggttgttcttgcgttctcattaatcttcactgtgaggcaggtattcttaacactattttatgtgtttattttatggggtatggaggctcagagagaataataacttttcatgaaattgatccgattgattttaaactatgcaaaatagagtgctgatccccgcaaggatccctagccacctgcctcatgggcggcctcagtattgacagatagatcattgtctctgtcaccaactgacagagctaattgagccaccaaggcaaatcttgtggcagggactctgtcttgctccaggcagtctgctgtcgttattaaagaagacaaagagttcaggatatagagtgaatggctgcatttgaatctgagcttcattacttgttacaaatatgatgacctcgggtagaccagttacctctctgggccctagtctcttcacttatgaactggagacgataacaacacttttctcataggactattgtaaagagtaagtgagataattcaaacaaagtgcttagcaatgcctggaacatagtcagtactcaatacattggcatggccattagtgtttcttttactcctgatcaatcaatcccattgtgcgtgtaagaaggtttggcggagctgactctttggactgtttttcttctcgttctgggggctgtaaggacagagctgtgactgcctaacttttgaaaggtccatgtaggattgtgaatcctgggagttcctagtttatacactcatttcccctccaggaaacatgaagaaaagaaaaagtgtccagccccagaggggccaaccgcagcacgttcatcctttcagcggacgctcctggggaccgtcattgttttcccagccctgggcagcagagctattttttgctcctctgctctcccaggctggccttggtattagtagtggttccaccactgccgtgtgtgtgtgtgtgtgtgtgtgtgtgtgtgcgcgcgcgcgcctgtgtccatgtgtgtgtctccgtgtgtgtgtgtccatgtttctgtgtgtatgtgtccctgtgtatgtctgtgtccctgtatgtgtgtgtctgtgtgtgtgtgttgtgtgtgttgtgtgtatgtctgtgtccctgtgccctacttcctgctcccctcctatttctagtcatagcctcatgatccaagtctcacggcaaatgggaagaagtcagttcacttcctgagtgtctaaatagcccacattcattgggccactttgcacattgctaggccctgtgctcggtgccccatgggtatcaccacatttaacgagacactcccgttagaaaccacacttcgcagcaaaggaaaccctcactcagagggtctaagacacttgcctaagcccacgtagcagggacatgtatggattgaaattcaaatccatcaagtggatagatttgaatttgaagtcatcttcctcctgtgtgaagccaagacggcctctggtcccttctgaggctcacttctcggcactccattactcatcttgcactgtccctccgtgatttgtcagtgtgcgtcccactgcccctgctgggctgtgagggcctggaggttggatgctttgcctcatcttctctttagcttgtctctaaaccaggcgcgaggtcagcactcactggatatttgttggttgctttgttctttcactgatgaagggaacagtaagtgagcatctcttaggtgtcaagtgtggtgctgggcactagcatgccaccaaccaccttcaggaggcttccattctaacaaggagacacagagtcagctccctgaatcctcacaagagcctccaaaaggtaactactgtgatcttcattctgcagggtaataagtagaggctccagcagtagggaggcttcctccagaccctctcacctactcattaccctcccatttaaataaatagtggggccggatgaggtggctcatgcctgtaatcccagcactttgggaggctgaggcgggtggatcacctgagatcaggagttcaagaccagcctggccacccatggtaaaactcatctctactaaaatactaaaaaaaaaaaagcctagtgtggtgacacacgcctgtaatcccagctactcaggaggctgaggctggagaatcacttgaacctgggaggtggaggttgtagtgatctgagatggcgccactgcactccagcctggatgacagagcgagactctctctcaaaagaaggaagggagggagggagggagggagggagggagggagagggaaggaggaaaggagacccatgattcctgcaaacaaaggcaggcactgagtgtgatgggtacctgctacacactcttgaaggatgctccctactgtagaggcatttgccattgtcccctcctctgagtctcttttaaaaacccttttccccagagaaggtccatctggcccaggtctgcagtagaagcgtctgtgttttggaggcgactggtggatgtgtggttctgggaggaaccttctcctagcacattataccccctccaactcccagagcccttctggggttcgcttctgctgcatttactatgactgattctgaatacaaagtcctgttgtcagatggtctcaggactagaaaagtcctgctgcctggtcattagccttatagtcaacccgtgagtgtgtactaccatggaggtcaccctccactacatccaggcttctaagtggtggttgttccccaaatctgcagcgtcacctctctccccaccctaagaatgaacacccactctagaggaggggttggaattttaatagggccctaccctgagggtcctcatcgttctcaggctgagctcagaaaccttagccaagtggccacaggctgttgaacttgattttgctggcagggttttaggttggcaaagatgtgtttgtattctgctcctaggccaccagggatttgcttctgggaatggggacagtctccaagtgttgctactagccacctctttggcatttcagagccagtgaatttgattggcattagatcagccagtcattatctcagtgtgtccagcagactggcaggcctagtgagcctcgggggagaagaggaagatagtttgcatggatagggagacctgggaggaagacagactcacctgtgttgaatagagaccaacacagcctgtgtcaagctgggtgttctgagccaacaattagcaaacgaaggcagatataataattgactaatcatggaaagcatactatgagcaccacaagggatggtcacagactcgccaggctagtgggggtccagatcagatgtcggaagtctggggaaatttttatctgggtgcagccatgtcaagaggggtctttaggccaggcatggtagctcgcatctgtaatgccagcactttgggaggctgaggtgggcggatcacttgaggccaggagttacaaaccagcctgccaacatggtgaaaccctgtctctactaaaaatacaaaaattagccaggtgtgatggcaggcacctgcaatgccagctagtcaggaggctgaagcaggagaatctcttgaacccaggaggcggaggttgcagtgagctgagatcacgccactgcactccaccccgggtgacagagccagaccctgtctcaaaaaaaaaaagaaaaaaaaagaggggtctttaacaccagggcctttactgcttcccggtggtgtgcagtgggccacagcagggaggagatggggctctgggccggcgtttgatgtaggcactctcatggggagctgcagccctggagtcctctgctctgctgggtgggctgcatctaggggaccagcctgtactaatttggagtatatgtgcctccttcttaccaacccccccatgatagaaccttgtacatgggggcactttgaacagaaggttagagcctattagtaccttagacgggctggcagcatcttcttgggtaagagcctgacaatgatgaactccaccaggaagccagagcggtgatcgtgtccccacacgtgaactccctttttctggctgctcaatcgtgttcattttgatttctgggaccatatgctttagcagtcagtcccaaatgttagctatccctgcatccccagactccgaagatttgggtaagttaaagagctgagggtcttgaagagatcgtatgacctcaaggaccctagagagcattgacagcccacccaggggaacaaggagcatgtacattagaataaggcacacttttctcagcgtggctgcagtcctgagccagggtgcacagtttgggatgtaaagtataggttagatttcacacctacatgtccacttgaccaggcaaccactgggcagtgaacaacttgcccaactgtatacaatggccctagtgcagccagctgatcccagccccatggtcatgtgagcaagtgaaggaagattgccattgagtttctgtttggcctggggcctggggccaggggcagctggtaggagtccagggaaagtaaggccttcctcagtaaatgggaccacagtaccatggagatatgcaatttcctccatagctcctaactccttgcctctcattgtacattttgtagccaagggggcaacaggtacttaccagcactttctaattaaacacaaggcgggtcctaggccttctaggaatggttgggctgtgtatttgcagtttctaattggtcccagaccagatcaaatcatggacatccctccacagaaatgggctaggcttcattctcagtgctctggagctgcgctgtaagtctggtttgcatcaaggccattttcttgttgaaaggagcaaggctaatagaggacagaagcacccactgggaaggcgattttggaaacctcagacattggtgggccttgtgagctgagcagacagaaggcagcccaagatgacctctggatgggtgggactggttgggccagagcgttgcgctgggtgtgtagcgagagttcccacgcagtgtctgtggtgatgattccactcctccatcaagagtgagcatggtgggagggcctgagcccctgggtcccctcagtctggactgacccaggggaagctggaagcagttgctagcctctagcgagccttcatagacgcctaccatctgcctgaaatggctggagacaggggaaatagaatccatgggtttttaaaatccagaaggaagagaaactccacccgtgaaacataaccccaagtaaagcgtttggaagcaggatatttaattgccaaacttttcttgagacccagctgccgggtaatgttatcttgactgctcctgaggctggaggagagtctatctgggcccccgatgcaggcttgtaaacagagctggctttcttggatgacctctgccctgtcccccttccctgtcacctgttctttctctgtggtttctctctgaagtttccagtgctggcaaggccagctcagggagacttaagaagctctggtgttgaggttgggagctaggcatgggctggggtggaattttgtgtgtccatcacccgcctggagtgataatctaggatgtccaaggtttggaagaaagcagacgagagagaggggtctggagattgtcctcgtatctctgggcttatctccagggaggtctcttgctatttcctcaacccaagatttagactctgtccaggggggtaggctggggggcctctggcaaatccccgaagtttgggagaacctgggaatgggggctcgcttccccatccttcacactgagtcacattcatggctgctcagggcatagaaagtagggtgcaagatgttagcaggaacaatcctttgccaaacaaggaaagaactgctttttagggggaagtgtggctgtatcctagccgggtggctgtggccggcaagggccacaaggacagctctctgtcagctcttccctctggctggctctccagcggggtgtatctttagtatggttttaggccaagggttaaacagagatgacttcgtgtgaattttcaatttttgtttttaaaatagagacagagcctcactatgttgtccaggccagtctcaaactcctgggctcaagcgatcctcctgccttggcttcccaaagtgctgggattacaggcatgagccactgcgccctgcccttttatttttaaaatagagacagagcctcactgtgttgtccaggccagtctcaaactcccgggctcaagtggtcctcttgccttggcctcccaaagtgctgggattacaggcatgagccaccatgccctgccagttttcaacatttctgaagagtagagggcaaagaacttttccgaggggggatgctctggtcatgtgcagagtagtcctaggctaggctgggaagtgggacatctgggttcctgtcccagctctgccaccaatggatgtgagcacactccagtgataaccatgttttcatcagtactggcagccctgaaggttgtgtcctttgtatagagaaggagtctgaaggcctgagcggctgggctggggtcttgcagccaataaggagggtgctgcacccacatgtggctaactccagagtctgctgcttcctacctggccatgccctttcctcggcaaatcaccaccctggcccctgggtttctcctctgctaaaggagaggtctccctgtatcctcccagctgccaggggctgtgagcctgtgattgattctctctgggaggtgaagggaagcctaattgctagtgggatggaggatgtgtgttaagcctcagttaagcccttcccctgggctccgcttggttggttccggagaaaggctgatgtctaatgtcctgcaggcgaatgcagccctctctccaggggcggattggcctcttgggccctcctcacatttagctcctggggtggaggtcagagaaacagcacctggtgtgggctcagcctctgctcctgccccagggcctgtgggaagcagagatgcaggtgggaggggagatggagctaggagtcagcagggggaccagggtaggtaataacccccaggaaaatcccacagcattgagtttgagggggtcctcaccgtcagtcggttttgtagcattcctaaccatttgcttctgtctgggcccccagttctgtgtcttcttggtctcaggctcttagaaggcgcctttgttcctgcatgttcctctaaggtgcactccctcagcaagagcaccgcaggcttctcagaccacccacacctttatttaaaaagatggtgtcaaccggtcagatgaggtggttcatgcctataatcccaggactttgggaggctgaggcaagcagatcacgaggtgagaagatcgagaccatcctggctaacatggtgaaaccctgtctctactaaaacatacaaaaaattagccgggcgtggtggcgggtgcctgcagtcccagctacttgggaggctgaggcaggagaatggcgtgaacccgggaggcggaggtcacaatgagccgagatcacgccactgcactccaacctggtcgacagagacagactccgtctcaaaaaaaaaaaaaaaaaaaaaaaaagatgatgtcaaccaaaaataaaatttgaaggccccctgcaaccatctgaatgtactccctcctcagcccgggcaccctaacattgaacctgaaagactggttcaggccatgacaggaagtggggatcagacatgattcattatactcctgcagcatcaatatcaatgcagacctaagatctgataagaaacatttacaatctgttctctctgaagcctgctgcctggaggcttcatttgcatgataaaaccttgatctccacaaacccttatcttaatccagacactcctttctaatggtagtaactctttcaaccaattgccaatcagagtatgtttaaatccacctatgacctggaagcccctcgtccccgacttagagttgtctcacccttccagatggaaccaatgtaaatcttatatgtattgattgatgtattgtatttccctaaaatgtataacgcaggctgtaccccatccaccttgggcacatgtcatcaggacctcccgaagctgtgtcgcaggtgtgtccttcaccttggcaaaatacactttctaaactgattgagacttgtttcagatactttttggtagacaatgtcattcagtcctgatcaaagtagttcagtttagataaatttatgtacagggagatagtccagttcagttaagagcataggtattagaactcagctagacctgggttcaaatcttttgctctgtaatttattagctgtgtaacttcaggcaagttacttagcttctctgagcctcaccttcttcttgtacaatatgggaataacagtggtagctaccttattgggctgaagattaaatgagctaatgcatatacatgctttatgctgtactggtaactagttacatttagttgcttaaacattaggtaacattaagttatcaaaatggttttacaatgtatcatgtgatacctatttacatatgatgtaaagcaaagcatacccccatttattataataatagccaatagtctattttgagctgatgaagataggggtggccttttaccttatgttctgtatcagggccacatgtcataaatgccccatctctgggtggcagcactcagacctgtttgctttggctttatggccctctccttggttgcgtttcagaaaaaactcgccatggcatgagtctgcctctgtgtcatagagataggaagggagaagagactggattcagctcattttcctgtgtatcaccggagcagccaagcacaaagcctcaccacgcctgtggcaaaccctgttccaggcacctgggaggtgggccagtctgatggcaaggtgtctaaatgccacttctctttgctaacgttcctcctcatcttggcccagatccctggcctcactggctattttattcttagggtagagtccccccagccccacccctacagacctacaggacacagtgactaggcagagaccccggaatctgaatttttatgaagcctgcccccggccccaggtgatcctaaagggcaccctggcctgggaaccaccattgaggacctacagccattgcctctctcctgagggaggaaagggggcagaggtcttacctgtgtcttatcagtgccctcccttaactgtcctcctggagacacccctgcaggtgtccttcccagggagaagttcaacagaaaagccctgaggctgtgggagggcacccattcctctaactcaggcctttcccaggaaggacagaaatagtgggaagagcaggccagattgtgtggactgggggctttctctccttctccaaggattcctaagtcaattcagccttccagagtggcatgagctctggcagagcctgatggagacttgggaaccggggtgacagcctggccctgaaatgccttcattgtgaggctcccaaagagaaaagtttttccagtctcccacgtgctaacgcctcttcttcaaatccgtttctcatccagaagaccagtgtgtttgttcaacatagcaaagtgttttctgagcacctgctctgtgccaggcactgagcaaagacagggatgctgagatgaatcacacatctctgagcacttctggtctcctgaaaggcatttcagagtgagttctgaggatccacagtagcaaaacaagctggggtttgttaaaagtgtaaacatccgagccctcaaaacccaggtctgcagaatttcagagagcggggtccacctgcaatttcggagggcctcttatagagtctcattcactctaaagtttgtgaaccagtggaaattagctatctaaaaaggccaggcgtggtggctcatgcctgtaatcccagcactttggaaggccaaggcaggtggatcatctgaggtcaggagttcgagaccagcctggccaacatggcgaaaccccgtctctactaaaaataccaaaattagccaggcatggtggcaggcacctgtattcccagctactcgggaggctgagccaggagaattgcttgaaccagggaggcagaggttgcggtaaaccgagatcacaccactgcactctagcctggacaacagaatgagactctgtctcaaaaacaaacaaacaaaaatgtagtgacctcaattttatgtttattgtatgaaatatatacaaataaaaagaaggaaattaaaaccactcattctgatcctactttcctaagataatcattgttggcatttgatgaaatatccctctaggggtatgtgtgtgtgtgtgtgtgtgtgtgtatttagacatatattgtagcatctacatggtagctgatactgtgctagcccctagggacagatgagatgagtaaaagagtggtcctgccatatggaacacctgcagtcatgttacatgatgcctggcacagacagcttgaaatccagccttgctcacctgctcttacctttttcccacaggtatacataatcaatgtgacctggtctgactccacctcccagactatctaccggaggtacagcaagttctttgacctgcaggtgagtttgtcagagctcggacagtggcccaagtctctctggtgggctggcctctctcataccctcgcttatccagggagcccccaagagagctgtcagggtcagagtccaggtgggagcagagggacagaggagggaagctggaaggtggagctgggctcgtctcaatcttgcatactgcaggcagacactcaggactttgttggcctcctctgatggtcttaacagtaacgctttgtcaccctcccttgcctgcagggtaggaaactgtggtgaagaggcgggaggatggtgggaggtgctgtgtgcctgaccagacgtgtgtctataaacatccagggtgagacagaagccactgcatcattgcaggcaaagaaaagcaaacactcagggaagaccgaaacagaaaataagcaattttttcaactacaggcacaaactaggcatacataccacggtgtctgtctgaccgaatgaggcacttgccacccagtttgtacatgtacgtggtaggtgtgtgtctctaagacacaaaggcatgttcacaagggaatggtagtatgggtcccacagctacccctgcagacaccccccttgatgccagctaagttagtcaggcctctttgggttgcaagtgatagttttacaattgcactggcttagacacaaaggagatgtgattggaaggagggaccagggaagcttgtgcagccgaccacatggtgagaagggcagtgaggcagaggcttcaggaatgcctgaaaccaggatctgctctccctctgtcttgtctctgcttccctctggcactgccctcagcttctgttacctcacaccctgaggaatatggctgtcagcagctctagaattttatatcttttggctcccaacagaggggaaattgactcccagttccaagttgaaaaatcccagggacgattttgattggtctggcttgggtcagatgccctctctggaccaatcagtatggctgggagttgagggtcttttagcacagacatggccactagggagcccacctctgcggatcacaggcaagtactagagaagggagaatcagtgtgagttgagcagcagccctttcaggtagagccaagatgttctagattcctctcggggttgtgagcctggtttaggccaataaaaacacaaagagacactcacttctaccctcacagccagggtccactcctttcttggcaggcctttggttgtcagtcatcttggagaggtcatcttgggtaccgtgtgcttgcccccaatacctaattctatctcattgtcctcattgccctacctatgagacaagccaagggtgacctagcttcctgtattacaaatcctttcttaatccaacaatgtgggattgaatatcccattgaatatgggattgaaagccactccctactctccagccttcttcctcttccctcctcaattcatgtccagtctccttaattccagtgtaatctggtggggtttgctgataccccatcaatgggtgcagtgtgctggacaggaagtgataactcagttggggagagggaaccctgaaaggactcattgatgagctggagggggcctgaaagccagtggaaacttccaaatcagaacttttcttccccctcttcccttatggtcccccacccactcctgcattgcagaatctcaggagaaaggaatgctgctcccccaccaccacctcccttgcctggagggctcattccctgtgtgtggaaaggggatacgcaagcagggagcagctagtgcagtgtgctggccctagcttggcaatggccatgagcttggccaggcttgtccacgtgggtcattgctgacctgtagatgcagtttgggaaggggttggaatcgttctttggaaattaacttatgagccaagcatagcatctttacgaacccattttacctgccatgatgagttttagtggcgttcattttgaaaagccttgcttatttatcaggtcgctgattttggtatggcggatcctatagaggaagaacaaagggagttgctaactccatctctggtcattggtgcacctcagaactcatgtccctgagagattgtgtaagagagcagcttagagtttaggcactgggggcacattccctgggaccggttactggctgtcaccacgtaactccggacaggctccttcacttctctaggcttgcttttctcatctgtagtgtgaaggttcaaattgcctgcccggtagggttgttaggaggaatgaatgagtgaatccacgtttctcccaacacttagttgcctagtgagttgcctggtgttagcaggttgcagggatgttgggctgcatggctggggggcgtctaggggctggagacccactcactgatgttgctttgtggcttccctcacttggcgtcactctgtggtgagctccctgtgcccagtccctgccggcgtattcagagccaggtaggcctcaggctcctctctgaagctgtcctctggggcagggtgggagcccgctgggagctggggtgtggcccaggggcagctctcagaaatgttttgctcctttcctttttggctgactctgagagtcccaggctcaccaggcccacctccaaggagctgctccccgggtttcaccaactcgtggttctaagcctcctgggggccacagacccctctgtgaatctgatggaagccctctccccaggaaaagagtggatacatacaattttacttgcagtggcaagtgttcacagaccccctgtggacccccagtgaagaactagcgaggtgcgatggtgtgcctgtagttccagctattcaggaggctgaggtgggacgatcacttgagcctagcaggtcgtggctgcagtgagctatgattgcaccactgcactccagcctgggtgacagagtgagaccctgtctcaaaaaaacaaaaagaactgctgagctaaaccagtttaggtcgtgaagcatacattcacacccggtactacttgggcagcacttgggggtctattcagataacaacaggaggcctggacacccctttgacccctttgatagacccttggttcccccctgtacaagttggttccctgcaccccagcgtgggtctccccgtacttcccctcccttatgtctccctcttcagatgttttcctttgttcccgaaggccaggcacccacgaggcggcctcgggttcccacctgtgtcacacagcccgggaaccacgtgcaaagcgatcccaagcggtcgctgaccctctctggtcatgagttgagggccatacagatccagtttcattcggaacagcacatggaccctctgtttctccctctgggagcacacagggagatggacacttgcaccctgcccttcacactctgcagccatgaggccaggaagcacttgaagggtgctctgtcatctgaacagaaaccccacactctttggtttttccatttctctccacagtagcttccacatcagcacagcccttccccaccccctcacccccacactccccaccccctcccagattctaagatctgaagcagaacatttctctggttattatcttcaaagctcctgcctggacctaactgccctgcatgtgaagccctgcatgtagatccttggaaatgaacagtctcaggcacacaccagccctgagaacagcaagcaggagggagccaagagcctgaggcttgtccttggagaaggttccttgtccctttggggtgactcatggcattaaggacagggtacttagaactctgatggtgcattgaggagctgttcaccggaaatggggaaagtcagagggttgggagagatggagagaacctccccccgccaccgatcacctggtaactgctcattccacgctttctgaagccttaggaccgtgcagagcagagccatttatctcagcgtccccttcccatcccaccacccaccttcttctctcacagcttacctgctacctgtgaggtcttggattagggttgccagataaatatgagatgtccaattaaatttacatttcagataaacagcaaatgcttttttaagaataagtgtgggcactgggcgtggtggttcatgcctgtaatcccagcaccttgagaggccaagatgggaggattgctggagttcagtagttcaagaccagcctgggcaatgcggcaagatcccgtctctacaaaaaataaaaaaaattagccgagtgtggtggcatgtgcctgtagttccagctactcaggaggctgaggcgggataattgcttgaggccggggaggtccaggctgcagtgagctgtgattgcgccactgcactccagcctgggcaacagagtaacaccctatctcaaaaaaaaaaaaaaaaaaaagatgttccaaacatttcatggcatatacttacactaaaaaacgttatttgtcgtttatctgaaattcaaatttaattatgcatcctgtattttcacttgttaaatctgggagccccagcctggctgagtgtgagaggcgagggtggaagtagaaagatgagagtccaggctggctccgggtaagagtggatgggcctgtgctgaggccccccaggcagcagcttttgtacagagcagaagtggcgcaggctgaggaacacacttttgagaaggacaaggtctcttcctgccaggagtctacatctcgtgaggaaggcaaacttggaaacagttaagtccactgtagatgaactaaatactagattgaggtacaagcaacatgctatgagatgaagaggaaggaaagagcattcttgggagagggaacaaagaagatgcccatatggtctctctctctctctttttttttttttttacttttatttatttagtttttagagacagggtctcgctgtgtcgcccaggctggagtgcagtggtgtgatcatggctcactgaagcctcagcctcccaggttcaagagatcttccagcctgagcctcccaagtagctgggatcacagatgcatgccactatgactagctaatttttttttttattttttgtagagacagggtcccactgtgttgcccaggctggtctcaaactcctgggctcaagtatccttccgcctcggtcttccaaagtgttgggattacaggcatcagccaccacacccggcccccatatggtcttaattagtgacagcagcctagggtgacatagccaaacacccacactctagtttggggggatttggttgttttttgagaattcttatcagggtaaaatatgtctctggtttccttccttccttccttccttcctgccttccttccttccttccttccttccttttcctccctccctctctccctctctccctcccttccttctttccttcttcccatccttccaatattaagtgtctgccttgtacatccaggcggtgtgccagctctgggacacattgatgatccaaagcagatctggttcctgcctttatgggtctcacagcttagtgagggaagacagattttagttaaaaaacaaagacaaacaatattgttttacaccattccagatgtaacaaaggaaggtgccatagacatattatagggaaaccttatactctgggatcagggcaggcttcctgaagaagtaagttttatctgacacatcagtgagttattttatcttattttacttttgagatgagagactcttttatgcttctaatgaaagccaaagactctctccccagacaagtgcatgaatgtgcacctgtaattctagtaacctttttggttatccataccctgcctgaaatccatccatgagcaccaggataacaccctctgctcttctccagaccttcttctctccccatatctcctgccacgagccttcagacccagactcacacgcaggggctgcccacttagaacccccaggtacggaggctttaaagctgtactgtccaacgcggtggccactagccacatgtggctatttaaattaaagttaattaaaaatttttgaaattaaattttaaaaattaaatgaaataaaagtaaatgttcagttccttggttgcacttgctagatcacaagtactcagtggcggccgtggctagtggttgtgtattgggcagatatggaacatttctattatcacagaaaattctattagactggtagcttagacaactttgaacacacaacaggcttgagctggctttctggccaccctacagtgatctgtcacctcccagccccttcctgagttgccccctgaaatcttctagggccctggcaagaagagggagattattctcctgcacagtttgcccatccttagggcttttcagctcagcggctattccaaacacttcttctggaaaccaggtcaggttcccgagagggcttctaagagcctttcagatgtgaagttaagaacagggaagaggtgaggctcttagtctccaagtggaaattggtttcttctaaaaataactcaccactcagccctatctgaccaggaaaaggacctgtcccagggaaagctgaccaggacagggcctaacgtcgaggcccatttggtgattaagggcctgggttgcttggaggtgcagttgaggtgggaggaggggcggcagatgcccttttcagttgctttctcacgggtggctggaccacgtttccagcctttgtctatttccttgcacagctccttcctggtcccactgaggaggggccggaagactctctgaagccctggctccatggacggttgtttcacaacctgacctacaaagcgctgggctacagtaattgctctgcaaacaccgactccaccatgctgctattgctttagtctgaactctggccagcgagtgcacagggtcaatatttgatcagaactgggagaggccctttattttcccctgcaccgcttggaagatagagttaagagggttgttcaggtttgctcattggctctgaaggacttaacctattttgacaagcttttctctctattccttattcatctctccagactctccacccatgcaccccaccctggggtcacactcactttccagctccccaacagcccacctcatgatgggtggaaaaattataattcctgaatcactaacaaccagccttggaatgaatgtgtatatgggtgtgggtgtgtactgatgtcacttacggagctttatgggatcattgcatttttagagttagaggagttcttattccaagtgcctcactttgcaggtaacaaactgtgttaatttttctattcattaaatttatataagctttcatttggtttaatatccaaagcaggcctcagctgagatcaacctggggtgatcccagtgtgtgccaagaaccaacctgaaagcagaaaagaggaggaaatgtctcttccgcaggcactctgccttttaatcattgagggaatttgttcgagattactgaccctagactaaagcgatgaggccacagcctggggaggtaacctgctaagttctaagaatgatcttgtaccaaggattgcagagagctccagcacacctggtgtggcagtgccagctccagaatgtgctgagcatgggtcattgtgaatgctcacatgccttagacagaggagaacatcagccttgactgaggtcattcactggtcccaggcaggcacagacagcctcatgttgtttgcaatggcaaaaatgggaaacagcctaaaagaccatccatacagagttgctaagtcaactgtgatattctcacagcacttagtacagcagtcaaagcaaatgagactgatccatgggtggatctccaagaaacattctgaacaaacaatgcaagtttcaaaacagtacttatagtatgataataattatataaaaaaaaacccaagaacaagatttatattttgcaggtacatatccagcatatgaatgtaaatgttttttaatctagaaggctgtactccagattggtatccgactcatctctagatgggggttagggatatcagtaggaggaagggcttgataaagggggaaccttatcttaatgttttactcttttagaaaaggagaatgcattcatatattatttgcaacattaatattgaatagttaaagagtcacctattgggggagctagggttggtgggaagtcaaaaataaaatatgtctttcctggtcattatggtataatgggacagaaagcacaggtgaaaaaagtaaacataagaacatgtctaacaaggaggacatgaaactcattataaaaatcacattacctcatatttcctggaccatcattctagatcattcctgtggaatgtaaactggttagatcccattacaaccaaccccagggacctgtccaaattatcttgtccaactggaatcttgtattcagatattactcaaaatctgcaaactacatattgaggcaggaagcagttgggtgggggttcttgtgtcatgacgaaactgtactcagagttgtgtgttgctggggcacagtggctaagggcatgtgctccagggccagggcacttgggtttcaagaccagccccagcgcttactgtctaagctttgatgagtgatttaacctctctgtgcttgatttctcatctgtataatgggtgtatagtaataactgcctcactgggtaacaggaaaaataaaatgacacagtccatataaagaaagcccttaggataggactggcacagagacgccagacaggtaagctgaaatgtcaccaattaggccctcagaagcttaaaactccaaaaagccagagagccccactccatctagagacagaagtttcttcctgtgccccgttaatgtagacatcactttcaccaaatagctcggcctgcctccagggaagagaggcagaaggcagtgttaaaggttttctagataaatgattttcaccttcaaagtttaactacaaacctatttcccttccaacaatgctgttaggaaaacattgttttttaaaaagtaattattagttgacagcttttccttgctcctggaaagaggcatctttgattcctgaaggaacacataggggttccaggggagccttgtggggcttccatcggctcttggggattccctggctggctccgctccacctgggagctggctgggctccagcgcccctttcaacttgtgcctgtggcctgagtatgaactccagcttcctcctgcctctcctgagttcccctttggcagatcctgttagcaggtgagggagttgtggaatattgggagaggaagaccagggtgaactggcacctctgggcaggctcaggatgggaaagccagttaccattgagtttgaatcctggggttacctgggtccggctggagggtgttgggaaaagtttgggttgatcttttttcccctttaagcagatggagtttgcaacttctcgtgcagtttcccaaccttgtgggtttaggaagacccctgtgcttgtgggggcctctcaggtccagagcaactcgggacctggttccaagcagatggagagaggtacggaaggaaggtggtggcagcggggatagagcatctaggagaggtctctgcacatctatgcataaagggaaataagacccagagggctgagctcaggccctgagaatcaccgcctcggggcctgccctcaggagaactctccacccagccagagcctgtggacatcaagagagctggggaacttgtgtgacactgaagccgctgggagttgtcagatatgcaccgtgctgtgggtctgtgtgggaaatcacacctttcctatacagttgaggactcgctctgtgagcctcattttggatggttgtgtgcatttgatccaggcccagggtattcacggtgttcacagggtgtttggccaaatcctattcctaatggactcaaggccctgtcagatcagaccctcatttgtgcagtagaaaatcaaaagccatctccgccctttgctgcacccccagcctctccatggggtcaatgtgggattttcatacagcgggggaagctcttttgtaaactggggaaaattgtaagaagctggaatgtcctctgggtgtcagtccttggcactgttcattggctctaaatttctgggtgacgtcttgtgagtgtgagtgctaggagccttgggggcatcactgctcccccagtgactgtccagcagggctgagaatgtccctttcagggagagaaatcagctgtgtgcaaatagcacaatatgggaggtacatgtttgtcaactgatgttaacgatgtccgctgggaaatcagtggtggaattataagttttccaaccaggaagcccttagagatatctagcaggatgacaagtatctggcactcatgttgctatctcccactcatgcctacagcagacatcactaattgatcatggcattctcctgtcctgtacccatggcaggcattgttaattgattacgagcccagacatggtctcagagtctttctaaaaaacaaaaccgagtatctttaggaagtcactacctatcagttggcaatggcaccttgagatgaaactaactggccgccctctgatcttgcccatttcccttatttgacagacaaggaaatgaggtcccaagcagggagtgatttgtccaagatcacagcaagtgacagcaggactagaactctggtactctcgcttctagctcactccaatctgagttcctagccttccactcagaagtcctctttctgggccgggcgcggtggctcacacctgtaatcccagcattttgggaggccgaggcgggtggatcacgaggtcaggagatcgagaccatcctggctaacacgtgaaaccccgtctctactaaaaatacaaaaaaattagccaggggtgatggcgggcgcctgtattcccagctacccgggaggctgaggcaggagaatggcttgaacccgggaggcggagcttgcagtgagccgagatcgcaccactgctctccagcctgggcgacacagcgagactccatctcaaaaaaaaaaaaagaaagtcctctttctgtttttggctgatgagggcaggaagcttctgttgcctcactgagagtgtgcctggagggaggggtggggaaccattcactctgcctagagagaagctgccgttgcaaagagctgaagacttctctctagatcccagaaaggtcgctggtggctccctcccaggctcagctgcttcctggagctcagcccacatctcctgcacaccgtcacctgcctctctcattgttgaataataaaccccagctttgccaggggcagtgtcagagtcagctcacaccaccttcatgactgttcagagctgcacaccttgttttcctggtgtgcagtgtcatgtcagggtgtgtttgggtgtcacgtcagggaggcgttggaatgcagttgcagcctctgccacctccttcctcctctgctcctaggcccaaaggtccaacttagaaaattcagctctgcccctactgggccttcatcttacccctctttggataaccaacaggaaagttgtctggaaagtgtgttgggtgacagtgcccccctccaaactggagaatgaagggaagggggatctttggtggtggccaggtgagtgttgtgtgtgtgtgtgtgtgtgtgtgtgtacgtatacacaccctgtgaagcttcaggtgtgaccaggtcactctcttcctgctggagggaatttcaagtgcctcctggcacctctggaggagcactagctacgtgcctgactccatgcatggtgctggggaccctaaggggaaaatccagagtcatcctgggtgaaagagccctcagctggcagagcatgagggtggaatgcacagaacgggtgttgccgcactaagtgggcagcccaggatgtagaccacctgcatcatgcctgcatgctgtgggcattccctttggcttgtgggggcagcttcgatctggggcctgaaggtcttgacatcctggtccttctaccccccccatcctcccccactgacgatggcagcagctggttttgtttttgactcttttggaatgaggcatgtagggcagtctggtaagctatgggagcctgagctgtgggcttttctgagggaagatagagttattcgtccctctgggaggcaatctgccaccagtgtggtgaccgggagatgtgagctgcattgattccctcatcagcagcccccgccccaggctggacctcagcttcctgatgatttcagttgctgccatccctgtgtctcagggacactagtttattttattttattttttgaggcagagtcttgctctgatgcccaggctggagtgcagtggtgtgatctcagctcactgcaagctccgcctcccgggttcaagcgattctcctgcctcagcctcccgagtagctgggattagagtagctgggattacaggtgcctgccaccatgcccagctaatttttgtatttttagtagagacggggtttctccatgttggccaggctggtctcgagctcctgacctcaagtgatccgcccgtctcggcctcccaaagtgctgggattacaggcgtgagccaccgcacccggcctcagggacactagtttagattggaacactgtgggagtagttgggatattggagctttttcctttatatcctcaatttagctgaagccaaggaaaaaagattttagatctcccagagacctccacagatggatgacatcaggctctccaaaggacttgtgggagtcctggtgccaaattcccaactttccaagtagggcagcatctcccagagatggaaggttcaggctgtgttatcagccagacttatttgggtttgcgccttggcctgcccctttaccagctgtgtgaacctgagttaccctccaggagtctccaccttcccatctgcaaaatggctgtactcgcagagcctgtcccatagagctgttgtgggatgtgaagatgagcctcaggaaagccttgccatcatggctggagcagcggtgaagcattattattatgagattgttggtgctgcctctggcatccctggagaggggaaggggctccgatcctccctgtgaacagaatgcatgcccagcctggattaggggaacatttttcccagccacagaagggtcttgggtacctccaagctgcagtaaatcaatgctttggggctggtgaggagacagaccccaaagccaccagggtttggctctatctgctaattatggagccttgatctggtgctcagtaaacaaagtggccggttcatccaccctggcagtcttgtgctcagtgctggctgaggggctcgggaagagcccaggaatgtggtccatttaggtataccttgttcaaaaagattttttttgtttgtttgttttttgccaaacaggaagaatgaggctggtgtttgggctggagctaagatgctggcagagggtctttgggtgggtgacaagccagggccattcttcctgctgagacagtcccggcagcacctcccgagggcagccctggcggaggccagcctgccttgctccccagggagacaggcttggtttttttctgggtttcccagggcttcactgctcatcttggaacctttgaggaggaatccccagtgggagggtggagggaaacccctctgtgtgtgcctgcccccactccatccagcagtgcaacagggtggggaccaagacagaagagactggggccaggcagtctggcaaagtgccaatgttttaagaaaactgtgtaggaggactccaaaatgggagactctatccattgctttatatatatatttggtgcatattgagaaaagtctgctgctgcctgagtctggcagttgggacagtttggaatacctgggtttcttggctgtgtagtcaagaaccagggtgcgggctggagccatgggcctgtgccctggatgggtgacagaatcacctgtgatctgggttcacctgcgagccagattaaaaatgcatccagattcctgttccccagcagcctcctgaatctgactgtctagggcaggctccctgtgtctggagttcagataggcttgataagtgaatcggatgcaaagctggacagaactgtggagtgctgggataaggagaccctagggcctgaggagctccctgtcacagctgctggtgatgcctgcaggtgacctcagtcccagcggccaagggcttctctcacctctgcactttctcctcagctcaggaagggcaagaaggaaggaaggagcttagggacaaacctgacttgctcctcctgaggcaggggaggttggggagcaggggtcacccctcaggctggggggactctccgtaggaaccagtgttggcacgtgctttgtgtcaggccctgccccatgtcctttccatgatcacccctgaactgcttacagcccaccctgggatgtaggcaccaccactctcccccatttttcaaaatttatttttattttatatttatttttttaagaggtctcactgtgtcacaaggctggagtgcagtggtacaatcatagctcattgcagcctcacccctgggttcaagcaatcctctcagctcagcttcctgagtagctgggagtacaagtgtgcaccactgtgctggactaatttttaaattttttgtagagatggggggtctcgctatgttgcctggactggtctcaaactcttggccttaagtggtcctcctccattagcctccttagtagctgggattaaaggtgcaagccacagccccccaacattcccccttttttaaaaaaaagagatgagggtactcaggtcacataggatgtcaaggtctcaccacaggtaggtggaggagccaggattcagactgggcagtctggtgctggaatccatgcgctaagccgttcctctctgctgccactttgatgtgctgcagagccagcctgggaagccccacacctcgaagaggagaggagtcctttcccttccttgccaagaaggcttcagctacagagcagaaggggcaggtgggggctgggcatagagagaaatggtcagtttctgtatgttcgtttccttgctctgctcaggagtcttggattctccctgtggtgttctctctctgtctctctttcctcagtttctctatttctctctgtctgtctgaggtctctgagcccatctctggctgtggctgtgtttgttcctgtgacctttccctgagcctccgtctacgctcttatgtcagcctccccggaggctttttctctcgccctgattctgtctttgccagtctcgtctgcatgtctcatcccaggatgcggccgcatcccaagcagaagtctgggagaagggcaggtggaagcctgctctggtctgcatgggagtctcctgctgggattagtgaaggcagaagcccttgcaggggaggaaacctgcttcccctcctcaggagactgtggggatggggaggcagctttcccgagagtggctcacgtacagacgcgccttttggaatcaggcggcagtcttggcacctgatggggaggctgtcctgcctcctgtgggcagccgtgatggccagccattgctctgtccccctcccagaagagcagtgactgcttcctcccttccctgggccatgctgtgcccgggggccctatgagtacaaggggctggcagtggcctcagccctcactcaggctacccccggagagtggggttcagagtccctgtgagtggggttaggggcacggagggcaggagtcttgggccagctcttccccttatctgactggacagagggtccccgggtctcatctgtctgttccattgcctaatccctgcccacccccatgctagctgttcctctaaggccacacctgccccattgctgttcctgctagaaatagctgagcagtgggcaggtgcccaggaaagggagtggctcttgcagggacaggctggcccccaagctgtcagcgatccaggtcaggtaggtgtcaggaacaggcttggggcagggctttgctggcccttgaatatcttctatcagtgaacagccgttttctctggtccaagcctttgccatcaactggaaggaagggttgggggtgagcacctgatcacatttgttgagcacctgctaagggcaagtgttggtgttcagagtggggctgaggggctggagacagatgcaacccgagctgacctgcagactggttacccgtctaagcagacacgcctagtaggctgccgctcccaggtgtctctgcgtgtaagccacacatgtgcctccacctcagtgtgttccaaacccagctgccatctggacccctccccacatcctccccactcccttctccttttcccccttctccccttccttcctccttcttacttctcctcctcctcccctttcttttcctcttcttcctcctccaccccagcagacccatcctcctgcctcctcactgcaccccccgagtttttactgggactgtcctgccctccagccagccgctgccagtgcttctctgtgctgcagcttctctccagtgtttatttgtaattaggaatgttttcaatcctatagaaaatgatatcacaggcatgagaggaccgactgcccagatttaacacgtgaatattttgccacatttgcttcagatatgtctcttttaaataaataaaatggtgcagatagaagaggtgtctggtcaatgctacattcccttcctcctgccttgggtctgcgtgtaggagtggaactggaggtggagaagggctggggttcaggtaggctgggaaggcgctccaggcacgggcatccacgtgggcaaggtgtgggacaggaccgccttgggcatgcacagaggcttgggcgacccctgcttctgtgacctcttggggtctgaagtccagggagggcgggacctggaaaagggcaggcctgcacacaggtgccccagcaacccccgagcagccagcatcttctctccctgcacttcctcctcctcctgcatctcattccaggtgggcagctcccctgtttgaaaggagcccatcacctgggtcagcagctgggctgccacctggagaagtagcctgcagctgggcaccagggtgggcttggaagacagcaagctttgcggggggacttttcctgttgcattcccaggtccctggcaggaggcagtttttcccccaaggagagcctcattagaagggctggcagcagagcctgggaagcacaggctgccccgggcggctcgcctcactgcgggggctgctttacaaggcttccctggcaacactgcccgaggtttatttttagctctagggattcctctctttttccatctgggctccaccttgttctccccttttcccactgtgaaggaacactgggaagtccttggcttaaggagattccaaaaagaagttataggagacgtctatgggcaaaataaatgcctgacctcagtgaccagggaggaagccatccaagcagcagatgccagctttgacaccttcagacctgtacggggcacacctgtgcctgggtcagctgctatgtgcatctaagatgccaaaagggattcaaacccggttgggaccaccccacacctggccagtcatgtcccatatccagcccaatagcaagtcagctcgtcctcagctcatcttctcagactctgccccccagagacagcccggatctgccctcttcctctgcatcgactctgcccccaccgtggtccagccccgcatcaacctgtcacctgggcaactgagacagcctcctcaggggtctccacattctcacggtcacctcctccataatccagtcttcccacgaatcagagccctcctaaaacataaaccctatcctggcagaccatggccttgaacctttctgaagactccctttctttttggaatgaactccaaactccttgcctgcccccaggccctgggtgatggccctgcctgcccttccagacccatctctgtcaccctcctgtcacttgttctcagcaccccagctcgctcgcttcacctgctccttgggcaccaagcgcagtgctgccaccaggcctttgtccttgctgttccctctgcctgcagtcccttccctcaggtccccaaggagctgactcctgggcactcagcctcagctcacatggcacctctcatagaatcagagagcccccccccccaaggcatgcattcatttcatgtactcttggtcactttgtcacattctactgtcttcaaaacacttattacaacctgttattatcttttttttttttttttttttttggagagatggagtctcccagtgttgctcaggctgaactcctgggctcaagccatcctcccacctcagcctcccaaagtctgggattacagggatgagccaccatgcccagcccattgtcttcttaactgttgtttactatgtcattccccacctccctccccttctccccagaatgtgagctttcagagagcaggatcttgcctgctccatagcttctgttttcccgatgcctagaacagtacctgccatatagtgtgtgcttgggaaatcattgttgaatgaataaatgaatgcatagtgagctgccgctggttatgaaggaatgggagagagaggcctgctgtcctcctcctccgctttaaaggcaagttttatttagctcccattcctcctcttgtgtgcccatctttgcctatgggctagatttactattgggatctgcttgttaaggattagatgaaatctttatggcagagaacaatgaggacttctcaaattttcatgtgcacatgaactacttagcaatcttgctaaaagattctgattcagcaggtccgcctggggtttgagattgtgcttttccatcaagctctgagatgatgtcagtgccacagtctgccttgagtagcaccggcgtggaacattgggaggatatgtttgaagtccctcttctccattcctctcttattcttctttcggtcccagtgtgatctttcccttgttaggtcatagcccttcgtgaccaggtggggatctgatctggtgaacttgggctttgtgaggagccctgttgcagcacttcccagaggctgcccaggaatggcgtgggctgcttcagagaggcggtgggttcccatcgttggttcctctgagcttgagggtcatgtgtcaggcatgctgatgtccctgtggcaaggaggaggctcctccctgcaattcagctttgtgtctctgtgtgctttctacaagcttgtgaaaccaggatcttgaggtgtggcccattcacctagagtgactttcagaggccatctggcaagtcctccacccttctcagtccttccgggggaaagcatggcattctaaccactgtgcatgtgggtttgatagatacagctgtgggagaggagtgatggtttagttccagcaatagttgagtcatgcagggaatgtaatgcctgacttgattggatctaaggatagaaccgcaggaggaatctacattttctattgccttccctcttttagtttgtttcaatagaccttgattgagctcctctgtatgagtcagggcaggctaactgctgtataacaaactcagtgactcaacatatttattttctgcacaggtcccagacctaaacaagtcactagagggctctgctccaggcagtcattcaggaactcagactcccccagctggtgaccccatcctgcgtggagttttgcatctagccagcaggcaaaggaagagagaatatgaaggactgcagggagattctgtgggttatgccaaagggaagggtacattaccctgctcatgtgccactggtcaggatttagttccatgattgtacctcccagcaagggaggctgggaaatgtattctagtcataggtccaggtatgtgttggataccatgatggacagtggaaatatcaaggcacagacatgactttcaagaagctcacaggcttttggaaggaaacagtttcacaagcaaatcattaagtccagtatggtaagcatagttctagaagtgtgaccgatctgcaggagtgatggggaggagggagctgtggaacagcaggttacacctgtggagacctcaggcaggccaggcagtgtgcagggacggacaagcaagggtggcagggcgtgtgactagagaggtcagttgagcagaggtcatgaataggcttgtgtcccacaggcagcagagagccaacaaagggtgtgaagccgaagatgaaatctgcagagtggggagcaagttgcagcaacattagagactggttcaaacttagcactctccttgcctggacctgcagagaggtttcacatgtatcttggtttctcatgccaggaaatttctaacagaggaggaaggggtggcagtggggaggtgactctccaagtcacctggtgcaggcagtgcttctggctggagtttgctgcgcctgcctgacctttgagggttccactcagcaacacagggcctggatggtggcttccagtgtcttcaaggatgctttcattgccctctcctgagttctaggatggcccagccactcttatttcctgggaaggccaaagaggctggtgctggttcacagccccagggctccatattaaccaggcaaggctacagggaggagctgaactctgcccgcttgaccccagccttctgcagtagcctactctttcgcttttccttttgacaagactttggaggaagaaggttctgagacctatgggcaccttgacccatttggaatagagaaaaaagtggggaatggagatgcttggggaagggaaggagaaaggcaaggatgttagactgtcatttagaagtgttccgcttggcttccctttccaggaagcccatcagggttgcacactgggggcctgctctggaatctccttgccttgagcagcagcctgggcccaggcccgctgagggtctgttttggcttcatctttgccaaaaagtgctctctttgtcccagatttcagtctgaatttgatcccgtagtggccagggcacttggggtaccacagttctaggccatttggaggatgagaagaatcaagaacaattggggctaggggtgtggttcagccgggaaaaggttaaagccgtttgccttccttccccttcccccttcttcagggcctcctcctattttggatagtccttgcagtttgtgtgagagagaaaagtgtcaggcagctttggggagaatttcaaaaacctgtgagtggtctctggcaaggctaggggatggctagagacccccaggaggaaacagagtgaccacagccaggaacctgccagaaaacacctcaaatctgggcagacttccttctctgcggagtgtcaccaccggcgccctgggctggtgccaggattcctctggctggctgtctcacacacagatgtttcttgcaccactctccgtcctctgtactggccagatgtgtcttcctagaattccactttcacagtgttccttcgctgctcagcagcctcaggggctccctattgcctggaggaggaagtccgagttcttcctctgtttcagatgacccctgcagccctgcccctcacactgccccatgtataccctccctgctccagcaccaggctcccccagctcccacacttcctagggaccaaagggagggaagttcacaagcagccggggctggcacacgggggtatcaggaggatgctggggtgtagctcccatccatagtaagaagccggccccgcacggcgcctcatgccaggcgggtggatcgcttgaggtcaggatttcgagaccagcccggccaacatgaggaaaccccgtctctactaaaataccaaaattagctgggcgtggtggcaggtgcctgtaatcccagccactcgggaggctgaggcaggagaatcgcttgaacctgggaggcagagattgcagtgagccgggatcgtgtcagtacactccagcctgggcgacggagcaagactccatctcaaaaacaaaaacataaacatagtaagaagccatgcctcaggttctgtgactcctggggagacactattccttctgccaggagccaggctcagagctggccacttgcagaatctcttatctgactccttttgtcactagctccccaggtgctctgctgccctggcctcatgctcttccctcttggccaaggggagctgaagtcacctgagctatctgtgttgggacaaagctcaacagccttaggatgagaaagggtgtgaaattataggtgaaaaacccaaaaggccttacagctgttggaagttagggttagatgggcttggcaggtggccctgagcagctccctgaaagcagaaagggctggaggagggcatcagagatcagggaaacaccaccggagtctctttaccttcaaactggcgaccccattcatctagcactcacggtaaggccagcacacctgctcacctgtattctcatttcatccgcacagtgccatggggcgctgtttctactcccattttacagatgagaaaatggggtcacaaagagattaagtgacttggccaaggtcatgtagctaggaaagaataagctggagttctgacttcagccctcaagcattccactactgactagaacactaataatggtaaaacagtgccaagggaggtgcctccttctgggggtttcctctgtgcctggcctgtgttaaagcgctctacctattcatttccccccgccttttttttctggagacggagtctcgctctatcgcccaggctggagtgcagtggcacgatctcggttcactgcaaactccgcctcccggattcacgccatttcctgcctcagcctcccgagtagctgggactacaggcatccgccaccgtgcccagctaatttttttttttaatttttagtagagacggggtttcaccatgttagccaggatggtctcgatctcctgacctcgtgatcctcctgcctcggctttccaaagtgctgggattacaggcgtgagtcactgcgcccagcccattttccctttttaacttcagccaccatggaggggaaaaacaggcatggtcctattttacagatgagtagactgaggctcagagaagttatgtgggaatgatgactcctggcatttggcagcacttgcttgcatcttctccttggatcctcacaacacgtgtggagacaggcaggtccagcatttcacagataaggctgtggttacccagagaggccaagccatttgccccagttgcccagcaacttcttgcaggctagaactggaatcctcctctgttgactccaacctagtgctctttctctcctgcacaaaggccatgggtcagcaggtgggggtctgtggaatgaggccactggggtaggtttggggacaggcatcggtacttgggcaccttttgggcatcagagagaggctttctgtggcttgaggatttcccctgggattgcatcctccagcacatctttgcttaattcaccctgtgtatatctcactgcaggtgtcgggctatccgcccaggcctagcatgttaaatgtcacgtcctggccagcccccacccacggaatgagctgctgggaaagccagaggcctcctccccaaccctggcccacgcacgccagctgggcagctcccctggggcctctagatgcccagagccaagctggcccaggccaagacgcctcccagacccatccacccctctcagtctccctgccgcctccctgacctcagggttgtagtttcctaagcactttccctggcatgagggacgcagcctggtgtcataacaagagtaatggtgacaggggtgataagaatagccggtgtgtatggagcacttactcagtgccaggctctgtgccaagcactttacctacattatctcatttaatcctctcacccacctgaccagtcaggttttgtccctgttcccatttcacagatgaggaaactgatttgaatgcagagctgcctagctattcacgatttatttttcttcacattttctaaaatgttgtgcaagcaccactgtgattcaggaagagactcttcatagtatacggacagatatttatcttttaatggttatgttttgttttaatgtgttaatggtatgggttgaagtttttatgtattcctcccaaaattcatatattgaagtcctagcctctggtacctcagaatgtgaccttatttgggaacagggtcatcaagatgtaattagttgagatcatccgggagtagggtggctcctaatctaacatgactggtgtccctgtgaaagggggaaatttagacagacacacacgcagggagagcatcatgtggagatgaaggcagagatcaaggttctcctttttacaaaccaaggaatgccatagatgacttacatccctgaagctaggggacaggcatgggacagaccctctctcacagccctcagagggaaccaacctgcccataccttgatattggacttctagcctccaggactgtgagacaatcaaactctgctaagacacctagtttgtggtactttgttacagtggccctagcaaactaaatagttagaatacacacacacacacacacacacacacacacacacagacacacacacgcatgcacacacttttttttttttttttttgagacagtggtgtctagctctgtcacccaggctggagtgcagtggcatgatcatggctcactgcagcctcaacctcctgggctcaattaatcctccctccccagtgtcccaagtagctgagaccacaggtgcacagcaccacacccagctaatttttaaatctatatattctgtagaggtggagtctcaccatgttgcccaggctggtctgaaactcctgggcttaagcaatcctcctgccttggcctcccagagtgctggaattacaggcatgagccacggtgtccggctatacacttatgatttgaagacagagaaaggggccatgagccagataatataggtggcctcttgaagctaaaaaaggcaaggaaacagatgctcccctagagcccagggatggaaatggctctgctttccccaacccagatgctgtagacagcagcttagtgagtgtgtgttattatcgagcaggcatctgagacctcccacctgccagtccccatcccagagactccagccacatgtagtgccgtccttgagctgggttctgaaaatgacttctccatctcgtcacactgctggtgatgctttagggcaccctaattacccctgagagtggcacatcaggcatctgccctcatccagccctggtgccagctgtgtggtcatcctcaagtcgctggaataaatgatcaggagcctccaccccggatcccagcactttctctgacatacggcagcatttcatggaatccgtgagcaaggcaaatcactcccatcccactgcttcctgtagcaatcctgacaggcccactgccgagcataagtccctgccattcctccccctggaaggccttcctcccatttcccagctctctattcaaggcctggctctgatgtctcttctgagacatccttttgctcactccagccacactgatcttgtcctttcctaaactcccatcgcctggcttttcataccactcagcaggttgacacccacttaatgctgctagttaagtcccttgtacccatgtgggtgtcccagctcccactcggatcacagaccatgactgacactcctgaaacctgctgatgtggtaaaggcctggttgggaagggacttgaagtagtgaaggcttgcatgttttccagaaaatggtcaaagaagacttctttgacttgttaaggaactttagaacctggaatgggctccctgtcaaagttggggtgtgttctagcaccgtgcttcctcagcgtggcatgagccatgtcccagctaaaagcatcccaactccttgccagggtggacaggtcctctctctctcctctcgctctctccctggctgttccttcaggcctatctggggggccactagtatggaaatggtagaagagtcacttaacttgaatatagatcattagaaatgatcaaatctgcataacactccaggcgtccagctgggacaccggaagggcggcactttagcagcaaggacctaagtaagaccctaaagtaaggcctactgtaaactcaccctaatcaaacccaagaataagtcctaacaatatccacagaggagacagaatttggaggttgagtcacatcaagttagaggtacttggaaaatacctaggactttccatagatcccccctaagaaagcataaaactctgcctacgtaagtttgaggtgattaaccattacttgaattggctactagaacaaaaatcaacacttttcagagaaaaataacagaatccagagtctctacagcatattagccacaatgacaagtataaaatgaaacattactaagtggtcaaagaaataagaaaatatgacccataggtgtaaaaaagtactagaaactaacacagagatggcccagatgttgaacgactttcaaacagttaaataactaaaggaaaatatggatttaatgattaagcagatagtagagaaatggaaactataaaaaatagagtcaaatagaaattttgaaacttaaaagtgccataattgaaatgaaaatttcactggatgagcttaaccgctagtatggaaatggcagaaggatcacttaacttgaatatagatcattagaaatgatccaatccgtataacagagaaaacagaatgaagaaacacacgcacagtcccagaaacatgtagtacaatatgcagtcttctgacttacatgtaacaatagtcccagaaatagaagaaaattataatggagtagaaacaaaacttttttttaaatggccacaaattttccaaatattgtgaaaattatcaacttacagattcaagaagccctgtgaactcccaaagagaataaatataaagaaaatggctaggcatgatggttcatgcctgtaatcccagcactttgggaggccaggacaggaggaccacttgaggccaggagttcaagatcagccagggcaacatagtgagaccctgtctctaaaagaaaaaaagacaattaactgggtggtgcacacctgtaatcccagctactcaggaggctgaagtgggaggatcacttgagcccagaaagtcaaggctgcagtgagctgggattgtgccactgcactccagcctaggaaacaaaagctcgaccctgtctcaaagaaagaaaagaaggctgggcacagtagctcacacctgtaatcccagtactttgggaggctgaggcaggcagatcacttgagctcaggaattcaagaccagcctgaccaacatggtgaaaccccgtctctactaaaaatacaaaatattagccgggcatggtggcacacacctgtaatcccagctactcaagaggctgaggcagaagaatcgcttgaacctgggaggagggggttgcagtgagccgagattgcaccactgcactgcagcctgggcaacagagcgagactccgtctcaaaaaaaaaaaaaagaaagaaagaaaagagaagaaaaaccacacttatcattattgtccctctcttcttctgtgatgctcgctgatgtgtcccctgcatgtaacacaggggactgcttagtcctcagctaagtagaatgaacaaatgaattctgaggtttcccgcaatcttgcatggtccccacagagactgggtggccttgtctctttttttctctttttttttttttttttgagacagagtttcactcttgacacacaggctggagtgcaatggtgagatctcagctcactgcaacccccgcctgccaggctcaagcgattcacctgcctcagcctcctgagtagctgcgattataggcgcccgccaccacgcccagctaatttttgtattttcagtagagatagggtttcaccatgtggtcaggttggtctcgaacccctgacctcaggtgatccaccccgccttggccttccaaagtgccgggattacaggcgtgagccaccgcgcccggctgtccttgtctctttttaaggggaatttctgggtcaggaaagccaccagctttttgtagtaatgcacccttttttcttgagctagatagaaagggcacaaggatgaaggtttgaggattggggcctgaaagcttgagtctctgggagctccaccctctgggaggggcgaggagccggcctcttgggttacagatgtgccccagctgggctcgcccgtcctcccctctcccctgcgtggattgctgcggagccctgccctgggagagctgccgaatcagctttctctggctggagccagcgcgtggagcccagctgtcccctatctctcacacgatccaccctttagataaacagcctggccgcctccacacactgcgaggttctgatgtggttgcgaggggctccattagccaaatgcctctcactccagccaggactctggcgatgggccctgcttttcctccagcctgagtcaggcccgtgctggagtgacaggagaatctgcttcctgcctgcaaaggtggtcccggagaactctctgctgggcggggccttcctgcctcaccgcccccgcgcccagccttcttcctcccagagggcggggcagcaggttcaggagacagccccgctcagccccgattgttttatctgtggaaactagccctgcaaattgggtactgaccaggttagagcccgctttgcagcctgcctggccctctaggaggggtgacatttgaactgtctctcaccgcccgccgatctgacgtattgagggccaagatgctgaactgtgcagctttgcaagtacaagccccacacagaatgaactcttacttggtttgctctggagtctgagcccagagatttgctttcgttgaaagctgacctgtgggcagaaaaggtgtccctggcagctggttagctgtgcttccgttttccgcggccagtggtccatgggggtgggggatgactgacggagagcagctccggggctctgctggtttatcctggtggtgggattaggtgacaggtgtggctgggctcagcacctgaggtcctgcccagacctgctgaatcagaacttgccaagagctgcagatgcatgttgaaggttgtgaagcctggctccttgatgtgaaggctgcagggtatgtgtgtgtctgtgtgtgtgtgtgtgtgtgtgtgtgtgtgtgtgtgtgtgtgttgttttgacggagtctcgctctgttgcccaggctggagtgcagtggcacgatcttggctcacagcagcttccgcctccgaggttcaagcgattctcctgcctcagctgggactacagatgtgcaccaccatgcccacctaatttttgtacttttttttagtagagatggggtttcgcaggctggtctgtgaactcctagcctcaagcagtcctcctgccttgtcctcccaaagtgctgggattataggcgtgagctactgcgcctggccatgaggctacagtttaacttatttctagcacctaaggcagagcctgacatggagaaggcatacagaaacggttcttgggggaaaggaatgaatgcatgagtcctgcctgcccctgcccactccccacagcatcacattccctctgcactgtgagaatctcagactcttaggtctgaaagagatggaggagtcggagaacatatgcatgtcagagctggggaaaaaatgtcaagttttggtagcctaactcccttaagccccagagagatatagcaccttgggtgaggtctcaccacttgtggtggaatagcgggtcaccttgtttcaggagacaggtggttgagataaggacaaagcgttccatacctgggcgcgtgttgctgggcccacctctctcctcagacatctctgtacctcttcatcagaaacctatggagtcatttctcagaggccccaatgacatgttagttatccatttatgaattctcattcttcttatggaaaagatttaaggtacttataaatatgcatagaatacaacaagataaaaagtaaaaagaaatgcattgttattaaggaagtgtgcgtagacatgtgaacaaggggattcacgacagtgctatatatagtagtgagaagtcagaaacaacctaaatatccaacagtaggggagtgggtaaatacactatggcagcaatatcccaccaccaggataagccagcagagccccggagctggtccccctgtcagtcatcccccacccccatggaccactggccacggaaaatggaagcacagctaaccagctgccagggacaccttttctgcccacaggtcagctttcaacgaaagcaaatctctgagctcagactccagagcaaaccaagtaagagttcattctgtgtggcacttgtagctggcaatatccagacattgaaattctgtgtcctgattgagaatgctgacgtgtcctgggcacagtggctcacacctgtaatgtcagtgctttgggaggccaaggtaggaggatcgcttgaagccaggatcttgagactagcctcacagtgagatcccatctctacaaaaaagtttttaaactagctgggcattgtggcacacacctggtcctaattacaccagaggctgaagtgggaggatcacttgagcccaggagtttgaggctgcagcaagctgtgattgcacactgtactccagcctgggcaacagagtgagacctggtctcttaagaaaaaagaacattgatatgaaagtattcattgacatggaaaaatgttcattatatagtgtgaaagtattgatgggttcattttatttacatggatggaagaatgcctagcaaagatagatatcccaaaatattaatgtcagggagagagattatgagtgattcttagtttctttttgaccacccactgctataacttctagttttttcccttagcgaacatgaattccttatgtcgtagtgtaatatagaaatgaaatctacaaaaacagaatatgggtgaggaaaatgggaaaaggagaaaataggagtcctaatctgtatagaatttatttgaaaatgtattaatttttaaaatcctttgctgagcattaaggtataggaaagaaaaaaaaatcctgtttagagtgttatggcccagttgctgtttttacacatagcaggcaattattaatgtttgagagtttgacttaaaacattgagaactcacgtggccaggcgccgtggctcacaccggtaatcccagcactttgggagcctgaggcaggcggatcacttgaggccaggagttcgagaccagtctggccaacatggtgaaaccccatctctactaaaaatacaaatgttagccaggcgtggtggcacacacctgtaatctcagctatgagaatagcttgatcctgggaggcggaggttgcagtgagctgagatcgtgccactgcactccagcctaggtgacagagacagactctgtctcaaaaaaaaaaaaaaaaagaagaagaagaagaaagaaaaagaaaaaatcatgagccagcttttgttaaatatccatctgtattcagggaagtgaaagttaatcatgctgcagtctttgtcttgttttgaatgtaatcaccggtgacctgcccttcattatgtgggatctaaataacctgggtatattgggtaatgattatgcaagagacaatcctaaaattgtgtgttagagctggatgggtggacaaacggatggatggatggaaataaatgcgcgcgcgcgcgcacacacacacacacacacacacacacacacacacacacacacacacagagtctagcctagaaccatgctatagcttggatatttgttccccccaagtcttatgttgaaatttgatacctggtgtcggaggtgggcctaatgggaggtgtttgggtcatgagggctgatccctcatgaatagttggtcctgttctcatagtaatgagtgagagccagttgttaaaaagagcctggcgcctcccccttgccctctgcttcctgtctcgccctgtgatctctgcacatgcccactccccttccatgccgtgagtggaagcagcctgaggcttcaccacatgcctagtagattgtgagccaagctaaataagattcttttcttgataaattacccagccttgggtcttcctttatagcaacattaaacagactaagacaaaccgcttttcaccacctccagtgctaacaccttggtccaagtcaccttcagtaggatcctaactggtctccctgcttccaccctgtggtccattccctacgccgtagctagagccgtcttttctaagtgtgaagcagatcgtctgtctctgcacagaactctccaggacttccccttccatcacgacaagccctgagtcttcaccacagcctcaccaggccctctgtgctctggcccatcctgccactcagatctcattgcctgtccctctcatcctggctcactccactccagccacatcggccttgccaggctctttttgcacgtcctgcttccctgcctgaaacgttctccctctccagcgtagcttgcttcctcgcccccctgcaggtctctgtagaattgctagctcgaggtcaggccttctttgccgccctatataaaatgacaactcctgtactgttcccgtaccatatcctacttgattttcctccgcagcactgatctgatcttccctggcacatgacattcttacttgtttgctgtttgtctccctccaccggagtgtaaactccctgagcgcaagaactttgtctattttctttactgccctttccttagtgcccagtgctgtaaagtggatgctcaatatgtatttgaaagactgattggacttcaaagatcatgtgactgatccttctcattctaccaaggaggggcctgaggcccaaccttgagaggctccattccttgcctgaggtcacacagctggggcagcaggactagatcatgactcccctcctgcctatgcctcagaaaggaaatcagccacacacaaaggggccctggcctcatccatcctgtctcctgtgtgtttttccagtttacatagaatttcagtccagaatagcaaaaaaaaaaaaaaaaaaaaaaaacaaaacagttgttcctccagaaccctggaaactcttccagtgggtccgtccttggaaaaacagcagcgacctcagggtgggaaggtaggaagtggaggaatggtcttccggcagcaggggcaatgggatggatttggttttgcaattaaaataacagctggttctgtttccacagcacggttctggaaggtgggtggtctgtctaaagtatcaggtggggccttcccccatcctggcccaagagggttcgggatggccagtggctgaaggattcaccccacagacgaagtaggaaagaaactaggcccaaaggagcctctggaaaccctacaggcagcctggcctgaaagcctctggtccctaccccagccttgctcggggtcatctcctgacaccttcccctgcactcctacccgctcactgagattgatcagatgccctctttgatgcagagagagctttggcctcctccctctcatgccccatgtggtttgttaatcatctgtgaaatgagggatctcaggcgtcactcatccgtgtgaggacactggggccctggagcagtggagtgagtggggaagggatgatgaggaatgttctggtcttctgaatcctgtccctctgtctgtctggcttctcagatgcagcttttggataagtttcccattgaaggtggccagaaggaccccaagcaaaggatcatccccttcctcccaggtaagcattgggtggctccacccagggatgggggatacccgggaaggaccagtccttcccttaggccgagaagagtactaagcagcagattctgggcggggcatgcccaggaatctgcatatgaacaattcccccaggggatttggaagctccagactgtgaagtccactgtcctccaagtggcttctctcaccattacaagaccgtctctgctggctcctggcctgtagcttctgaggagtttctcaggctcctggactttggtttccttttcacaaaaagcacagagagaccaagttctatgaatggatgaagagctgcaggctgagatgtttgtactgactcccattctaatcacggataaccttaaattgagcgcactccctgatctgatctcctccagtcctcacgtcaccttatatggaagaggaggcttacaccattttggagtgtgtttaaggcaatcaattacattatgtaatttagaggaaaacttctcaggtgtatcataacctgttattttgatgatgtcttaagtgtgtatagagatttatagccatggagtgcttttttatttgttatcatatgcacatctctataccgaggtgtgtactataatctcccccaatgggtgaagaaattggggttcagacaggttaaagaactgcccgtaaaagtggcagagctgaggaataaactcgggcctcctggtccatgtctggctctgccctgcaccagataagcgatgctgtctcttggctctccagaacccctaccgttccccagaagagctcccttcacagtgggcttccccccgggctcagactggccctggacctgcacaggtcaggaccacagtgatcagtcagaccttggcaagaagcagggcctgcaccttgctaacccctggcacactgccagcccacagccagtgcctgcttgctgacttgaaaacggatgtaggggcacctccctcagagagcggctcctctctgaaaggcgtttctcctgcattcctccatcctcaaaagcagcgaaagatgtgagtccctatgaccgcctgtcctcagagtcctatgctatagctagagataattagtttagctacaaggaagaacttctaaattccacagtttgggcaagactggaactagtcagtgagggtgtagggactctcggcccctggcctccccgcacagggtcatagcattgctccttcattcctggcccaggagttcacatggggtgacttgcattccttgcttggctttgcactgggtcttgaatggaatgtccagcatccaggttggtgacaaccttagatggtgctccggtacagtctggaagctcagtgccagggtttggtagcccatctgggatgctgtgggcacaagagtcctagaggcaacctgaggccacagcgtgttaggctggccttggggcatgaaggtcgcctgtttgctccagaagaatgggcttctcccacttcttcctcagctagcactccagagaaagagcaccccatcactattccatcagcagctgtttaccagggctcagcctgtcagagctgatggggctgggtggcctggtgaattaaagggagatctgaatttgttttcctcatctacggaacgctcaggctagtggagagaagacctgctccatcatcccaggaccatttaaggcaggatgtgactgtaccactgtgcaatttgagggtgactggagagggagctcagagaacagtgacctcattgtgagctgaggaagtcagcagagacctcctgaacgaggggggcctggagctggcccccacaggatgggtaggcttggagggtggaacgcagggcaaaggcttgtgtactgccgctacctcagccccttgtctcaggagtcaaactgcccgggttcaccctggaaaccctggctctgctgattaccaatacagagaagttgcattagcttctctgtgcttcagtttcctcatctggaaaatggggataatgatagaatgtacttcgtggggctgtttcaagcataaaataaatgagtgtatctcaggtgcttacaactatggcagctcctagtaggggccaaataaatgttagtccttattattactaatgttccatacatgcctagcattttacaccacaatttacatatataatctgatttgatcctcccaactaggtgatcatccccattttactgactaggaaactgaggccaagggaggctaatagacttgcacaaggctacacagccaggaagcacagcccacaccagagctgtcattcctgactcctgggccagggctcccttccacatcagctgcccaggtgccgagaacacaatagctgccacaggactgaggacctctctgaacttcagtttccacttacaggattgcagtgaggattaaaagaatttacgcaaaacactttgcacaaagtctgtcttacagtaaataataaatggcagctgttaatcaagaaagtcacctgcccccacaccaccgtcacctactgggaaaagtcaagcatggagacaccttccagctcccatgcaaatgtgacctgtgcatagcgggtgatgttgtcaggaggagtgaggttgactcgcccccaccctgtgcccttctttttcctggtttggcttcttttcttgccttgcttcagcagggttccctcttagactcctcttcagctcactcactctccaggacttcaaaacacacattgctggccatttggaatcctaccccggggttcccaagccctgtccctggccttcctcctgctcactagaaactaccttaaccctgttatgctctgctcactccttagctcagacatgaaggaaaaagatggaggaaaaataacgcaacacaatcagaacctggccagggcaagttgagtgggtgtgaggattccccatccacccccaccgccctgatgcacagggcttccaggaggagagggtgtcagagaagggcagtgatgaacattgcctgtcttaggtcaagttcgttaaatgcagagcctgagatgaggattcgcctgctagtggcttttgagggtatgctctcacgtgaacttcctgtggcagggaaggaaacaggatggggcagaagaggaagtgaggcagagatgtgtgttcagctaagtctagcctctgcctgatcccacggggagctctggagggtgaatggcaccacaaaactgttccatcttaggggacagcttttatagcccccccacatcagtcatccattgtctgtgggctgcctcttcttccaaagggtgtggagcatgggcatgatggctctcatggccgggggcatgcatctgaagaagggggcagctggaagcccctagcagtagcccacactcacagcactgaggggaggagccgcagctggtacaggggctcaggacagcatctgctatacacactagcaccagctcaaggctctgcttctgcttccttgcctctagggagggtgtctgaagggaccctgctgattcccccaggctcacccccagcagcagtgactcagcagaactccagagaacttaacagtctttcaaccccagggagggttagcagccagccttgagaatagccttgccagccctttgcctcacctgaaatttcagagcaaggaaatcccaaggggtggaagcagagagcacctattatttccagaagggtctcaattttagctccagagatgctgggatgtgctgagcatttctgttgcccaagtgtggagtctgcgggatgtgcttggagtgttaggccagctgatttgctttggcccatgtggctgcaggctgatggctgagggctcatagaaattttactggctggtggagctgacagagaaattagagacaaagggaaaccatggcttggttacatgcttgcccatctgccagtcaaatcctggcagaaaatctcacacatgggccgtaagtcttgggacctaggacacagtcttgtgatatgtctgggtggtgtaatggtcagttcagggtcagcctgtagatttgaaaagtggtgagtgcctggggctcctgtggtcaaaggcagaagctccatccctggagaagctgacccagacagggctcattggctcttgggggacagatggagtgttgtgcagtggtgctgaggttgggggtaaggattgggggtctgtgagtagggccaacaaggtggtagagtggggagccagtatactgctgacccaggggctgacattggcatatccatcaaatcctatagaaaattttgtaggggaactgcccgtaagagagcccccgaattgttttcatcagggctagaacctgctttctggaccctggaagtgaaaatccactgtgtctgggaccaccagcctttatgaagtctgcagagccttggaagggcaatgagaagctatggacccacgtgggactggcagttctccagcaaggcatcctgggaaagaaaacccagacgtttcatggtcaggaaggggcagagagttactccagagcccagacaccctgaagagtggtggtgggggcaaggggtagagggaaggaaagggagcccccccaggcctatgcctccaaaccccgtattatgtgagactgagggagacacacccatctcttttgctggcctttgcagccttcctttgagacaaggcccttatccgcctctgtcatgtttctatcatgaggctggatggggggtgctttgttaagacatgttgggcgcagtggctcacacccgcaatgccagcactttgggaggctgagatgggtggatcacttgaggccaggagttccagaccagcctggacaatatggtgaaacccccatctctgctaaaaatacaaccaaaaagttagccaggcatagtggcacatgcctgtagtcccagctacttgggagactgaggtgagagaatcacttgaacctgggaggcagaggtcacagtgagcaagattgtgccactgcactccagcctgggtgacagagcgagactctgtatcaaaaaaaaaaaaaaaaaaaaaaaaaagacgtgttgattgctcctagtgtgtgcctagccttatcctagccactctgcataccttccctccagtctcactgcaggtggctttatccccattttaaagagaagtcaaatcactgtccaccatcacttagccatacagcagcagagccgcgattcttcctatggggccgtatgtctttccttgggcaagaaggaattgccacaacagcctcagctagactctgtctttgtccctcccttcttgcctgcacacctcccaggttagggatctgagaagttctgcctgagacagaccactgggaggtccagcctctccctcgggctgtcattgctatctcatgtttcaggagtgccctgtgtgggtggcaggtggctggaacctcacggggactcaggtgacctgtaagggttctctcattccattgagtggccgaggtaattactcaccagcacagagtaattgatatttttcttgcaattaaaccacttaacttattattttaatgattacaaataagatagtcccaaggctttcagagtgctatcttcctttaattatgatctaacaagtttggctatttggtttcctaacagcatttttttaaactttttattttgaaataattagagactcacaagaggttgcaaaaatactaggcactctacattcccccctccaattccaccactgtactgcagggtagctggcattattcccattttaaggagaggtcaaatcactttccaccatcacatcacttccccccaatggtaacatcttatgtaaccgcagtatgttatcaaaaccaggaaattaatattggcacaactcaactaactagaccacagacctgagtaattgatttttattttatggaggtggagagtgctgttaaacaagcatgtcagctggtctttaggaaggaggcagtggtttgataatagtccctgagaaactgtactcccaggcccaacctctcggcattcccatcctcaacaaaaaggcatattccagaaacctgtgcaaattcagctctttggaacaaatcacatgatcttttaggtgtccaaagtattattctattcaaaagaggcatataataaatcctgttgcaaagcaaggaacttttaaaaaaaatattcttttaagtattcttggctgggcacagtggctcatacctgtattcccagcaactcagtaggctgaaacaggaggatcacttgaggataagagtttgagaccagcctgggcaacagagcaagactctatctctaaaacgaacaaacaaaaaacatatttttactccagctctcttttgattaaaaaaaaagtattcatctttccctcgttacatatacatatttattttatatacatatattgtattgtatattttatattttatatacatgtatatattttaaatacatatatatatctttttgagacagggtctcgctctgttgcccaggctggagtacagtagtacagtcacagctcactgcagcctccacttcagaggctcaatctgtcctcctgcctcagcctcccaagtagctgagactacagttgcgtgccaccatgcctggctaatttttgtatttttttgtagagatggggttttatcatgttgcttaggctggtctcaaactcctggactcaagtgatccacctgccttggcttcccaaagtgttgggattacaggtgtgagccactgcacctgacctggtttacatatatttttatactttgggacttctcctgttcctccaagttccgtaggtgtgacaagacgggctcagatgaatgcctgcatatgcagtgagttactttataggaggggagcctgcatctttttataatggatggtaagcaaacctgcccttttgctcccaagatggacactatccttagtccaagactatatgcaaacctgccgtatgccccagagcaaggcactacctctgtcttctaaggctgtttgctatgcaagcacctttgaaaagatcatccaaaacaaaaagcagttagtgccttgtttacaagacatgtacaacagcaggaggcccagggagaattggctcagaagtgtgccttagcgctttctgaggtctcttgctttttggaggggtgggcagaaatcaaattccttaggacattgggccaagcgtggcggggtcaccagcctctcagggcagcctactgtttacttggaattttctgccttgttttagaagatgactgtggaaaatccatctcctgttgcccatcctgggattggagtagatttcctgtgtatcccgagtttgctggcctgaggagactccctgagaggaaatggtcattacgacatgaagtagagtgtgtagctgctgatgtaaaaagcaaacaactgtggccagggattgagggacttcagaagccaggcagtggagcaaaaagagctgcactccctctgcaaaggctgtgcgaggtcccctcccactagcaagccatctgtgtctctgtactggctggcactgggcctctgggcttccagaaagcccttcatcctaatagctgagttagtcccatgcatcgctatccatatccccaggttgatgagtcctggagaagtgagattgcttagggagaaaagtgaatctataaccataatcaaggtaggcgttgccagcctgcagacagccttgtgaccttatgagcttagaggtatatttttagtcagcaggcatgcttgcttcttttgtactgactcgccagtttacgtaacggccctgtaatgaagaggcagtttggagccacagtgcagagggtgctgggtgaattgcaagcatgttctccggggccttcctctcccagcccccagagccctgtgcagaagatccggtatttgttccagcatagaaggaagcagggggaagggatgtctttaactagagctggtccgtggcccgctccctgggctataggtgtctgtgtgtgtctccaccaggcaccagctgagaaagcccttcctgaagggccctggatgctatgagggaggttgtggctcagagatttcaccagactgcaacccccaaggaagagaggttgagaagtttctgggtcccacaggtgacctgggatgtcaggaaaagccaaactatgtgatggagaaggaaaaatagggtctgttggtaattctggggtttaaaaaggtcaacaagattataggcctgagaggcaccgtgtgccatcttaaacacagctttcctccaacctccactggaggtattttgtcttctcttgatgtaattactgcttcccatccccaaaaatcagtctcctactctgtaatctggacgggcagttttcagggcctgctgtcagcagctgactctgaacacagcgtggaatagctacattcattcctttctatcacagatatttattgaacacatactgtgtgccagctgtggtcactggtgatatgactgagaacaaagtaggcctggttgtggttctcaggaagtttaccttccagtgtgggagtcagaagacaaatagatgagcaatttccaagagtgatgagtgccagaaggaaaaataaccaggtcatgtggcaggtgctacagctcaaggcatctgaaattagatggtcacaaagggcttctttgcagaggtgacatctccactgagtaggtttggatcatcagggcccaggggtgccaggcttggggggacagcaagaacagtaaccttagtcggaccaccggtatatgtttgaagaacagtaagaagtgtgtggaacagtgaggagtgctgagtcacccagagacagctgggcagacaggacttgtggagccaagacactccagagcggctccacctgtgtgtttgtgagctgtgccatctggcccagtcacacggactccaggctctgtagcatcatctgtcaaatgggttgatcatggtttggtgacatcgcaagcagttaatgcatggaaagcgctgtgtggcgtgcaacgggagaggactggtgccgcaagcctgtctgtgctcgtggtggctttgccgcaggacacagatgtgggatttcctttgccctccccactctgtgctgagtcagctcttcccactgcagcccaggccgcagcccaggcacagcctcacttcctgcagttctttcccggcctgtggtaacttgcaaagcagcaaggagcttgtttctaaagagcagatgacccagatggctgatctgggatgaaaggtggggatccggcctctgatcacatggcagtgtcactgtcactaccttccagactccgagctgcagaccctccaggtcttgcagggagtaacaagctttgcaggggtcagccacgcaaggggcttttttacttttgaaatgtagatcagtctcccaagcccttcccccgcgacatccccacattccaagaccaggaaaagagccaggccaccttgttacaacttggtatgtgccttcccaatcattctagaagggaatcagctcctgaacacctacccccaaccctccgtcctggatggattgtatcctaggtatcttccccaggaactttctgatctgggccgaaaagcctgtctcttctcatggtctcagtcagtctgtgtcatctaagacgcagaaaatgcacccgggcctgggtctccagagtcctggattctagtgcaccccatgctaatcaccatggcacaaaattgaagaagttaagtttgagcaatcagggatcaccttgcttgttggcaaagtcaccagaaagtgacaggcatgatttcagggctcggtgacactcctgtcctttaccctccactccctccccctggaaatacatcctttccttacctgatgcctaaatgtccttttacaaggttggatcctttccctccatgctgagagagtacagttataccctggtgtccccagggttggtgcttccagccaactcatactccagcgtagatggcagactggatggttactgagaccagggttgatagaggtgagagggcaagtgggcagctgaggctagagacagaagaaggtgctaggcctcaaaggcctgtgtggagtctggagaaggggctggcgggagcttgcacggagcagaggagaccagctggggtcctggagaggcaggtgagagggcaaaggtgacttggcctaggctgggccctgggtggagggaagtagactgaggtctgtcttagaaggacagccaagaggccatgctgatggattggaggtggtggggtggggtcgaggatgactgcccatagctctgtctgggcagccctggccaagatggcagaaggagtgtttcacctcaccaccactccccactcctgcctgtgggctgcatccgtgggggtgaagggaaaggacttcctccctcctccctgaggtggccgaagcctttggagcatatgaaaggtgctttgtggtgggcagcctccctccccaggagcctctgggcactgggcactctggtttctgggtccaggtttcactgagggctcgggagtggcagcagcgggtgatggtggtggaggggaacactgaggcgcattgagaaggagctccggcccccaacaacttcttaggaggtgaggggcactggaagagataaactcccacagtgtccctggcctaatcccgcacactgccctcctgggtcactccaactggacccaggcccaaggacaaagccccaagccagagctcttctctggcagggactgagctggctctaggcatcacctgtgtgaactgatgtatcattcatccagggctgcctggcacccagcagatccatcgttctgggcgctgaaaatacctcctcccccttcacctccacagttcccaggactgatgtccactgaggaggccccaggatgccaggctgcccagcctccagaccacagttggccccaggggactggcatggcctgaagatggagcccgttcatctgaatgtaccttcaaaagggaagggaggaggcaaatgtggagggtgggggttggctggcagcctcgcctttctctacctgtcagggacagggtggcctggcgacacccctgcaggcttcaactgtcaagatcgaagctcgtgtgaaggaaaggggctaggtttatgtttctccccaggcccaaacaggagaagccagatttcgccttagtgaggacacatttgggtggatctcagagagaacttccagggacaggaagaacttctcagcgggtagggggtggttctgagcaatgactttgggctcctgcagatctggttcatacctgggctttctacttagtgctacttgcctgaaccaaaactctgctattttccgtggctgagatgggtagctatcgtacttccacactggaggacttacagccagacaaacctggggttcaaatcccaactcagcaggctcggcatgctgtctcacatctgtagtcccagctactcagggggcagaggcaggaggattgctcaagctcaagagttcgagaccagtctgggcaacatagtgagaccctgtttcaaaaaataaaaattaaaagaaatcccaactcagcctcttcatagttgtgtgactctgggccagttttaatcagtttaattctgaagctccatcataatccccatctctgaaatcccttcagggttattgagagcatcaaatgaaatgtcatctgaaaagcacaaagtaagccctcagcacacgattgtgatttggtaatttttagtatcaggtccctaacaaaattgtgagctgtctctgggatggtttgaatgcagcctcctagaatcccttccaagagtgaggtctcttctcaggagtgcggtcccacagccttgtgtgttttaaggattgctgttcaaaatgtggtcctcagatcagcagtgtggccatcatctgggagcttgttggaaatgcagacacttggcctcccccaagatctgtaagtcaccgtctgcattttaacatgcacaggtgatttgtgtgcaccataaagttggagaagcaatgtttgaaggtccatcagagcccttctacaggaggtctactgtgtctttagggctctcttggtgcttggttacgttcagttcattcacataatacaaacaactgagcctgcaatgaatccatttctgactcaaagtagaggtgcatggggagacaaggatttacaggggtaacttggtgagggctggtttcttggcctcacatccttacatacacctgagctgcctgcctgtttctggtattctgtgggagggagtcgtgagtaacagccctctctccccatcactagcccaaccaggaggatgctcaggtcccaaccacacgccctcatcagatatagatcagaacattctctctcccctcccttccaagatggggtgaagttttgggccaaggagattgctaagatttttattttagaagttccctgattggagatgggcaagactggctcatgaactctctgtggttttgaagatagggtggcatgagaacgtctaaagcctatgtctggagttacgtcgtactgttaggatggaaaacaggctcttgtaagatgtctctggaaaaagttaagtcaacaaaataaagtgaagccaagcatggtggcacactcctgtaccagctactcgggaggctgaggtgtgaggatcacttgagcccaggagtttggggttacagcgagctatgatcatgccactgcactccatcctgggtggcagagtgcgaccctgtctctaaacaaaattggttttaatttcaaaaaagaaaaaaaagtgaaatttgaaaggagcatattttgctcttctatataaaataaccattgcagacctaagcttcaaagtaaaggagccagggaggagagttgagatgagtgagtgactggtaatttggtggccaggtaattcttctctgattggcacagtttttactcctggcctcttgtttctgatctgaaagacgaattaaccagtttaatagttggtagttggtgaagatggcttaagtgagacctatgtggtcttgttaccagaaaaacttgctggtgaaagacagagggtggagcagctgttcacgatgtgagcccagtggtccagagataacaattcgttgaattggctgtagggaaaaagttgcaaacagctttctaaggaactttgtgtgaggcctggaatttcaacaaattaaactattataaatgagagagaatgtctgcttaaggattatagctactacttattaagcatatacttctgccagatactgtgcaaaggattcatgtgcttatgttgtctcatttaatgacaagtctacttgacacatgaagactcacaggctagaaggggtgcatgacttacccaaggccactcaactagtaagaggcagagctgggcttcaaacccagttccctccacttccaagcccaagctcttgataactattctttttttttttttttttttttttgagatggggtcttgctctgttgtccaggctggagtgcagtgggacaatctcgactcactgcaacctctgcctcctgggttcaagcaattctcctgcctcagcctcccaagtagctgggattacaggcgcccaccactatgcccggctaatttttttttttttttttttttttttttttggtagaggcagggtttcaccatgttggccaggctggtctcaaactcttgacctcaagtgatctgcccaccttggcctcccagaatgctgggattacaggcgtgagtcactgcacccagcctttgaccactattctttatgtccttgccacaaagtgggattgaccaaagatgtactgtctggagattaacagttaagatttggtataaaatggcaggtatgttgcctgcaccagggtgtttgcattatctttaaaccttgtttcaagtattatctcatttaaatatatatatatacatattagaggttgatcaatgttgtccttttaataaagtatcacattcttatggtaaaagttttagctagattacattattttctcagtcacctttcacttaatctatcaactgctaccagccacctagtggcagatgctggaattgcaggcatagtgtccagaaggaaataattgaattctggaaagctggctttggaaacccaaacctatgaagtaactctgtaatgataatcatcacagatattatttcctaaaccacgattcaacagagtactgaaaacaaggaagaaagatgtcccactttactgttatgtttctatgtgacacgaaaactgagaagttttcctttgaggcaccaaatagaaccttaggaaaagtcgcagggttttacttattcattcctaaaacttggtgagggaggaactctgggcctggggtctgctttgctgtccggtttcttttgctgtgcatgacagcagtttctccaacattagggtggtgttcttctgtgcattgtaatagatttgtatttattagttcagaatcccccataaggataagtcacagcccttctctgagcctgagttccctcgtctgtgaaatacaagtattggacttgatgctgtctaggttttctcatagtcccagcatttagtgatctaatagctattaagaccaaaggaataaatgcctaataatggaatatcatgcaaaggggaaaacattttaggagaacaggagtcctctaggcctgcctcaaatcccactgtactggcagaacgtggctgcctctgtataaggcaagccttgtgcccttcccactcccctgttccactcctccatttcctttggaaggcagagaaagcccccttgtcctgaatgtttccctgcaaagggctcctgctgaaagactgcatacacagccaagactttgaccttcacctttgcccctcactgacttggtgaaaaagagttcttatcctcccctctctaggtttgggaggcggggaatcagctagggttagtaggaattcaatgaaaatataaatagaaacatgatctataaataacagtgccccaaaatatcaggaggcatgaataccggctgggcagcagacagtcacagatcacgagggcctggacagggagtgcgggttattcggttgctttggtgtctcttgggatgcttccaacttgccagtgggcttggagaaaccctctctctttctggactctagaaacgccctctttgttgcctctcttgcacccatctctagctaaaccttccttaacactgcctggaattagatctggtgtttaatcccagcagtgtgtgacttggggaaattcagaagatatctctgagctttagttttttcatctgtgcccatgaggatttttaaagctggagattttgaagagcaagaaccgtatctcattttatcttggttaacagggtggaacctagggccagattgcctggattcagatccccatagtgctccttactagttgtttggccttggaaaagttacttaacctctctgtgctttaatttccttgttaaatgggaagaataatggtatctatattgttgggctgttgtgaagaataagttagttaatatttgtaaaatgcttaaaatagtgtctggcacatagtagacatatataaataattattaagcaaggaaacaaatctatatatcccccgtgcctacagcgttacctggtatgtagtagctgctcaatacatgtgtagcatgaatgactgaatgacctatctatcttgtagtctacaaaagtcattcaataagatcatgcgtgaattctttctaagccacaaagttctatacaaatgaaagtgggaatattaatcttacctactagggtgacagtttgacaagggttaaaggtacactcccttattatcctcattcatcttctctgccttgcatactctgcattctattggtctgggggaaatgcctggagctgagacagctcagtggtagaaaaagtccgtttcccgctgtggtgttctgcggcagtgccagcctctctgcgtggcctagcactgccctgcccttcttagcattaggccctcattgtgggtagtgctgacaaaattgttcacaggcaaagcaaagcaaagcaagctcttaagcagacaaacaattggctgtgtcgcattttgctatatacagattttaaatataaataaaagaaacaaaaaaagcccgtgcccctcaacaaagcaacctgaatggacaaggcagaaagagcattgaccccggagtcaggtgctgggttctaggctcaggcctgcctcagcttgtgtgtaggatggggaccatcccatcagctctctgagcctccccaggtctggaaggtattagattctgtcagtaattctcagcctcagaggtacatgagaatcgctcagggggctcatgaaaaaggcagactctcgccctgtccatccccttccacttcaattcagggtgtctgggcaaattttaggaacttcattcgttaccagtgttccaaatatctctgattcaggtaacacagggaccctgtccttccaaaaggagtgctaggccttgtagtagttacctgggtaacaaatcatcccccaaaattagcagcttaaaacgacaataaaaggccaggcacggtggctcatacctgtaatcccagcacttttgtaggccagggtggcaggatcacttgagcctgggagttcgagaccagcctgggcaacatagagacccccatctctacaagaaattttttaaaattagctgggcatggcatcatgcacctgtggtcccagctacttgggaggctgaggtgggaggatcacttaggctcggaggtcgaggctacagtgagccaaaattgtgctactgcactccagcctgggcgacatagcaagactctgtctccaaacaacaacaataaaaatgtattatctcagcatagtctctgtgggccaggaattcagaactgcttaactggatggttctgagtcagaatctctcatgaggttatagtcgagattcagctgaaggcttgactgcagttagaggacccacctgcaagacggcttgctcatctcgctggcagactggcgctggctgctggcagaggcctcagctccttgccacatggatctccacagtgctgcttcagcatccttacaacatggaagctggcttccctcagcatgagtatctgggaaagagatgaggaaggcagttacaatgtttttataatctagccttgtaagtcatacgattattcccacaatatccaattgcttccacaggtcagccctggttagtatgggaggggaccacgaggcaagagtcactggggccatcttggaggctgacttccacagcctcctttgagtcctcagttctatgaaacactgttagtggatggcagctcttgttgttgggttaggatttgtagaaattggaggcaggaaagacagctgagttggagaccctagcagatgtagcctggaagcacagaagcacagaagcttataggctacgtttgctaggctgtctgtaagccagaaccaggctgccaggtcgggtgccctttgagttcagcctggtcactgagttgctaagagaaggtgggcaaagcgtgaccctctcagagcttagctttgacttcagaaggtgaggaggctggacaagatggcctctggggtcacctggtcttcacccctgtgttccacatgggctgtggtgtgagtttacgttgtatgtgcccagccagtgaccaggcccaggctgctccccgagctcctgagatgtgaggaaggctgggtgcagtggctcccacctttgggaggccaaggcgggtggatcacctgaggtcaggagttcgaaaccagccaggctaacatagtgaaaccccatctctactaaaaatacaaaaattagccaggtgtggtggcacatgcctgttatatcagctacttgggaggtaacagagcgagactctgtctcaaaaaaaaaaaagaaagaagaaagaaagaaagacttcaggaagaagggcttcgggcagggtctgaaggttctggtgtcttctcaccgtgaacattatggtccttggccttggaggtccaggaactcaggcatttctgaatatgcaactgtagtggcttcagtgtgctctgtgtggccattcagtctctttggcacctttcataaccccaccccagggacctcccagcatgcgtcctgatgcacgtacccactggactcccttcagcttctcagatgtgcctgtctcttcagtctctgggcctctgctcagactctccctctacctggaacactcttcccgcttccctttgcctgtctcactctctccacttcctcagccctgtctccctcctgcgtgtgcctatgacagccaacacatcacagcgcagtgcccatacacagtatcctttgcgagggcagggaccgtcaccatcacagcccagcccccagcacagtgccagcatttgggagggagtgaatgggtgttgcgtgttgccccttctttcagggatggggtagggttgagatgtaccccgtcaggaaagctggccacaggttgcacagcccggggctcagggaaaggaaggaagatagcagaatcattaggagcctaggcatgttcagtctgcccaaagaaagagactgtggcacacccaatcccagctccaccacttcctcgctttgcaaccctgggcggggcactcaacttttcttaccttcagtttactcatctgtaaagtgagaataacaacagcacccagtatgtagctcagaggttgttatgaggatcaactgtcataataaatataaagtacacggcacagggcttagcacataccaagtgctcaatgaatgttacgtcctcttaatgttactgtcaccatccttgcaggagatgggtggaaccacagaaaatgctggtgggaggttgatgaagagagttgactgtctgggctcagttttgccaacagaaccaaagctcaaggaaagcaggctttgggacaggcgcggtggttcaaacctgtaatctcagcactttgggaggctgaagtgggtggattgcttgagcccaggagttcaagaccaacctaggcaacacagtgagacctcatctctacaaaaataataaataaataaataaataaaatgaaagcaggctttggtggacagtgtccatcccaagagagccaggcaaactcccctgtggctggcctggccaggcctgtggttttgggccctttaccgacaggcctctgcttcctgcggcttttcctctgtctcagagcctcagaagtgagtgggtgtctttcagcatcatcactgcgacccaggacttccatctgcctgccccacagcctcctcatctggctgggccattctgcagtgtttctctgagctccagaggcctcgtgcccctcgccaagccccccacactgtggaccatgccacagggagaggctgccaggaagctctgcccagcgtcccaccgtctttcctgagggcagcctcccctggagggaggagccgaggctgcacaggctgaatggggccctttattcccggctcccacagggagggtacagagccactgcccaccacgcccaccacacccacgcccacatggagggggtacagcttggccctgatgccggcctctgagctaaccacactctggccccactgtgtctgcgtcctggagggtgaatccacccctctccccagctctggctgaagctgccgtccctaatgtgtggggtgagctgtatttgctagtctgccaggggtctgggggtgtgtaaatgagagacagcctagagcaagccagtgtgaacacacactcacactcactcacctttcagcaagtcgcggtcggggtccctgtgtgcccgtccttgtgctgggccctgaggatacgttcgtgggcttcactggctgcaagaagcttgcattctgtccttagggaacgctgtaaagaggcaggttcagaagatcattatcaatggtggcagattctgggagggaaacaacggaggccggagagagagggcacatggccaccaaaggcctcccaatgagggatgcaaggcaatggctgggcaaagggcagcaggaacagtgctccaggaacaggaacagggacagcgaacacacaggcctgaggtggggaagagcaggatgtgtctgtggcgtgggcagagtgacaggagatgggcgggcggagagagaggcaggagctgaatcctgcccggccacagaagggagtttggattttatcctcagtgccctgggcagtcactgaaagggttaagcaagggttatggtttgagaatattattctgaggccaggcgcagtggctcacgtctgtaatcccagtactctgggaggatcgcttgagcccaggagtttaaaaccagcctgggctacatggtgaaacccagtttctacaaaaaaatacaaaaaattagcctggtgtggtggcgcatgcctgtaatcccagctactccggaggctgaagtgggagaatcacttgaacccgggaggcagagattgcagtgagccgagatcactcccctgcactccaggctgggcaacagagcaagaccctgtctcaataaataaataaataaaaataaaaaagaaagaaatggttctggtcccactgctctagaatgctgctcaaaaagacttccattccatttggttcagcaaagatgtattagtccctccatgggcctgggactaggtgctttatcactagcagacacccataaaatcccagttgacccacctggggtgagggagagaaagatactgttcccttcagcctggctctgcttactgggtatgggaacctccgaaccagaatttgggagatcgttcttccctccaaggtgcgctgatgctttctgcaagcaagccgtggctgcaggagggtgaaggcttcactctgtcgtgaaccccagtgggcttttgcaagtgtgtttccctgggcgtgtgggagagggagtggggagtgctggagcgggcagacacacctgtgtgagtcaccctagaatgcccctagggggcgggtggaatgaacaattggcctccttgccattgtgtcacgtcctctgccctctgagttgggcctccgagaaacggaagccgtgtgggagacacagatgtgtttatgggttgggtgaatcaggaagggcagccgcaggctgaggggagctcgtgtttggccttggtgggaagccaggtggatggactgggtgcctgggaaatgcttctggtacttggattccacgtggccagcaaggagacaggcagggcccaccccaccccatcccacctccttgacctggaagtgtcaactcataagagatcccatttgttcaccatttgccatgggctgggctccatgctaaatgcttttacagactcattcactggctcctcgtaatagtcctttgcattagacattactgcctcccattttgtagtctgaggaaactagcattcgaataggttatgactcatcccctgtcacataacagtaactggcagagccagatgtaccagtcaggactctcctggtgacaagaaatagacccatctcaatctggcttaagaaaaaaggggaaacttattggttcacataactgaaaaccaagagtaatggtttcaggcatagctggatctaggggaccaaatctgtgtctcttaagccctcagctttgctgtcttttctgttgacttaattctctgataggcttcccccaggtggtaacagagatacataaagatgcttcctagcagcttggggcttggcatttatgagttagcagctgtagagagagaacacatctcttcctggtagttccagcagtagtcccaggctgattcccactggaccaatgtgggttgcatgcccatggctggactgtacttaatgatcagccccagagtttgggatgggatcaaccccactgaaatcccatggactgagaatgaaggagggattgtttcccaaaagaaaatcgggcactgtaataattaaaagctggcagacaaaacctaccaatgtctaccatgctagacttcaagccagaggcagcatcttggctctaaagagagattcatgggagccagaactcagggcatggtgtcagtatgcctcaggctgctgaccttcgctatggggattgtgtctttccggaacctgcatgtgcccactgcttccagcctcagcatctaggcctcactcctgccttcccccagcccaagtaaatggcaacaaagccagatgttgcaagtgaagaaggaaggattgggtgtcagggtgtgatctgagccaggtacaaggctgtagactctggggatgtcatctcagctgcaccagaagctggaggcagcccagcaggggaagaggtgacctgcagtccccaggctgcagagggtcagaggtgacatgtgagtttcaggggcagcacttaaaaagacaagcaggggccaggtgcggtggctcatgcctgtaatcccagcactttgggaggctgaggcgggcggatcacctgaggtcgggagttcgagaccagcctgaccaacatggagaaaccccatctctactaaaaatacaaaattagccaggtgtggtggcacatacctgtaatcccagctactagggaggctgaggcaggagaatcgcttgaacccgggaggtggaggttgcggtgagccgagatcatgccattgcactccagcctgggcaacaagagcgaaactctgtcgcaaaaaaaaaaaaaaaagacaagcaggggcctgccattcagccactcccaccctagcctaggcagggctaacccaggtgaaagctgggtggccccatggtcaggaaacagctgaacatcaagagcagggccagctttcaggaagacaggggagccagtagaggctgttccgccgttcttctcccctgcccattacatccagttccatcaaggcctctctgctctatgctctcttccctagcgagaccctgttattgagtgagaagccggtgcctgctcatactcaggtgtgaatggttaataaggctcactgtaccattctccaggaaaaagttgatatatcttgacgaaaatcttaaagaaactaaattctgattctgcaatctcaggcatcaaagaagtagattgtgagtttgtttgtttttagagttgggtattcttagggcccagggcataccctcttggtgtctgcttgctttaaaccatcaaaagtcccagcctgggccaggtgcagtggctcaggcctatactcccagccttttgggaggctgaggcaagaagatcacttaagaccaggagttcgggaccagcctaggcaacataacaagaccccatcactataaaaatgtagtcgggtgttgtgtgcacctgttacttcggaggctgaggtgggaggatcacttaagcccaggagttcaaggctgaagtgagccatgatagagtcactgcactccagcctgggtggcagatgagatcctctctcaaaaacaaacaaaaaaagagtcccagtctgcttctccttggaccagcttggatcaccgagcctcagtgactcggtgagttgggggttggtaacagcctctctgaaatcaaacagacttagaatgaaagaggggtcgtttgtgttttgtttttaatggtgaagaaagccccattagtggaatcatggttatattctctctgccctcccctgcccagggcccttcatttaagagcttctgtcttcatcaatctgtcagcaaacaacacggatggaggcgcctggtgagggcagctggacatgggatccttggctggtccagcccactttgcacagggacctggtcaggtctcaggaccacagagagctgtgggagtaggaaacttaacttctcctccttcctcccacatgcattgcctgtgtcttatcaccccacgagcatgcgtgtcacccttgagggggggagggaggttccctctaggaatcctcacatcttctttcctccagttcatctgggaaatctgttcgtctcttctctcctgggtgtcacatcagccctcagagccagagaaggacccgcccccccattctctcggcttcaggtccccacagcttgcctgtctcctctcaggctgagactccggagctgctctgttcagacactcccctgtcccccacgagggcttcaggctgcactcatatccatttcacccagcgccatgccagacatttccagggattcagggagtatagaaaccacccctgtccttggggccactgaaatccgcttagggatatagggccctgtcaggtgactggtatgccctgtgactctcccataactaccctgcggtaggttgaataatggctcccaaaaagatatatccaagtcctaacccttgaaacctgtgaatctggccttatttggagaaagggtctttgcagatgtaatcaaagatcttaaaattagatcatcctggatatagggtgggcactaaactcagtgacaggtgttcttataagagaaaggcagaaggagatgtgggacacaggcatggggcgggaaggccatgtaaagactgagacagagatcggagtgatgctgccacgagccaagagatgcctggagccctcagaagctagaagaggtgcagaagaactctccctgatgccgccagagggagcgtgaccctgctggcaccttgatttcagacttctgacctccagaactggcagagaatacattcctgggttgttgtttgatttgagacagtctcactatgtcacccaggctggagtacagtggcacgatcatgactcagtgcagcctcaaccccccaggctcaagcgatccccctacctcagcctcctgagtagctgggatcacaggcgtgcgccaccatgcccggctgattttttttatagcattttgtagagacagggtctcactatgttgcctagtctggtcttgaactcctgagttcaagcgatcctccagcctcggcctcccaaacagctgggattacaggcatgagccaccatggtctgccaaattcctgttattttaagccactgggtttgtggtaatttgtgccagcagccttaggtgacaactgcctcccaccttcctttctgttctcagacccagttagaagggcaggagggctgtccttggagcacgaggcctttgcaccgtgcagtctgtgggctccaggcccacctgtgctctcccttgtttcttaggcaagtctccctcgacagcctgggctctctgggctgcattgaggggaggggtttgtgagcatctgtatccctggaggccagggtggctgggaggagctggccctccttgagcccaaggggctgctgaccctgttgctataaatcagggatccccttgagaagatgagagggggtcctgaggagggtggcttcctgacaaattctctaggacagcaggggagagagggccagagtggggtgactgccagagggccctagtggttggcaaggaagggcgagacaagcattcaaggaaggcttcatgggggaggcagcatggaactgtgccttaaagacagaatgagtgttaagtaggcaggcccaagggcacttagaataaaaccaaactcttttctgtggctgcaggctcctctcttttctgtcttccatcatgtccagttccttctgccccagggccttggctgttgtagtttcctctggccaagcccgcttgttccagagctttgcacagctgctttttctccttgaaggctccactgaagcccagagaagcttccttgaccattctctaaattcttctctaggcacccctcttcacattaccctgtgttattatctttgtagagatgggggaagacctggaagtataaccaaattactcaataggtatgaaaatgtgtactgccttcttcccgtgcccactcccttcccaattggaaggtaaactcctgagagcaaggccctcatctgtctggttcactgctgtgctcccagcgcctggaacagagcccagcacagcaggcctccatcaagacagtgctgggtggatcaagggaaggaaggaagggtggaaggaaggaaagaaggaaaggcagggggaagtcttccaagaatgaatggcgttccaagtggcagaaagacagggaaaaaggagttgtacatgcatgcatagacactgtgagtgtgaagaggagaggctgccaggaatagatcagcctgctcagaccagaagaggtcccgaggccagccctctcttacggctcctataatcagtgccctcttattacctctacaaatgggtcctagttcatggaggtagctaccaaactcttcatggctggtgtggggaccctggccagtggtactgtgtctggtgattctacttgaggccccaggccctggctctcatgggagtccatcccataggtaccgctttcccaagaagagccctggaggctgtggttggtttgggggtttaactgttctcatctcccttcacatgcagaataaaatccaaagtcctcacggtggctctcaaggcttgacatgatccaagtgcaaagatcatggctcccccacactctctaagctttaaaaccccaggttgaaatcccagctcagccactagatagctgtgtgactttggacaggtccttcaacctttctgagctgccatctcctctaggacaaaatgggcctggttaaagtacttgcttcaaggttgttgcgaggatgaagggagggaattcagtgaaaagctcttagtgtgcaccaggtgtgtgctgagcgcttagctaccattaaccctttcctccttcctcctctgcccactaacgtccccactgtcaatcaatcttagggcttccagaggtagcagccatagagcccaggcctccgatgagcacacagcagtcccagtggagaagggacctgtttcagggtcacacagccagcctgtggcccaggtaggacttgaaccccagactcccaccggaggcccccactccttcgctggtctcaccccagcccagcccagagtggcaggaagaaggacctccagttactgcttagacgtcgcagctgcacagcttcttctccgctttcaggactgagttaatcctgatgagttaggtctgtctcatgccccgtgcaatcttccttgcgatgctcatcagattcctagggcggcatctggatggctttgaagactctggcagaagctgagccctgccgtcaacgggctgcactatatttacaagaggcctttaatgccctgtggtcccggcttccttcatggggattttcctccccctcctttttctctccccctttttatacggtcaccggtttggctttcagagtgtggtttggattcctaacagagaagtcaagaccggagaatcccttccaggccctccctctctccctccctctctcccccactggccaattgtgccaaagccctgggaaaagaaaacgttgctcctgtcaggatttcagcgggaaagggggaagccccattgggcttccaaaaactcagctgggaattggcttgtgcagaaattctcctctgaccttgcaagtgagcagcagatccaggagcctggtggggaggactgggcagccccaggcacagtggcccggtggcctcactcagagtgcagactggagggcagggcggggtcctgtgcttggggccagcatggggaggagtcaggagcaccctctcatctacctccccaccccaacctatccctcccttctctggatctcctacacctgtggaggcctcagtgctccttaactagtttttaaaatgagttcttcccagcactttgggaggccaaggtgggcggatcatctgaggtcaggagttcgtgaccagcctgaccaacatggagaaaccccactctactaaaaatgcaaaatcagccgggtgtggtggcacatgcctgtaatcccagctactcgggaggctgaagtaggagaattgcttgaacccgggaggcagaggctgcagtgagctgagatcatgccattgcactccagcctggacaacaaaagtgaaactccgtctcgggaaaaaaaaaaaaagagagttctgtctgcaactaggacaggaatgatctaagcctcagccagagctttggctaaccttgagattgggggctgggagagggaccccatttatcttcccatctccctgctttcttttttgtcccccaacaggatgagaaagggcgggagtgcatttttggaggctgaggccctgctccatgcaggtttgtgggccctcccccaccctcctgtggtccccctgggtttcctctgtatctcagacagtccttcagggtcctgctcatacggctggaccgctggtgtcactgggtctgggcatccctcagcttctgacaaacaactgccttcattagaaaggcccagaattccagccccagggccacccatcttcttggcagtcctgagctcaggtcacctcatgtttttatttttacacagcctccccctggcctcacacatgtagcctgtggcatgtgagcaatcaagcgacaggcaaccaaaaaagggtaggaggcaaagaggcaaggaataccgaatctgtgacatcttcccccaaggaacagcggcgtcgccagtgtctggataaatcacgttttatctcctttcgagagggacgcagggcagagccgcttcatcttggtgatgtcgtctgtctgcacagtgttgtccatctgacagggagatggcccggccctctggcttcagagaaaagatgatgaaggagagcttgagcaagagtccaggagaggaacaagaatgacccagcaagcactcattgagcatctgctgaatgcaaagcctagtgctccatgtagtgtgggggcagacaggaggggtgagctgcagagccatcatggagagatgagagatatccacgggaagcaggtcacatgcaataggatgcagttacacgttccactgtctgacttcagcagggctggcgaccaatgcttgtggtggcagggaagtcaggggtggctgcagctggggttttcatggcccctgggtcccctgtctgttcacttctgcctaccaaaggctgctcactggagccactagggccttctacctcagggctttgtctagccatgggcacacactcagccagatgtgctggagttaacgccctcagaggcagtcctcagtgacaaacagggagttggtgggtagatccccagcctccacatgtcaggtacattctctgtcatctcctggagccccccagcagaattgagctctagttgcccaccatgattaactggcctgataacacttccttcccctccctgcccttactgtcccactcccctaatgatatttcttgggatcgcctccaaaacaagtcaaatccttgtttctggggctgtgtctgggggaataatctaaatcaaggcaatggcttttctgagtacttcactcggaccttgacagaagcagctggtgtggattcatatgcagtctacctgtctgctcacatgcaatggaaatgatctaaattgggtgtcctttaattcaagttatgaaaacccatcttcaactcatttaaatgaaaaagaaaatggtattgttttatgcaactgaaaagtaccaggtggaccctggtttaggaacagctaccgacatccagctgctgaaatgatgtcaaagggctctgtctctccctctctccacttggcttttcaatcactcaagaagcttttaccaagcacctgtcttgtgctagccacccttcctttctctcattccgtttgcttcccaggccactagaggtgccaggctttcatcctgccagcttagcaaccgtgggaaaaagcagtctcagggctgactctcattggcccagattgggtccctccccaccactgagccaatcactgtgactctggctgactaggctgcatcctgtggctacctttgttgctagggggtgtggctagactgactgacaccacaaggactgggagtggaagatgccttctccagggggaaattaggtagactgaggcaacagatgcccgttacagctacaggtgagcacttcatcatgtgccaagctcatgggccccaaaatgggtcacaagtgctataactcacagcagaatgtggcagatagcctaggaatggacaacgagttgtggatgttctggaaagagggacattactcccagctcagccaatcaaggaaggccttctgaaaagggggctttggccctagacattgacagccgcctagcacagaagtcagttgtgtaagaccttgaacatcaaaccaaggagttcagattctaaatttctcagactagaaaaggacttatgtcttgatgcatttgttatgattgaatgtggccagcttgggagagtcagctgggaaggtctgaggggctggcatttcctgtaagccttgcccatacctgtagaggggtgtcccagcccagctggcagcagcccgtatggctggaggctgtgtgtgcagcgaggccagggaagagtcaggctgggacagccatgcttcccttggtattgccttgtgcccgccctggaaggagccacccacctaaactaagaataggaattcctgcccagctggcaggaacgaatgccgatttctcaaggagggatgggcctgaaaacaaagcgtagcatgtgggctgggctctactttgtgttgatttgcaaggtcacttgagagccgcacccactccgggcattcattgatcctgccattagatccaggcaaggtggcctggccaagtcactcattgaatcccaagatggcagcctccagggctcctcacccaccagagaggtcctgggctctcagcctagggcgcctcctgccctccaggaaaggtgactgtttctctcttgtttccttgaccgtggacggggtggtggcaggtagtgctggactaagatgctgagaagccaagggagaggggaatgagaaggtctctgtagcagttttagccagaatcccccactcatgagcatctctcttccaggcaagatcctcttccgcagaagccacatccgggacgtagctgtgaagagactgaagcccatcgatgaatactgccgggtgagagtgtatctggggctgggggaggggctcggggagggcttcagggaggagaggggcccatttgcctgagtgtccatctgtgaggaaaggttgctgtacagaaccgtcctgaggcctggtgtttcctggccagaggggtgggtatgggatcaccccgtagctgggccaccctctgggacccaaggacctcgggttcacagctaagcttctgtgcctgtcaggacatatccatgtttacaaaacacagttttaagtcacttcctctgggaagtgaactgagctcaggagctaagtcaaagagcctccttctgaagggctgcttgcttctctatgtgagattttgctggacatagaagaactatttctttgaattcctgttgggatgttgttgggatcagttcactagcatcagcagtacacatttgtttattcacctaaatcttggtaactacaaatgttcatgtacacatctttacagatgcaggtgttcacacaaacacatgcacattaacacagccagtgccaaagagcaggcaggagaaggacagcagtgtcatgagccagagcccacctgtctgtctttgattagagcccagcgctgctgcagagagcatgagtggctaccagaggatgagcggccctcagtttccttggcacatggcctctggagggccagtcttcctgggttggaagccctgtctaatttcatgaacttgggcaagttactgaacttccctgagcctctatttccacatccgtccaatagggaggagaacacacagggtgcctccacacggtggtcatgaggatggaatgagctggcacattgtaaggcaacagcacagcgtctggctcagaagaagcattcagcagatgcttttgttattatttttacaaagggcaaacaatttgtattaaataaacaagcaaatgaaaaagctttattttttaaaaatttttatttatttatttattttgatgagacaagatctttctctgcagcccaggctggagtgcagtggcaccatcttggctcactgtaacctccacctcctgagttcaagcaattctcatgcctcagccttccgagtaactgggattataggagtgcgccaccatgcctggctaatttttgtatttttagtagagacgtggttttgccatgttggccaggctggtctcaaactcctggcctcaagtgatctgcctgccttggcgtcccaaagtgctgggattacaggcgtgagccaccgcacccagccatatttttaacatgtttttgagacagggtctcgttctgttgcccagactggtgaaaaggctttattaaaagcaaataaaaaaaaaaaacaagcaaataaagcaaacacaaaataatttaatgtttctactgggcaccattggctttaatagagctagaatttcgtagttaaatgaaacccactgtggttcctgactcaaaaatcttgagaagatgtggtataatgtgttataatgtggcaaataaggtataaaatttcacaagtgctggtattagagtatcagaaggagaagagctggagtcgaatcccggtgcccacttactagctacgtgaccttgggcaagctgctttgcctctttgagccctagtttcctcatctgtaaaatgaatataaaaacactacctcacatgggagctgagtagggagaatgtatatcacagtgtcctcatacagagctgttgcaggaggagcacttgaggccaggagtttgagaccagcctgggtagcataacgagacctcatctctccaaaaaaaaaagtttaaaattagccaggcgtggtagcacacacctgtagttgaggtgagaggactgcttgagtcaggaggtcaaggctacagtgagctatgatcacgccacagcactctagcctgggtaacagggaacgatcctgtccctaaaaaaataaaataaaataaaataaataaaaaatgtttaagaaccaacttgctaaatttattaactggcattcccaagcctataggaagaaaagacaatgtagtcttcattaaactgaagtttgaatttcgtgactgtgaacattatacttgggtcacatgttctgccttattttaaaaggatgccccagtgctggattcccttaagctagaaacttctcttcttcagaccaatattcatttttctctttaacaggcattcactgtttctggttaaattgatggctgtagcctgagcttttatttctcttttttcctttctcaagaagttaaataaatgggcaaagctaatggaggagggggcatagggcgggaggaaggcttttccagctgggatttatagctcagattagccagcccaaggcatctgcagttgggctccaaggaaatgctgtctgctgggtcatccggaggaggaagtgatagcatcttatctcctgggatcaggctttgaacaggactcctgattcagaggggctctggagctccagtgtaccacgcgtagctgggggagccattgaagtggggtctgcaagaggagggacctcctaacctgattagcacagatggaaactgcccagagccagacaaggaatggggccatgggctcaccaagcagacagccatctatctcacaggcggtgatttactctgagaatggcgggggtggggcagtacagagtgacctttaattctgctgaactaagaagctgggatctgtggtctgattgtctgagaaacccactgaccttggaatggtttttagggacaagtccatggccactgccacctagctatgcatttcacagctggcctccagacagaccactcagcatcaccggccgaccccagccagcacagtgccgtgtgcagtccgctccacggccagaccttcccctgtctctacctgcctttgtctacgtactgcctagagcctctggagtctctacttacagtgccctgcatagcccacctgcttggctggtcatcttccttcgacctgctagacaatgtgggctcagagtctggggtttgatgggaattcaaatgcacccaaaattgtgcagctggctctgcacacagagcagccggctccctgcaaggactcagacatggaaagtctgaccgtgcagtggacctccccagactttgggctccctgcccttgctggccagccagtcccaccacctaatggcggtttcacagcccaatatcagtgttaatttttaacatataagcagcagattggatgggaatcacggaaaatttaccacatgccgactgagtgatcattttatgtggcacttgagggtcaggtgtctatgaagaggggttccaaaggcatttctttaactttataaattaatttaaacggaaacgtggtaatgcagttaatatttaatggtctgagacctcaacaagtcgaagactttcatcagactaacaagagtaagctataccatagaggcttggactcacaattttttaagtgactctatttaccccgttcctaggggtgaaatacatgtttgcagtgtttgtccaagggataaaatgaatattctagggaggggttcagagaggagtgtgagagagtgtttgagaatgagcaactcaccctttgacatgttaatgacatttatccaagtcaccacttcctggttggtacgactagaatttttttgctgcccaaatagctgagcatgtttctattattcgtctatctatgacacatttgatttcagggatcaatggctttctttgtaggagggaagagggattgggtgcagtcagacttaagggcaggaagtctgagcccaacaagaggtcagcactgaagggtaaggatcccctgaccctccccctctgcacttcccagactcattcatttttattcccacttcccagacttgaaaactgaggctattgcatggcagtggttcctagtcccaggtattctcccttccactgtgggattttccaccacagccaatcattggctctccccttgaggagagtaatgttgttcttgtggtccttgttctaaaagcagacctggcccaggagaggccttgccaatggggagtcttaggcagagcccaaggctgatccattcatgaggtgcctcctgagtggcctggttctctgggggaacccagatagtagaacctcaccatctccctcaacccagatagtagacccaggagaaggagtttctaggctgagataaagcagatcatgtcccttttctccttaaagaccttcagaggcccgggcacagtggctcatgtctgtaatcccagcactttgggaggccaaggtgggcatattgcttgagcccaggggtttgagaccagcctgggcaacatggtgaaaccctgtctctacaaaaaatacaaaaagtagctgggcgtggtagtgcatgccggcagtcccatctattggtgaggctgaggtgggagggtcacttgagcctgggaggcagaggctgcagtgagccatggttgcaccactgcactccagcctgggcaacacagtgagaccctgtttcaaaaaaaaaaaaacaaaaacgggactccttcagaggagtcctgctgcccccgagaagaatatctgagcacctcagctgggccctgtgtgggctggttccaagtgctgctggggcctcagctcctgcctctgtcttccatatcctgcagtccagtccggcagacacaaggccatccccagctagccaggcctccgcccctgagcctgtgctggtcccctgcctgggtgcacattcagtctccgcagtgggcccttccataagcctcatgactccccaggaaaagctgatcactcctgccattctgcccccagaggactgcgcccaccccgactctgtgcatttctcctctgcaggagggtaacttctgtgtgtctgtcttctcccagactatgagctccttgagggccacatttgtcgtctctgtgtcttcactaataaacaggaagcccagccctaagggattgtccagccaatgcctgatgacaagatggaaagatcacaagtagacaaaacttcctcagagagtgacatatcccccaggccctgatgtactaagatcccttgtgaaatggcttaaactgctaccaagaattagacatcatttacatttcaaggggagtcgctgctcagatccttcaaaaagaaaacccatgtgttttgaatactctgaactcagaagttcagtgagaccccagctttctagatggtgacctagaaagaacagtccaagcaggttagaggcagccccagaggtggggctggaaggacacaggtgggaggccagaggggcaggatgccagcccccttgtgccacacctccaactccacccagcgcggccgggcttttacccacaagatttccagggattagaaactgatgctttaaaaaaattaaaaaacaaaaaaaatcagtgtgcaggaaggagcaaaaaaaaaaaaaaaaaaagaaacgagaaaagaaactgatgctgctgaaaagagagaagcaattgatcctgtgtaaagagtgggcacctgtagtgttttgccaaatgcacagctttgctctttgtcctgacgcaggcattacccagagtggtgggctctgtggaggatgaccgtttcgaggcagaaggcctgagcacagtctgccggggccccctcctgtgccacttgcatgtgcaaagaccacacttgtgctcaccatagctgagtggaggtcttagagacacacaatgcagccaccctctcccttgtttacacctgcatcattggccatgatgacactcagtgctaagtggtggctcatgtcatggcccccatgaaatggtcttgaggggcaggagctggagactgcaggacagtttaggactggaaatggggaaactggcagggctagctgatggcaaaacctgaatggctcttcagcacctcattaccagtccccgcgacccagttacccactaccccagccccttcctgcatgccatttctgcagatctgctctcagccagctcactgacccctggtttacagaatggcagggttggagggggactgaggccagctcagctgacattctccagggacctgcatagttccagcagccccgcagggcaatgcttcctcccacttgccccagaacctgagggctagaaagtcgtactcatttcagcccttctccaacctgaggccttcggaaccctctgagctcacctgagctctattagaaagtctcaatcagattgattgatagatcagacaaatgaattcactggtgatggtgctgtttagttagagctattaacagttagagctggaagaaacttcagaatgtcttgaacctggatttgcctcagctgtgttccacagggcgtcactaggagttgtctggaaaatcagcaccgcagtcaaatacctgtgggtaaagctagaggcaggagggagtggatcagggcataggctctggactcagcctgattcaaaattttgctacttacagccggacgccatggctcatgcctgtaatcccagcactttgggaggccgaggcaggtggatcacttacttgaggtcaggagttcgagatcagcctggccaacttggtgaaaccccgtctctactaaaaatacaaaaaattagcctgctgtggtggcacgtgcctgtaaatcccacctactcaggaggctgagacaggagaatcgcttgaacccggcgagggggaggctgcagtgagctcagatcgggccattgcactctagcctgggtgacagagtgagactttgtctcaaaaaaaaaaaaacaaacaaacaaacaaaaaaaacaactctttgctacttactagctgtgaggcctcagggaattatgtaaactctctgtgctttagtttcttcttctgtaaaactgaaatcatagtcatactgtcctcttagagttgatgtgctgattaaatgacacagtcctacaggatattgttagtagtagtaaatgctggcttgtacaaagctctacaggtttctttcctgcaggatttctcagaggctttgtgatggtaacaaacatggtgatccccaaggccaagatggggggaccctcaaggcagatttcacatgtgctcacagagctcatttcacctcatcagggagttcttccatgagacatacttcgggattccattttatcttggaagaaatgacaaccagagaggtgaagtgagctgcctaaggtcacacagcaagtatataactgcagaactggaactagaattgactcctgtctcccattccagtgctctttcaagtgttcatcactgctttctcctaaagaatgacaatggcagcgatgacactaatgttatcacggctcacatttactgagtgtactcttcaccagccactgtgctcggcttctcatattcatctcgcttaacttcctaacagctaggtaggtgccacgtcacatcccagagctcagagggcaggtaatgcatccagcctcacacagcccataaatggcagagccaggacccaaacctgcatctgcctgcagccctgaggtcctgaggctctgaggccctgaggctctgaggccctgactttaccaccacgtggcatacatcatgaatgtctcatggcagaattttagacctaagctggggttgctaaccctgatatgcccattatctggccccctactctgctcttctcacaacggctgggcttgggggtgccctggccctggccatcatcaccagcccaggctgcggggactcactgctcagcatcactctctcctgccaaatgattttggccagagctgagctttggcagcagctctgatggaagctgctctgggctgagagcctcttgtcagcctgaaatcaggacgagccctccacgcggctcccctcagggctccccgttaaataaagatgctgcggttgttccaccaaaaggcctctttgtctgaggccctcgtggcccacgcgtcctctgcctccggaatgtgggtctctgtcggcatgaagagcccctctgttccctgccagggctgggtgagccatggctggccagggtctgtgcttagggtgagtggcagcacactgagcggggagggcactagtgctgtgggccgctgaaacccgccctctcctgccctgcgtccctccttctccctttcagggtggtcacccggcaatgactttgcacagagccgggatccctggtaatggtttcctcctgccttctgcccatcccgaccccattggcactctctcctggggccccctgtcctccctgactttctctccctccctcttgctccctgtctgtctctctctttcctcagtttttcatttccttttccttctacccttcccaaggagaacacagcatggacagtgtgcgttaaatgagaacttgaatattctggaggcatgctccacccatctgaccttcacagcttggggctggattctgcccctttcctcacttatggcttcacccccagcagcctcagtgtccccatcgtatgtggaggcaatgatgtctacctccaggacaaaatggggtgacatgtcattagatttgctctctctcatccctgtaaaaccaggcacagccccatatgcagcacacactgcaaagccctcactgtttggtggatgactggaggagtcaaggggccaaggatagggcctgacacatagctgctcatttaatgttaattttccttttctgttttttgcctgttgatggagatgtgttatttcagagacccttggagagccatgacccctgaaaggaatgactgagggttacatcatgctctcttatctgccatggtctggtcttacctcatcttgcctgggtgtgggtttggcatcgagaagggcccatcttgataggatgcctggtgctagatggcacacttcaattgttatctaactagctcagagaataactaaaccattactttcctcttcctcaatattataattctatagatgcaacctaagattatatgtgggttttttgccccactatcatgtcccatagctactggatattgggcttatagacatggaaaccttcactaccttatccatttttcattcatttctttaaacaaatataaatcaagtgcctgctctgtcaggtactctactaggatctggggacacagaaatcaaccaaacagactaaaatcgcgcctgcatggagcttaccttccagtgagtctttcccaccctccgtgggtgcctgtgggcaggccacatgtctccctgcacctctgtctcctcacccgtagtatggggatgggaattgtgccctcatgaggacgaccctcatgagaatttcctggaacgacactcacagacttactgtacttggcccaggagccactggatctaggccttgcatctgaagctggtcgtggtgtgtgaggtttcaggaggcaggggtatgggacagggtcctgtcttatagaccaggtctcatcaggagtttctcacaaaccctgtgtttgttgactcctccagtcctgggttttcctgtcttctcctggctctagccctcggctccctgtccccgtccctcagctctgctttggtagtgttctctcctgtctgtttggaccaggggatccttccttgccccagtatttctccccatactaaattgaggggcccagaaaacggggctacacccggcctcaccctacacccccaacccctccatgtcggactgggccaggtcagggtcctgcgtgctggtgtgcagcatgaactctgactgccttctttttattttattttgttttattttattttatttatttttatttttattttatttatttatatttttttgagacagagtcttgctctgttgcccaggctggggtgcagtggcacgatcttggctcactgcagcctctgcctcctgggttcaagcgattctcctcctgcatcagcctcccgagtagctggcattacaggcgccctccaccacactggctaatttttgtatttttcgtagagacggggtttctccatgttggccaggctggtctccaactcctgacctcaagtgatctgcccacctcggcctcccaaagtgctgggattaccggcatgagccaccacgcctggcctaactctgactacctcctgacctagtgcctcactttccagctgcagactctccccatgcctggatgacaggctcacagctggcccacgcacttgccatgactactgtttcccatagaatgcccactcctcctctctgcttgtccaaaccctgcaaactccacaagccgtgctcctgcccactcttctaagaaacctttccacactcttcagtttacattgtttctccaggcatcctcagcttggcctaaaacaaggccctgctagtcatgcccctgcccacctcctatggcccctctcccttgctctgggtcctcaggccgcactggccttcattcatctcctgaaaccaacatgcttgatcgctccacctccaccttgaccagttaattgttatccatccttcagaacttagctttaaagagtccttcctgaaacactggctccccatcttccacatcttcttgggttctatcaaactccatcatagtgctttgttgtccttggcagcaattatcaacttgtcatgaaataattaattttgtggtcagtgtttagggagtgtgaatgcctggtgcagctggagcgtggctagtggaagacaaggctgggaggacgtgaccttggactgttaggttatggatcttggacttattctgtgtgcagaagggaattccctcagggttcctgcagaatgattagctcctgaggaccctaagacccagggttccagggttcagtggtctttttttttttgtttaagtcagttgtttagttggttgactggctggttggatggttggttggttggttggttggttgactggatggttgatgggtaggttgattggataactggttaggggttttcttgttgttgtcttgttggtttgttgattaattggctggttggttagttggtcagttagttggctggctagttagttgagagaaatggatagaaagagggagggaaggaaggaaggttggttgtttgattcgttatttgattggttgatttgttgattagttttctgggtggacaggtgggtggctggttgaccatgtcttccatggctcagttcttgagcctctctgtcactgttggtgtaaggtgacactgtcttggttttcctgttcccaagttcatcacacctaatgccctttcttcctgtctctccacaggcacttgtccggctgcccccccacatctcacagtgtgacgaagtcttccggttcttcgaggctcgacccgaggatgtcaaccctccaaaagagtaagtaatagctcaggcctctcctgtgtgctggggaggcgtgggctaaagcaatggccagcctggggaggctgaggctgtgggaacacaagcagaaggtgagctagcagggccagccgggctaaagaacagtggtccaaaggaatgggggacattattccccaggctcctagtgccagagcccactcttcattttcctttaccccagggctgcagggaagagtgtctctgcatttgtggagcagattttcctacaaactctttctggctcacagggttgttacaaggagcagatgagataacagaaaatataatggtcatgccatcgagaccactcagggctagcacagtccttgctcttcgctgttatggctgcagaggtcccagtgtgcactgcccaggatgaaaactcacctgccaaataacagcagtcctgggctgctacaacagattttataatcatcataaaaaatcataatgaatttacccagtatcttttatgtatagcattttatgataggcattaccatattcaatagtcctatttacagaggaggaaaccatggctcggtgaggtcaggtgcttttcccccagagtcatgcagatggtttgataggagacaggacaaaacctgaacctaagtctgtggttcctagtggcccagtgctggctaatgtttccatgtttggagagaaacagggaaccatgcaggtcttttttctctctgaaattgggatgctgtgggtggtggtaaagatggcccactcagccatgctggtttctcacacccaggacccgactccatccagatggccatgctctcttgctcagagcattctgctcacctgcagtccccagcataggttctcattggagagaaaaattcagctcccacccaggagctggtgggcagaaggcagggaggggtgttgggtaagagagagggttggggagaggacttaaggggatgctgatgaatcagctcactccatagctatcccctggaagcttaaagtaccggatgggtgagagagaggcagatggggtggctactacagagggaaaggagagagtaggacacaggaaccctctgggccaggtggggagaggcagggggaacctggtgatggggaggagaaagcctgaagatgagggtgagcattgcgtggctctggaggtgccattcacactgcactttctgtgaatgtgcccatgaggttgtagaatatgtggcctgcacacccatacatggcagtcctgcctaaagggacccttctgtcttcacgcatgctaaaagactaatagcctgaaatagcctgggcatttcgagggaggaaaaagcagctccgaggcccacctggcctagcaaagaccatcttcactgatggctgcctcaggcaagaaacaagcactgtgaaccatcaggagcttatcagtagcttggttcacagcgtgaagcagtggaaagccacagggtataggatgcaaagtattgagttcacgtcccagttctgctgctactagctgtgtaatgtccaggcagatccctcgtaacttccccaagccttcctgtggtccctagtggctcagtgctggccgaagtttctacatttagagagaaacagggatgaatcttaaattcagctgattgaaaaaaaaaaaaaaaaagctaggcatattggctcacacctgtaatcccagcactttgagaagccaaggcaggtggatctcttgagcccaagagttcaagaccagtcctggcaacacagtgagaccttgtctctacaaaaaattaaaatttaaaatgtaaaatttcagaagaaagaatagcgagaaatagggaaccatctgtaaaaagggaatagtgattaagccctgtttttgctacctccaagggttatccatgaaactcagatgatgagaggtttgcaccagggcttgtatattctttttttttttttttttgagacagagtctcgctctgtcacccaggctggagtgcagtggagcaatctcggttcactgcaacttttggctcccaggttcaagcaattcccttacctcagcctccctggtagctgggattacaggcacatgctaccatacctggctaatttttgtatttttagtagagacggggtttcaccatgttggcgaggttggtctcgaactcctgagttcaagtggatccacccgcctcagcctcctaaagtgctgggattataggcataagcaactgcgcccggccagggcttgtatattcttatccccacattacagattacaaaacaggagctcacagctagagcgggaatttgaacccagaacttccaggttgcaagcagaagcccacattcatctgtttctcccacctgcttcactggtttggggactgtggtcctgaagctcctcaggatctcctttctgtccccacctgtctgcgctcctgccccttccttcttcatccttgccttgcctcagggcaagggaaggctctgagcctggcagcagtatccctgggtcctcacctgacccgcccttgcccagctgtgatgttctctccaagcctctcattttctgtccttgcatggggagagaggagatgctcctccctacgtgggtggctgttgggatcccccgtgatcgtgtgcctggccacgggggaaaaggatcaggatcgttgatggtggaggcagcaggtgtatcgccacaaaagcagctgacccagcctgtgatccatgcctccaaacctgctctttgccagtcagctgaatccgtcggcctcacttcattcatggcattaagttagccttttgcccacctctaggaggcccttgaggaacagtggaaaccaggctcagcaagacacttggctgttggggaggcagcaggccatggctttgtggggccaggctctggggccaggccctgccacttaaggctcagtgatctttggccatttgctcaatgtctctgcatttctgttcccctaaaatgagataatgcagaactcacgagctggtcaagagggtttactcaaataacccggccaggtgctactggtgcacaggaagtgctccacacctgtgttcatggaaggctggggaacagaatggaatgtgtgcacgttccgtccctacctgacttttgcagggaggggctgtgaagcatttggccgctccatcaccaggccagcaggggttatctgcctctttcttgaggtggtattggccacgtgggccagttcaccactggtctggcaagttatgggcctgggaataggaatgcctccagccccaagacaggtctgaggctcaggaagtgagctcagctgtggccaggcagttctgaggggctccccctccccgggcccggccctgtctctgctccgcctccaggacccaccaagagagacctgtgttcccctgcagagtgtgcctgccacaaaagagccagagcttgtccatgaccctcggctgacaggctgccgacgtgtcagcctagtgcctgcacctcctccctctccggctgtttggacctttccaggcgactgtgcacctcccttccctccagcctagaacataaacacgggatcgagtaacagcatattttgactctggggcgactgtggagtggcttatcaaattatcaaagcctgtggatttaattggaattttgtagataacccctggcttctttcaagtgtgctgctgcagggtccattgagaattcatgggggctggggtgggggaccgtcttccctttccatcttccagagaagacaaggtctgtcacagcccagactcagtgggggaggtgggcagcaggcctgagcgcctcggctttgatcccaggccactcgctggcttctgcaggcggagagccagacccatctccggtcagttagtggttgctcttccagaccactggccctgcacagaaaggatgttcttcatggacacctttgatgagcctggcacagagcagccatggtggttttgcctcctcacacggaaggataatgggatttgcgcccttatgaaagaggctccagcaaggcccttgccccttccatcatgtgaggacacagcatttgccccttctgccatggcaggacacagctagagtgcgccatctgtggggaaccagccttcaccagacaccaaatctgctgacaccttgatcttggactttacagcctccagaactgtgagcaataaatttctgtttttaagaaattacctagtgtggccgggcacggtggctcacgcctgtaatcccagcactttgggagcccaaggcgggtggatcacctgaggtcaggactttgaaatcagcctggccaacatggcaaaaccccatttctgctaaaaatacaaaaattagccaggcgtggtggcacgtgcctgtaatcccagctacttgggaggctgagacaggagaattgcttgaacccagaaggtggaggttgcagtgagccgagatcgcaccactgcactccagctgggtgacagagcaagactccatctcaaaaaaaaaaaaaaaaagaaagaaaaaaaaaaagaaaaagaaattacctagtgtaagaaggtactctgttataacagcctgaacagactaagacgcttgctgtgtttattgttggcccctcccactagaacacaggctccaggagagtatgaacttgtctttgttctgttcacagctgtatccccagcacccagaacagtgcatgtcccagagcagggtctcagagggtctctgttggatgaatgattgttgtcattcagccctcactatggtcttacatggtaagtacgactgtgacatgattttaccaaggagctgaaggctcagggacatgaagccactcacctgaagtcacccaactggcaggtgcagggccaagatccaagccaggctggctggccccagacctacggttctaaccacagccctgacccaacccatcactcagctcacacccactacgccttcccaacctcgtcagcacccgctccccacctccaccccagccagagtaggtgggtaccggcctcagcccctttgatgttttcctttgaggatggtgtgtgtcagtctgttcaggctgctggaacagagtaccatagcctgggtggcttataaacaacagaaataaaattctcacagttcttatgaaagaggctgggaagtcctaaaccaaggcaccagcagattcagtgtctggtgagggcctgcttcttggttcatagtcatctttaccctggtggacagggaaacaagctctctgggttctcttttataaggcactgatctcattcatgaggctaatgaccatagcctaatcagctcctactatatcaccttgggcgttaggatttaacatatgaatttaggtgggacacaaacatttggtccctagcagtgtgttcttggaaagtcagcagttgaataggggtgtatgtgcgtgtgtgtgtgtgtgtgtgtgtgtgtgtgtgtgtgtgtcctgattggggggagggaggggagcagaaagggaaaggaagagtgtttgccttattgtattggtcacctcctctgtagtctacatcatgcttatttaaatattcatttaaatattaggccacccacgaaggtgatgttattatccccatttagcagatggggaagcgaagttgctagcagttacctgacttccccaggccatgcagccaagtggggaggcaggccttggagcctgggtgcagttctgttaggcccctccagccccccagcccccagccctttgccctgcagtcataaggggtcaatgggcaggggtgggcaagagaagcttgatgtagtttcttggtctctcctgtgtgaattgctggggagccatgtgacagcttgggatgaggagacccttggtcaccaaatcccaaagaaggcagataaagacatgcccttggccccgtgcggtggcttatgcctgtaatcccagcacttcaggaggtcaaggcgggaggattgcttgagcccaggagtttgagaccagcctgagcaacatagtgagacccccatctctacaaaaaaaagaaaaaagaaaaaaaatgagccaggcatggtggcacacgcctgtggtccccgctactcaggaggctgaggcaggaggattgcttaagcccagagtttgaggttacagtgaactatgattgcaccactgcactccagcctgggcaacagagacagaccctgtatcttaaaaaaaaaaaaaagacacatggaagccacaccaagagacaccctctgtagcagctgagatgaccccactgtgagcatgacctgcctcctggcacagtgtcctgaggccactttactgactcagctcccccttgctttgctctgcctgatctcctgagaatcccttgcttccacaggcaaggcccctcacccccagatgcagtcctcccatatggtgtcaacaagggcaaacaggagctaaaggcaggcccaaactggcccggcaggactcaccacgtggtcaactgcgtgacccagaaatgcctctttgtgttccattttaaattctcatccagtggaaataaggaatctaaaagtctttgaaacgaacgctaggaactctgtctgtagattcccaggaggatgcagttctggtgggagaaagatctggccgtagggccccaggatccacctttgcatctctgcagcctcctggcccagtggccacgccctcattcttttcttagcttgtcgccagcctccatgctctgccccatggttccctccaccaggagcaccctcctctcctccccactcgctctggaactgcatcctactctgtctccagactcagcttgggcccctcctccagaaagccctccctagagctggcaacctggcagccttgggatctgtttatggatctctccccaccaaggaacccacatctctggacccccaggacctggcacctagtaagtgttgggtgattgcccaactgtgccaaaataaagccaggctatttaatagagttatacattgaactgcccacctcggggagcagagccaggaggattctcaacctctccggagtcagggggccaggggtcagagaccagctctgccacttgcctcaggcaagttgcaaggcccttgtgtgcctcagtttcctttatctgtagagtgggaatcgttgctgcctccaaaggcagttgcgaggatgatgctttagcacacataaagtgccaaacaaacctggcacggtgtcagcactgccaaggccagtgtttgctgtccccatcatggtgggatggggacatcccgggtggaagcgcacagcagcagcaggcccacatcacttccctccacatacatacacacgttctccacttctggagatgcaaggctgcctttgcagcctcagggctgaggttgcagccttcttgaccactgctggcagtccaagcctgtgggcagggtgggcacacatgcctttggtgcacccatatcacagaggggaaaactgaggccagggctgagctgatctgccctgctcttgtcactcacttagtatctttcttcttgggcctcttaccagcccactggccttaccagcccacctcttacccacgatgggacacatagtgggcccacacagtgggtagacagtcacctcccacttcctgctctcaccctgggcttatcccttcggcttgtttcttcctgctgaagccagccatgatcctggttaaattcttgacattgcatgggaggagcagatagccctgctaaactggtttctgttcttcagcccagggccacagagccaccctctgttgtacagtagaacaatgccccaatgttccgagggacctggggtgagaggaggatggactgaggccaggccagaaccatccctgcctcagcctgcccatcaggggcccccaacactccccatggggcagagtccacccccagtgtccctgcctcctgcggggaaccccagggcaggccaaaaggggaggccatcctgcgggaggcctgccccagccagagcacaggtttgggaactgggccgggctggttaaggtggtgcaggggctggcttaggacactgagggaggctgccagggaaggagggccagggcagaggcagatgctgcttggggcctggggtgggaggaggtcagactcaagaaaacactctcctctgcatgactttctcatcctcccctcccatttatattttggggatggttgtttcatcttggactgcatggtaaaattgtggggagtccagtgagggggacagaggttgttgctgccatttgcctgggagaagcagagcccaggaggacagatgaactctgccagccctgcttcagggttcccgtaggaagacgaggggcaaggtggtgtgtgtggcagtgcagctggaatagcactgagaatgtggggtgtctcctccaggagccccacatccccaatcccagtcgaatgccaggtctggcctgttcgggaaggcagggcgactgctcggcttatgtctggctgccagcctcttgagttagagtccaggcttccctgctcaccagcagcattgctgtgggttgactgcgtggccttccattctctgtaagtcacccggagtcactgctccggcactggggagaatgaattgggatgatgcgtgtggatcacaaactgggcactgagtcatacaccctcctactcccttccttttcctaggaggcaaatggaaggttgtggacagagccctggaacctctccacagcagcctcccttcactctgcaggtagttactgagtgccagctgtatgccagggaccgcgtaggctaatcacctcaagggtcaaagctgaaattgtgaattgagttaaattaactgcagtggcaactgtggggacacccagctctgcctgtgagcttgaatggctcacttctcctcttccagtctgtttccccatctgtgcaaggcccccgtggtacatgtggcaaaatgattgtgaggttcaagggagcaaatgcgtagaaaatgcccctatgtacttaacccatcacaaaagctcaggaaatgggattttctgtttttcttctcctttcctccattagcccaggcctgggtacagagcagccaccccaaaaaggctgggggaatggaattgggttggccgagctgaaggtgagagctgggagaggagcatctcaccgcatccctctctgctctgggagtcctggccagggctggtgctgcctgtggagcgaggctgcccctaccaccctgcaggctgttggaaactccagggcatcccaagtccctgtctctcctgggggattggggtagaaagtccacccacacatgcctggctgcattctggtcagacacctatcatcaagatggctctgtgtgctctgtaaagccctgccaccacccatctggccagggacgtgggccacactgtccttgcagccccctgccactggctgctgcacaaatagcctctttatgttgatgggcaggagggccagctggaccttggagctgtgggaggctgagggagggaacagaacgttagataaataaaccttgtccatcccctgccatgcccccttcaacctgggtgggcaggtggcaggaaaatgcccacaggaagctgtgtccaacccacttgaaaggggcattggccgtggggaacaaggacttctgcaggctcagctgtcatgctgggtcggcgagctggagggaagcagattcaaacacccccagtccagcccagctcatagcgcacacgcctgggaggcccatgtccagggagagaagatgactctgttttcaggcctggcacaggattttcttcagggtggggaggaaggtggcagggaagggtatcctggtgcaggagtgtgtgggggtagactgggtcccccattaatttcttgggcttgtgcattctatgttctctgaaacctcaagacccccatgtgcccactctcttacccccaaggaaggcctacagagccctttggagcctctggcggaaggggtaagccctggaagagcgctgaggcctgctttgctgttatgttgtgttcaaggtgggtcttggttcccctgtggttatcactaccctccatgttcctagtccctgggtagttacccctccatggggagtttaaggcagaactgaacctagaacctgggtcttcggccactgggaccagccttcctctgttgcattcttgtgggaggcgtgtgttcatgcaagtgtttctagatcatctctatgtgaggcccgggacttcagaagtagctcagtccccactctcggggccctggtggtctaagggggaggatagcatggcatgggcctggcttgcttccacaggaggcagcagaccattataggctctggcaaaccctggctcctcccccacctgctgtgtggcctgggaattatttaaactcccaaaacctcaatgtccttgcctataaaacagggcttataacagctgctgataatggggaagacagaaaaagaacaactgattgtaataggtgcagggccttgcgcagcaacaaaccagcctgctgaggtggtcaggaaggcctccctgaggaggtggcattcaggctgagactaaagcaagagctcactactcaaggagagtggcagaggagggcatccaggccagagggagtccctgagattgtgtttcaaggattgaaagaaatttcatcttccgtgagagtaagggatttttggctagggctaggccaagaagagataggcctgaggcagtcattaacaatcgctacacttcagcatcaggtaaatgggcagaacctaggggtctctgggctatctcctggctctgacattctgaggtcctagcagaaccagttggctattgcagtggtccaagcatgcaacagtcaggatctagagaggggctggatggctgtgggaatgggagatattcatagacatagtccgagatgaaagggacaagcatccagagaccttgtgactccttccccttcacaggctctgtaagttggatcttgagggtggttggagtttgggcacgtctgtaactttgggtcactttgaagccctcggttcatgagatacatgtgtatctggctccaccccatggccatatcggatattacagctcccagcgtctggctgatgctgtactaaagccgtgctggacccttgagcatggtttatcttgtttgagcatccgtacaatccagggaggcccatgctcctttctgcagatgagggaccttaggctgagactggttgacttacctctcagctaggaagtgtcagaggctggactcatgccattgcccttcagctccaagtccacaccccacacgggggtgagctgaggatgaagtgagaagcacctgacccttggctggggcaactagctccaaatttcaggatgggacccttcatcagacagaagggcagaataactgcatcaggacgccatggttgccatggtcaccacgggggctgaaggtagagttgaaggcatgtgccacatttgggatcttttaaggggaacccaggtttcctgctgggccacatccctgaaaaggtacaaggtttgctgagactgccaagtctggtccaggccccccagggcagcctgttgagacccttcccccagcctcaggagctccaaggaggggcttcctatcccaggagggttcaggcctctgaggaggggtgctgcctggctggtacaggctcctctgatggaacagacacagggaaaccggttctagaagcactcagaaaaccaggtttcccgctcccaaaccacagactgagcccttggcttcccacaccctctctcatgaatggcccatttggtcatgggtccagagggcacgcagatggctacgtgcaaaaccccacccaggacatgtggcccggagcatggctcagtggtcagagccagagggagagtttcccccagacagctttactgaggtataatttacatgctataatatgtacttgttttaagtgtacaattaattcattgattactaatacttttacagttgtgcaaccatcaccacaatccaattttagagcagttccatctcccttaaaagatcccagagggaggttttggggttattttctttcctttttttttttttaattttgagacagggtttctctccattgcccaggctggagctcagtggcacaatcgtggctcactgcagccttgacgtcccaggccacctcagcccccaagtagctgggactgcaggcacacaccaccatggcaggataatttttttatttttattttttgtagagacggggtctggctctgttgcccctgctagtcgcaaattcttggcttcaaacgatcctcccgcctcggcttcccaacgtgccaggattagaggtgtgagctgccatgcctggccaccagagggacattttatattcttccaaactccaggttttggagacctgttggtatcccttccctctgctcctgtgtgaggggaggacatgcctgttcccagggactgagtctctgccccacttgctgctgctgtcatttctgggccctctggtagttccagctgctacgctgcccttgcacagattgctcagtagcccggggacgaggtctgcctggccctcccggtgcagctctgaggtggactaaccactgagttggcgcccagggtgaagggggagggtgttcatctcagtgggcacgttccctgcgtattgattccagtggcccagctgggtgttcactttgaacttcatccccaaccccaggtagttacgtgccccaggtcagtgggaaggccacctcaaatgcaatgcttacttccccccaaacttcttagaaggccagtaggtgcaggcaacaggccaagaggctgcaccacaatgatgcccaactttctacccagggaaattccaggtgttctggcagctcagctgtttagcagaaagtgcatgaggagctgattatcagcttggctttttataatcatttttccctcttgggatgctcctgggaaggaaggtggcagagctgttaagggaggtggccttggactcacaggtgtaacttcagatcctggttcagccccccaccagctatgtgccaggtggggcaaccgttttttattattatttttagagacaaggtctctgtctctctcccagtcctggagtgcagtggcaccatcacagctcactgtagcttcaaactgctgggctcaagcaatcctcctgcctcagcctcccgagtaactaggactactggcacatgccaccgtgccccactattttttaaattttttgtagacattgggtcttgctatgttgttgaggctggtcttgaactcctggactcaagccatcctcctgccttggcctcccaggcaatcttttaaccccacctaaactcaccacttactcaccacacctgggcctgccatccccacctctcaccccaatactgggacgtctcacttgtggcatataccacagaggtaattaaatccttaacatccggcttccctgagaggctgcacacaccctgagggccgggacattactgccaggcatctaccatatccctcgtgctagctgaaggatggacacagtaaatgcaataaatggagaggatgactgtctgtgggccttatgttcccccaggagtaaaatagggaccatagaagtggcagcatagggttactatgaggtctagaaagctaataatagctcaattactgtatctcaccatgtgatgacattcttctaagcgatttacattttttaaattattattattttttgagatggggtctcactctgtcacccaggttggagtgcaatggtgcgatctcgactcactgcaaccttcacctcccaggctcaagcgattctcctgcctcagcctcccaactacaggtgatgcccagctaattttttgtatttttggcaaaggcagggttttgctatgttgcccaggctggtctcaaactcccgagctcaggtgatccacccaccttggcctcccaaagtgctgggattacaggtgtgagctactgtgcccagaggactttttttttttttgagatggagtcttgctctgtcacccaggctggagtgcagtggcatgatctcagctcactgcaacctccgcctcccgggtccaagtgactctcctgcctcagcctcccaagtagctgggattacaggtgtccacccccatgctcatatttttagtagagacaaggttttgccatgttggtcacactggtctcgaactcctgacctcaggtgatccacccaccttggcttcccaaagtgctgggattataggcatgagccaccttgcccggccagcctacatgttttaattctctaatttttgcatccatcctatgaagtgggtatagttgtcatttccccctagtttgcagattaagccactgaagcacagagaggtcatgtgacttgcaacgccaataactggcaaatatgggctagaacctcttacctatcctacccctcaatgaagcttggcaagggcttagcatgctgcccagcatgcagtcttaatgaatggtaccagttgttactattgttgttgccgaaggggctgtgccagaggctggctcattagcgcccacaaaacacgactcatctctcagctacgtgggtttgcagtttctggagtcatcggagcagcctctccttccatccttgctgtgtcccagtgagaggcaaggtgggagggtttgcccctggtcccaggctttggagctcagttccccagacatcatccagcccagcctttgcaggttgtgcagtccagagaagggaaatggttgcctgaggtcagagaaactggattagcaccaggatttttggctccaagtccagtgctctttctggctctcagaactttcccagccgatttcaagagcaaccccaggcttggagcatttggagcatccctggtgcggtgcctgggagggtgcctggaggcctgagttgagcccttgagaagatcccagtaggagcctggctgatggacagggagaagggactggctcctctgaatggctcagaggcaggagcttggctgtggccaggtctgatttaatttggcagaggcaggctgcagcttagaccaggctgtgcctgcaagccagggaattgaaggttaattgccaggggcacctcttcctggcccccaccccaagcaggagagggcacccatgagcctgtcacctggtctgagacccctggagaactgcagtgttgcctcaggagccagtggatgggggacatgcattatccccatgctggccccctcatgtgctgggcacggtgctaggtcctggcagccacgaggatcttaataggcacgagcaggggacactttgtgctgcccaagacaggaaataattcaaggaaattcaggcatcttggtttggaatttcccagaagcagatctgaggctgaggattgcggctcaagcagtttggaggtgacactagaaggcatcagtaaggtgacacagggcagggaagacaaggctgccaagcgcagtgtcaacgagcttcatctcgcagggactggcacctggctgcaggctgttccctgggggcaggggtgctggggcattcatgcaccccttttccctccctccaggccatccccagacatagccggagggagctgtccaaaaagcctgtgtttcctactgtgcttagggtgactgcctggggtttcctggtgcccttctcctggggaggcctgggctccaacctcccactgagggagccactggttggtgctgcaggaaccagaggaaagagcctggcagccgcagggaaggtcaggaagtccccaccaccacccaccccagcttggggacccgagctgaggccctttgtcactagctgagtttctgtaacgagtgtggagacaggactgtgattcactcaaggcctgaggtcggcgccaacaaaggttatcaggaaggcctgcagggaggaggccaggctcatgtgtcccttgttccagaagagccagatcagggtaccagagacagtcattgagcttaaggaggccaggcaggtcccacacaggtgctcaagccaggagcgcaggaggacactggaaagggagagagactgtgggggctgtgggtgtgcagggaaggctgccagggagctgggcctccaagtgaacttgggtgctgagggagggtttggaggcaaaaggagagggagacagcctgggccagggtgaccttgagtgcaggcttggagatttcccagcagaggagggcaggagggtaggaaggtagagagagacacacacaaaagctcacgatggttaggagtcagctggcactggagtcaaatcccagctctgccactgggctagtgacttaactgactatgcctcagcttcctcttctgggacatgggagtaatgatagcatcttcttcttggtgggtggctacaaggattaactgaaataatgtacatgaagtacagtgagcagctgggccgggtggttcacacctgtaattccagcactttgggaggctgaggcaggagaattgcttgaggccaggagttcaagatgagcctaggcaacatagcaagaccctgtctctaaaaaaatgttttttaatttaaaaatattgaaatacagcctggcgcggtggctcacgcctataatcccagcaccttgggaggctgaggcaggcagatcacgaggtcaggagttcgagaccagcctgcccaacacagtgaaacccctatctctactaaaaatacaaaaattagctgggcatggctggcgggcatctgtaatcccaactacttggaggctgaggcaggagaatcacttgaacccggaggcggaggttgcagtgagccaagatcgcacctctgcactccagcttgggcaacagagctagactccatctcaaaaaaaaaaaaaaattgaaatatatagtgccatggctagcacatagtaagcacccagggagtatcacttcctaggtacaagactctgttttcagactttagccctgtcagggagaggggtgaaggaggccatagacactgtagtccaactgccagaggagagagacacacgtgaggcaatagtgcaggacattagcaagagcatccaggctccactgtgatgccagggtggtttccatgacaaccaaggtgatgtcacagaggacggagcacaggaggccgcgggctgctgccattccgtcctcataaataggcaggaaatgtactgtctgcacttgctgacccatctgtgacaatcagggatgacctcctggaggaagtggcacttccactgagctctactcgggggggaaaggaggggagagcagagatgcagggtctgcctatcctgccaggcagggattgagaacaggtggaggatgctcgggatggtgttagcagcgtctgaccagcctcttgagaccatccggcagccctgagcttggttactggttgtcagggaattcgtgcatttattcaggaaacacgattataaccagccctgtgctgggcctggcaagacacacacagttcctgctctcagggagcctactgttgaggggaagaaatagacaacaaacaaggcaatggcaaaaatataaaggcaatggtgacagccacacaggaaaataatccagtgctctgctagaacaaggtttgggggggtgccagaaagtgtattaggctgggagctggggcccaggacagcattggtccggcatcactgcccccagaacttaaaaaacctctgctgagaggaggctgtaaaaccagccctggtgaggccaggccatcctcaggctcctccagtccagccactgacccactgagcagccacaccagcggcagaaccaccaggaggcagcccaggaagcttgacagctgcaggtgctctagaggggatgctccatcaccatcggaaaccacagtgcatctcttgagcatgtggtcatggacgctgtgacactgtgacccactgtgcgggtcaccagccaggtttcttcctgttggacattctcatgccagccctgaagttgtgacctccctaaggaagagtctagaactcagtgatgtcatttgggtatttctttctttctttttttttttttttctttttgagacagagtcttgctctgtcacccaggctggagtgcagtggcacgatcttggctctcactgcaacctccacctcccaggttcaagcgattctcctgcctcagcctcctgagtagctgggattactggtgcacaccaccacacccagctaatttttgtatttttagtagacagggtttcaccatgttggccaggctggtcatttgggtatttctgaccctgagtctttgccttcgttttacctttctcttcaccacctactcctcatttagcttttctgtctggattttatgtgtccttcttagccacaaggtggtaaatgaacagtgtggtggttaggatttgagcactagactgagccaggttggcctccaatcccatctgtatccctcacaagctgtgttactttgggcaagtcacatgctctctctgatcctccatttctcatctgtaaaatggggatagtaagggactctgccacacaggcatgtagtgaggataaaatgagctgatgtgtgtcaagggtttagtttagcacctggcataatgtaaatgcttgacaaatgtagtgctcttgtcaataatagtattaataataataagagcagcactaccactcccacctttgggtaagaagagctcactcacggtggggagaactgctcagtggtgactcccaccaaggcctggcccacgcccgcccttccctccccctgtttgccaccatactttggggttcatgggcacaagcctgctccgggacctcgggggctttaccttggtgtagaagctcaggagaggttgcttggtggaggatggaggtggcggcccacggctggcctgctgggacctgtagtggacaggctggtgagcaggcagggccctcactgtagttgcagctgagctggcccaggagcattcagggttgacaggaaggcagctggagaaggctgggagcatggaggtattacctaggtattacctagggttcctggatggcccccctgctacaagcaggacacaggcttgtcctgtgagcctggagctggaggcctctttgcaaaagcccaatcagggaaactaaggcacagagagggctgccaccacccaggtcatgctgcctgctcagacagccaggcctggaacccatgtctcgggcctcacaggctgggatggccctggtttggcatcttacaggactcctccctagaccccgtcctttacatgtatgctctggcagaccctggggaagcccccaggccgccctgcacccaggctagcccaggagccacccatccctgggcacacaggcccttggccaggagcccgtttgtcctgcgttttgagtgcctgctgtgaggagcatggcagccactgccctctgtggaacaggctcattaagtcagcctcttggtccagcatcgagggggatccagacttggctgtcactcctgtcgcctctggggagacccgtcagcctggcagcagcaagggattctgggggaatgtgaaagtgataacagtcattcagatggacctggaagtccccagctctgccacccccagtgctgccagccaccagccaccagtgtggtctcagcaaagtggctttaccctgcagagcctgggtttcttcatctctgtacagacaccccaagccttgctcccccctccccctgaggccagccaggcccgtgtccctgcttcttcccatgctgctcctcctccagtggccaccgcccccaccttcctggctccttctctcagtgccctcctttggccaagcccattctgtcccaggtggttctgtcatttcccctgcaagtcacagctcttccagagtccctccctctcccctctcgagggtgaaccagtgctggcagcagggccctgtgactggcaggtggagctggagcaggtggaggatctgtgtatgcgctccctgttactgagcctgactgtgcacgggggactttatgtgtattaacttgtttatcccccagcaatccaattaggtggatcatttcagtctctgcactttataaatgaagacagagaccctaaataatctgtctggcagagctgggatttgaacctaggcagctacacacacacagagagacacatacacacacatgcacacacgcaccatgggagccaagcaaaccttctggccataccatgtcagagtctggactgtactgtccaataaagtagccagtagccacggtggctctttaaatctaagtcttaattaaacaaaatgaaaaattcagtgtttgagtcatactggtcacaattcagtgtttgagtgctcagcgccactgtggccagtggtaccatactggacaggacagatagagactatttccattaccccggagaattctactggacagctcctttgagggcaccactgttggggacagaattggaacattcagtgctattgggggtcaaaatcagagtgggctttctggaggaggtgccccttccttaggccttgaaagttgtgaaacactaggcagggcaggagggggcctgtggtggttgcagcacagacaaccgagtctgcagccttgcctcccattgcaagctgtgtgacaccaggcaagtgacttaagctgactgaggtgcatctgtaaaatggggctaacgcagctgcctctgttgggctgggcacatctggctgcttggtgcttgtgggtttgtcacatggtgtctaggaaagtctgggaggttcaggttccttcactgtaagaggcgatcacccgggcctcccagggccatgcaggtgggctaggtgtgtgggaggagtgtggggccctccgagtcctctttcccacagaggccaaggcagaaacaagcacagcctgactttgggtgggctccttggcctccatgggaaatagggagctccttggcccaagctcccagtctcaggtcgaaactaggccagggctggggagttaggggccatcagccaaggatcgacccaagaggtctgtgctctgcagtggggccctggtatctgcccgtgtgtcacacacacccatacacacacgtgacacagagaccaggcacatgtctgcagatggggccagtgtagcttgaggggcaaagcagtcctctggctcccccgacacaagtcctcaccccaccacctgaacaagggaaaccagaaggagctagaaatgtgatcctcaggcacagagctggtgccacagccttcagggagaatctctctttaggaatactgccgctgggttgttctcagcaacttccttctaaaatctgagctgcttcctctggggctcagtccagccccagctgcctgtcctgctcccccaagacatacagccttcttgccctccgcacccagcatgcacacacacacacacacgcacacacacaggcttacatctgttcctgcccctgcaccgttgctcacaccatcccttccaccccaaatctccttcctgcttctgctctttttaaacagtcttcatctttcaagggctagctctagtgccccatcttccacatagccctccctgaccaccccagaccactctgatctccctgtcctggaaatttctatacagtgtttcctttgaccaagctttggggcacctgatcacaagggaacttgtatgttgtcttttcgtgggtgtttgccatctctttccagctagatggacaaaaaaatgaaaaagagggcaggacagtgtgtcttctgccactctcttacttcatacacaagactgggtctacaacagaccttcagtcaagatgtggatggatggtggatgaatgatggatggatggatggtggatggatggtgaatggatgatgggtgaatggtagatgaatgatggatggatgatggatggatggctggatgataggtggatggatgatggatagatggatggatgatggtggatggatagatggatgatggatggtggatggatgatggtggatggatagatggatggatggatggatggtggatggatgttggatggatggtagatagatgatggatggctggatgaaggatggatggatggtggttggatgatagatggctggatggtggatggatggatggatgatagatggatagatggtaaatggatggtggatggatagatggtagatagatgatggacagatggatgactggatgaagatagatggatggatgatggatggtggatggatggctggatggatgatggacggatggatggctggatgaatgatggatggataaatgatggatggatggatggctggatgaatgatggatggatggatgatggatggatggtggatggatggatagatgatggatggatggtggatggatggatgatggatggatgatggatgcatgatggatggatgatggatggatgaatggatagatgatggatgggtagtggatggatggatggtggatggatggatgatggatggatggatgaatggatggatgatggatggatgatggatggatgatggatggatgatggatggatgaatggatagatggtggatggatggtggatggatggatggtggatggatggatgatggatggatgatggatggatgaatggatagatgatgggtggatggtggatggatggatggatgaatggatggatgatggatggatgaatggatggatgatggatggatgaatggatagatgatggatggatggtggatggatgatggatggatgatggatggctggatggtagatggatagatggtaaatggatgatggatggatggatggatggtggatggatggatggatggatggatggatggatagtggatggatgatggatggatgatggatggctggatggtagatggatagatggtaaatggatgatggatggatggatggatgatggatggatggatggatggtggatggatggatggatggatggtggatggatagatggatagatggtaaatggatgatggatggatggatggtggatggatggatggatggatgatggatggacttggagagagtcagggaaggtctttaaatataggatatcctccttgaccttctcctcagggacttcattgttgaaccccatcaccccattttgtcactccccctcccatggttccctaggtctggcatgtagcccctggaagtccagggaacccccatagccaagaacagtctggcatttacacagggagcaggatctcaggtggcctgaggaggagctcctagcactccatggcagtgggctgaactggcaatcccctgccccattttgccctctaagaaatcaactgtgtattcctgccatcctccccacttcccctaaccctgcctcctcccactcccatggactgctgctcagtgtcaccatctaggtgggactccttggaatgcacctgatgggaacccaggcctgtctgtcatcatggtcctgcatcagtgccctgagtgacagagccagggtctcacacaggccacactgagaaggtaggcagtcagcacctcctgcattgcggccaccatccacactcctagtctagccccctgtgaacccaggctattgggctacgggtcctttccatgggccagatgccatttaagagctttgcacattatcccatgtaatccccacgacagctctgtaagatagcaactattttaacccccttttacaaccgaaggtacagagaggtgaagtcacttgtttatatcacaaagcactaggtggctgaaccagggttctaacccacctgcccttttaactccctgctctgaggcctggacatggtaaaacttgtcctgtggctgaagacacacttagggcctttgcccagaatagtggaacaagtcagaggagacagacagacagtgctttgttcttttgctgtggacagggcagcagcagagaccctctgggatgttcaggagacaaaatgcctggggggcggggttctggggtctatgatggccatagcatctggcctctctgggatgcagcctggggagccccaagaccccttctctccgcaggaattcagctttttcacccagggcaggaattccggcccctctggacaagccacatggtcacaatggggtccattctcagaaccctggaaaacacaggccctgcggagaaaggacagattcttgttaaacacaagggccctcagtgccacgatttagatcagggagcaaatgggggcagagaatggcctgcaggcccctctgtctgtcttgcctggaggttgctgcctctggaggccattccgtgcaaaggctctcaaaagccagaacaaaaacccagctaggggctaaggggtggaaaaaaaaccccaactctccagacctcagtgacccaaagccccttcgcccagccctttgctcagaccttcctcacttggtttctggaagaacatgctccatctcactatggaggtttcacagataattcgaattctcacaatagccctgtgaggacactcagagtagcctcctgttaggactggggaatccgagggctcctgccacagtgggaaatatcacactgcagctcgatacgcagacagacatctgatgcaggtgccacaaaacagccttgccaggggtgactcgctgatcatttctagtctgttcttcttaaaatgctcattgggaccattaaattgattctgaaactcactaatgggtcactgcctgtcatttgaaaagcactagtttgaagtggcttgtccagggtcaccagcccctgagggggcagagctgggcccagaacccgggtctgtggacattcagcactggactttgacagcccctctcctgcccccaacccccagctgtcaacctctcctcttaacaaaattttcctccagccaggatctgaccaaatcactccccaattctgcaaacttctggatttcacagccagacatcaaagccctgctcagccttgcctttcctggcccgtccacccactaccctcactgcccagtccacaactgtttggagctgcttgctcctgcttgtagagctttccccctgcatccctctatggatccaaacccccttgtcctttaaggcctcctcctccaggaagctacctgggatgttctgtagcccccaggacctctcttttctctgcactgagtgtaacccctcctgtaattctcagcgtggattgtctgagaatgttggctttctcgttggacttatgtcacatatatctcttctgcctgcctgcacaggccttaatgaggttgcctacagcgagagcttaaaaagtgcttttaggttgataacagcagtcaaaatcattatgtacctcaagagccccacgtcactcccctggccaaggttgcatcttctccagccctcatattctagatagtgcccatgtccccagtgactgctgggctctgaaggtcacccccaagtcagctgtctggcagcccagccggcctcttgagcagttcccagtggctgtaggccccgcagacaggcatcctgggcccagcagccaatgtcagctggcagacagaagggtgagaacatcaggctggaagtttgtgtgtgtgtccttctctgccaaggcacttgccagtgggagggagagtggtgaggggtgtggcgggcagtggagggtacaaccctgcagcattcagcagaactccacctggcaggtactcagcacccttccacagagccggcccagccaggcccagccccctttcctctctctcccgtgcctcagtggctcttcctggcttcacctctcactctgggaactctgaacggcaggatggcaatctccattccccagcgagggcctgctgcccgctgctggtgtgacctctccttgtggccaaatccctagtgggcctcagcgtggcccctttggagcattgtgggtcagggctgtctgtttagcttcaggagcctgggccagccactgaagcctcagacctcaatctcctcatccatgaaatgggtgagcacctgctctgcctacttcagaacaccaaagaataaatcctgggagttttcaaggggaaggcagagtgtggggagccatgtgtcaaaacaggggaacaacacatgtgaattgttcagtgcctttcctgcccccaccagcctctccctgtgcagtctccaacaccagccatttcactagagcatccggggagggagcacagcgtgtctggccaagataaaatgaaaggaaaaaagaaaaaccctttcgggtctacattagcataaaaatgcaagccctttacatctcttggttttggggctctgagagttggccactccttgggaggttaaatgtgtcctaatagaggggtccagaggcgtgcgtccattcctgtgggtcagggatgaacacacttcctggtgctcggcgctagacagagaccagtggttgttctggcatttgcgaaagcccaaaactctgaaagtggggctggaatcacacctgcctggcactgtctgccagcatcgtggtgaggtccttaaggagaagctccttttgtttcaggggctctgtaggacccaggtttaaacaggtctttgccacctgtgtagcaactgaggtgggtcagatgggcccaggtatgaaagaataacaacaaagacaatttatagcagtttctgtgccggccactgtgcgaagccctttctacacactgtacattgcatcttccccaaaccccaggggtttggtgctattattgtcctcgttctacagatagagaagtagaggctcaagaggccaagaaagtagatcaagggcacccccctgcccccactgcaagcagcagggatttgaactggaggcctccgtctccagaacctgctcatccaaacatagcttgcatcatcctatggggaggggccaagagaggaaccgtatcacccggggatggggcggggtgggagtagaggccccaggagtccttgtttagatggggagggatggagtgctggttggaggaactccacccctctttcccagccaggccagacctgtggaccacaggagatcacccatcccagtttgtccagtttgagccctgaaagtcccatgtccctgttttcctgggactgtgggtcactgtacctgtggtttgagtcacccctggaccagctgcagagaatgaatggctgagtggtctgatgggagctgttttaggacacagcttgggaggccttttcaattacattagcctctggcaacgctagagggagatgctagccccgcccttcctcccctcctcttcttcctgtggctccctggccgatatgattcagcagcaagtcggaagcaggctagactgtgacctaccaggagtggagtcaccggcagggtgggggctgtcagcaccagctcagggcaagacttggagcaaggacggagtgtggattggagaaggggactgatgggaagagggggggttcttgagttgttagggaactgagccccagcagagggccctgctgtcctgccagactggaactggttatagggcagtgggaagtggtcatggtgtgaagggggatccctgcctttgcgtcttgccctcgtatgtgagggatgggagagtcccagccactggatacctaaactgcttatcaccctattcagcagctaaaaatatgaaatggctttgctaaaggatgcccaactggaaacttccagaaggtctcctattagggcagcgcctgctcgggcaggccagacaccctgaaggattcaggattcctcttcgttcccaccattcagtcacagcctggtgacccccactgccaggacctcagcctccaccccattaaccccatgtgctgatcaggccctctgggctctgccttctactcctgcatccactactccaggaaggggtggtaagtgggcatttgtcttgagcctcagagcaaggcctgggttttctggtccccagtcctggtctcacccactcactatggccttgaggaagttgtccggcttctctaagctttggtcttctcacctgcaagaggagagcccacaccccctgcagggagggacccggaagtcctcggtggggaggactctgaactctggctgaaggacaggcaggccaagagatattttctagaggctccttcagcactacaagcacgttgttcttactgagcataaatgtttcttaggggtggctggaggcctgatggagattatgcaacactggagcagcctcagaatccccaggggagtttgttggagatgcagaccatgcagtaggttggggtggggccctgcatctgaattttaaccactttctagatgattccattgaatagcaggctgagaatcaccaaccagggcctggcacaaaggaggccctccaagcatgtgagttttgtgtcttccccactcttttttttttttttttctttttgagacagagtctcacttgtcactcaggctggagtgcagtggcaccaccacagcccactgcagtcttgacctcctgggcttcaagcaatcctcccacctcagcctcccttgtggctgggagtacaagtgcttgctaccatgcctagctaatttatttttggtagagatagggggtctcactatgttgcctaggctggtctcaaactccctgtctcataggaacagcctgggtagcctcaacctgctcagagctggagaaggcagccattcctgtgaggcagccacccctgcctgggctactggcagccagggggatggtcagtgggccatcagtcctgggcttctcctgccaggaccagcaggaaaattgtgggacagcagagggtagctcctcagtgccctcactccctgcccttccccagtagccctcagtgaaaaggcctgaaaagctaatttcctccttgggagtggaaagtcttctgggcaggacacagctacgatctaatactctcctcctcctctcaggaattccctgcacagttgagcttttggggggcacagctaggactcagtctctgcccagtcttccttctgcaaggggggcaagcatgcctttgttaaggccttccctggactgactggtgggagccaggggagggggcaaatggaagctctcccacctttctgtagtccctttccaaggcaacggtttcccagattctcctccacaccatccacgctgcagtttttattccttccagtgggcttataaaccacagcccttccccagattgggcaaccttcggcaatggctgaacctctgtttcctaatctataaaatggattaggatgataggaccttcctcttagtgtgggtgagaggattgaaggagacatggaataccaagggggttctcaaacaagatggggaaggaaggggagagagtcagaaatgcagatttcctggaccttgcccccagcattctgattaagtgggttctaagttttgggaaaggtcgatgcctaggagagggggagctccccactcctggctgtgcaggcaaatcaccttggagattaataaacactccaatgttggagggcacccctagacctcctggattggaatcttggggagcctccatgaggatgactctgctcctttccctgggagcctgctgcctcttcctccaagagaacccccttccaccgcatccccccaaacccccaaccccgcctttccagtggcagactagcgggctagtttgcttcgaccaaagatgggcagcaactggcattttctttggcccctggggaaaatggaaggcatttccttcggactccggagagagccccagccagcccctccactgttccctgagcactgaacagaactttcagcctttaggggcatgtgaggctcaggttaagggagccagctcacctttcccagtcccctgaggattggtgaatggaggggggtgggaggagtggggagataaggaaggcaggagcaagggcaggatttgggaaatctgcccatctttgagtctggactctttgctggagggcagggcaggtaaacggaggctgggagggtgcagtgcctaaggtcacagcagttactttctctgacagcatttgaacccacttcctcagaagctccacttccgttcctaccgttcctggcctcccagttaaccttgcagtatcctctgtcccccccactacccgctcctcaccccgactccccagctgtagcctttgagaaggaccttatccatggcctctgccattctcggggcgtgcagtgagaggaagcagccacagtggcccccagcgagtctcgggtctaggacaggggcagactttaatcaaaggatcacacaaatctgtgattacctggcgggtggttttgaggaagacacgttgaggaggtgacatttcagtagtgacttacgggctgagtaggctgggttcacctcccaattctttgcatcgctagggcaagccatgcaaagaattgggaggtgaaccgctccggtggcggggagagcgggctcccagcgctgggtaggggccgggttccggcgagcgccatcccggagcgtcagtttcccagtttgggaagtgaggagaacctgcctcgcccttccccgccaaggcttagggaaggtgagccccagttagcggggcgggctggggcggggcggggcggggcgggcgaatcgcgcctgggggccgggctggcagggggcccgcgggcgggcgggcgggcgggcgcggcgcgcagtgcgtgcggctgcggagcgcgcggctagccggccgtgggcatcacatgagcagcggcaccggggaccgaccgcagccagcccgagggcgcccctgcagctgcagccccgcgctcgcgcccggccctaaccatgtctatctgttgttgcttctttttcagggactatggcagttccaagaggaaatcaggtaagggagcctccgggcgttttcccttcagccttccttcccgcttcgtgcacgcgcccctccgatcctgcagaggacttcttgggggcggggaggggggggttgtccttgcacgccagcctacgggtcctgccgggccaggggtactcgcttcacttgcccctcctcagtccatggcccctgagacccttggtcctagaaccctcgttcgccttccaccgactcgctcgggctcccgctacctcgctgtccctagtgggtgtgggggtgggtgcatggggagtgcgtgggtggctcgtgaaggggctaggcccccgcacggtgagcagccgggtccttcacccccgggctgcggcggccgctgctgcgcagtgctaagacttctccggtccctctcgcggtgcagcggtgatggaagggttaatagagacgcggggctttcctgcgagaaggtgaaattgagaaccgggactgaaaaggggtcatccttgagtgacttgagtttttagcgcctgcaccacagaccttcttccctgccccaactctgagcgtgtccttgctgcggaggtgggggctccgcgttttggcagctgagacgcacttgggagggggccgacccgacccccccaaccccctccccgccccccgcattggcctgacaggtgccagggcccgcccagagtttggaagggggtggaggcagggagagaggcgggccagccctcggagctgtgggctgagggtagagcaggattgtctctggaagtgggaggctgggctccccaaatggcaaacgcctggatgtgggcgggctgtagttaactgggggagagtggtccctaggagttagggctgtgtgtgtgctgaagtgggggcggggacagactgctgcagcgatccgtgctgacacgtggattggccatattgacagggtggctgtaccttggggtacatctggcccttggggatgtaggaggtaacacgtggctcctgtgaatggctcctgtgcccaagtgccttggcctgtggataggttgaggggagtgcccctgtgtggtggatggatgtagagtggggtagatgtaattgtatgatatgtatgtttctgtgtgtacaagtgcttgctcacgtgcctattgggacagggaaagttgtgtcctggtttatgtgttgggggcgtgtgtggctgtggggttctgtgcacatgtgtgagtcatgatagctgtgtgctgtgagggtatgtttacttgtttgggtgcataggctgggggtgtgtgtgtggttgagatatatctggttatgggttggagtctgtgtttgtgtgtatttgtgtaccagtttgggacatgtctagctgtgggatgaggtgtgtgtgcacttgcctatcacctgggtctggggtgtctcaggcaggcacacccactggtgcagaaggccatttcctcctgtgaaccgtggggtgagcctggggaagagcattcctccactgtcactccaggcaggtctcaagtgggagaatggaaggcgcagcaaaatgggggttgtgttctgtcaccgcccacacaggaagcttgccctgggcctcagacgtatagtgtcctggttgaacctgggctcaaattctggctctgtgtgaccttaggcaagtttcataacttctctgtgcctcagtttcctcattttctttaaaacaaaaatgctaatgttatctgcctcacacatagaggattaagtatgttaatgtggaatagtcctggcaccgaataactactgtacaagtatcagttctcagcagcagcagcagtagcactttctgaaggcctgggacctagtcctgcctccattgccacttttctccctatgtgaccttgggcaaattccttctctatgctgggcctcagttacccccataaaggcaagagctggaacaaataacctctcaggtcccccgccacaatctctggggctcagcttctgtgctgcttcctaagcaatgcagggccacacccaggctgcctcccccagggaaagccaacccccagtttctctgtcttccactctcacgccaggaaaaggatggatggagaaatttaatttatattggtgtgcttatgataatggccacttagtgtcatggttgaaaatgccagctctgaagccagacagctggagttgagagtctggcttctctcctctgtgaccttgggtagatttcttagcctctctgtgcccattacttcttctgtacatttgggataatattcatacccattttgtgatggtttattatgtgtcaacttggctgggccacagtgcccagatatttggtcaagcattattctagatgtttctgcaaaggtgttttctaggtgagattcatatttaaataaatcagtggattttgagtaaagcagattactctccataatgcaggctagcctcatccaattggttgaaggcctcttaatggaacaaagactgacacacacacaccctccctcagcaaggaggagttctgccagcagctgcctttggactcagctgcagctcttcccttagtctctgccggcctcccccatcacattttggactctcaaacctccacaatcacataagccagttcctaaaataaatctccctctgtcttcaagctctctatgcacctcccattggttctgtttctctggagaacactgactaatacacacctcatatggttataacgaagattagataaactaatatatgtaagcatgtttagaacactgcctgccacctagaaagctcccctggaagtgctagatgctgttatcgaatgagcatctactatgtgcgaggacattttcacgtttcctcatttgctgatcagagccacagtacatgatgggtggtgggattcccattttgcaaatgagaagctgaggctccgatggggtgactgcccacacacagtccttggcaaactgaggattggagtccatgtttagggctctgttctgctctataatgaacctcacgaagcttcccagggtcactccagccagggacatttgcgcagaggaaatggatgccattctggggttcactgtaaatctcttactgagcatagagcttagacttgaggcaaggcttagggatggtggagtcaacagaagaagaaagttctcaggaactttctggaggaagcaaggctggtgaccttgaaaactgaaggacagtttggcctcaaatttatctgcatctttcttccctctattgaacctgctccttccagcatcttccccatctcaggaactggcaccatccaccccattgctcaagcccaacatctagaagtcactcgttttttgttttttgtttctttgagacagattctcccctgttgcccaggctggagtgcagtggcatgaccttagctcactgcaacctccgcctcctgggttcaagtggttctcttgcctcagcctcccgagtagctgggattacaggcacctgccaccacacctggctaatttttgcagttttagtagagacaaggtttcaccattttggccaggctggtctcgaactcctgaccttaagtgatccacccatctcagcctcccaaagtgctgggatgacaggcgtgagctactgtgcctggctgagaagtcattcttgactcttgtcttttacctgccaactcgagctgcagaaccaactgtctccccacctccaccatcacatgccttagaaaccccttcatctctccaggaagaccccaccttcctacctggtctcactgcttctctattagacctctatctgacattctccacaccacagctagagtgagctcttaaaaaatattgatcagctgggtgcagtggctcactcctgtaatcccaacactttgggaggccaaggcaagaagatcacttgagcctaggagttcgagaccagcctgggcaacaaagcaagatcctctctctaccaaaaaaataaaaataataaattagccggatgtagtggtgcaggcctgtagtcccagctactcaagtggctaaggtgggaggatcacttgaacccagaagtttgaggttgcagtgaggcataattgtgccactgcactacagcctgggcaacagagagagaccctatctctaaataaataaataggaaggaaggagggagggagggaagaagggaaagaaagaaagaaaataacatactttcctgcttaaattcccccagggactccatcccacccagaactaattccctaccctggctcacagagcttgtgtgacttggcccctggctgccttcctgacctgggctttacccctcttgtccccgcccatcacactgctcagccacaccagtcaccttctgctccttaaacgcatcaaacacattcttctacgtggcctttgtacttgctcttccctcttgcctgtaatgttcttccctgatctttcacatggctggctccttaagatttctgcttaaaactgtcaccttcttagcgaagctgcctgatcctgcactgtccagcctcccccgcagattactcctcttcttccctcctcatcgcttcccacactctagtgatcctgtgtgtttgcttgcttcttctctgtctcccaccacctcaagagcaaagaccttggctgcagggcttgcaccagccccagggtccactggtactttttgaatgggtgggtggatggaagaaagcatgcatgaatgagtgaaccttgtgcaggctcaggaaagaaaggtcattgtggctttaaattggggatcattgcctggaaagaggagacatttttctggtttgggagcagagagcgggaggctttggtaatccagagagagcacatgcacaaaggtagagggataggactaagtgtggcttgttgggagactgacctaactgagcatcaactatgccaagcactgcgcaaggtgtcgaggctataggaacgtgcctttctaccctagagaagtttgcagtctgctgtgggtgatgagctatatagaagaatgtactattagatggagggaagtgagggagcaacatggttacctgaggaagagcagtccaggccaagggcacagcaagtgcaaaggccctggggtgacggtgtgtgctggctgctcatgatgcagtagggaggcctgtggctgggatgaagaatagtggagggtaaagtggaaagaggtgagagcagagatgtagctggcagtggggagggaatagggtgaagcagcaccatgtagggccttgcaggacattctaaggattttgactttcatcgagtgagatgaagattcactgaggggttctaagtagaggcagggacatgatctggcttcaatcatagaatgatggggattgactaggcaggatgggttatgatgtgcaaggtcgcagggggctgctagccaggtgagataggatgtgggctctggcagcagtggagggggcaaggcactgcgggtgttggacagactctgatgattggatgtgggcctcaagggagagtttgtgtgggagctgggaaacaactgcatcaggttgcctggggtcccactcttaggccgacaacttgccagtcatgtgacttgggcaaatcccttcgcctctgagaacagattatctcacctgttctgttgtatcagccagggttcaactaaaggaacagaacgagtgggaggtatatattaagcgatgtagtgtaaggaactagcttacacaattgtgggggctggctaggtaagtctgaaatcctatggcaggtcatgaaagggggcaggctggacccccaggcccaggctggagctgctgtccgcagatgaaatgtcttcagggaaaccttcactctgctgaaggcctttcagctactgactcaggcccacccagagtgttttagataatttcccttacttaaagtcatccggtcatggtctttaataactataaaaatacattcccaaccaggcgcagtggctcatgcctgtaatcccagcactttgggagaccgaggcaggtggatcacctgaggtcaggagtttgagaccagcctggccaacatggcaaaaccccgtctctactaaaaatacaaaaaattagctggacgtggtggcgggtgcttgtaatcccagctactgaggaggctgaggcagggagaatcttgaacccaggaggtggaggttgcagtgagccgagatcatgccattgcactccagcttgggcaacagagcgaggctctgtctcaaaaaaaaaaaaaaaaaaaattccccagcaacacctaaattagtgtgtgattgcataactggggacagtagcttagccaggttgatgtgtaccacctgaccatcatacctgtcaaatggggttgttatagtagcagcgacctggcttgccccaaagtgcacagggttcaaggaggtgatgccctttgaggggttttgtgctgtgcctggcagtaggaagggcctgttgttgttagctgttgttgcttccccaaggtgggcactgctccaggagccccagtggggctggagcagactccccagagcaaggggttctcttgagacctgcaaagatctcatgcctctcacccagttctctaaaaagctgcatttcgccagggcacctagccgggaagttctgagatgcgccactagggggcacaggtggccacggagcctcgggattgtcagggccctggggctgttgtcaggagagcctgagggttcatccaacccaggagtcctgtggaagctccagctcgtttacatgcagatgaggttgctcaagagtgttgttacaagcttgttctcttaggcaagtgttgatgttcctcatgaaatcctgtttactttattcttctccttggaaaagtggtgagctcagccccacttctatctcagtgatcataaaactgtattattagctgagttcatgagatcagcattaatgtagtttcactgcagagaagcagtgttgcctggggttgacagtttaggttttggcaacaggaagacagggtttgaaccccagctctgccatttgttattgccgttttaattattgatagattaagaaagaaggggagaagttggtctttgagttgagacatttatttccattctgtgagacccaggaggggacgacagggcgtagactcagccattgctgagtattccgttgagttaaaaacgtggactctggagccagaatgcttagtttcatgtcccggctctgcctgctgtgtgatcttgggcaagtccttctctatggctcatttcttcacctgtaaaatagggataatcaggtttttttcatggggttgaggattgagtgaaagttcctgaagtgataactccagcaccgtgcctggcctagaggaagcactaagggtgaagcagcttttactatgaataggaggcagcaccggaggggttcgtctcaaacaggagagagcgctggtttcagcttttgccctttctccggagtgactcctcaatcagacagggggaaggtggggtgtccactatctcatcattgccaggagcctccctgcaacaaccagggtaggtggtcttgtcccattttatagaccaggaaagggaagttaaggaacttgccccaggtcagccagacacaggattctctttttttttttttttttttttttttgagacagagttttgctgtttgcctgggctggagtgcagtggcacaatctcagctcactgcaacctccacctcctgggttcaagtgattctcctgcctcagcctcccaagtagatggaattataggcgtccgccaccatgcccagctaattttttgtatttttagtagagatgggatttcaccatgttggctaggctggtcttgaactcctgaccccaggtgatccacccaccttggcctcccaaagtgctgggattacaggtgtgaaccaccatgactggccttttttttgtttttgtttttgtttttgcttttttgagacagggccccaggctctgtcgttcagactggagtgtggtggcacaaccacagctcactgcagacttgacctcctggcttcaagcaatcctctcacctcagccttctgagtagttgggactacagacatgcaccaccacgtccagttagtttttgtagagacagggtctcgctatgttgcccagggtggtcttgaactcctaggatcaagtgactatcctgcctcggcctcccaaagtgctgggattacaggtgtgaaccgcagcacacagcctaattttcctttttatgagtttggtttttaataaagtgaatttgcttagagcaagacccgcccataagttctggccactattaagggttagtctatggccgggcgtggtggctcgctcctgtaatcctagcactttggaagaccgaggcagttggatctcctgagatcaggagttcaagaccgacatgatgaaacctcgtctctactaaaaatacgaaaaattagccggatgtggtggcccgcacctgtaatcccagctactcgggaggctgaggcaggagaatcacttgaacccagggggcggagtttgcagtgagccaagatggtgccactgcactccagcctgggtgacagagtgagattccgtctcaaaaaaaaaaagggttagtctacctgaaaaagttcctctattctcctccttttatagaggaagcttttaagagagggatggccacttgcccagggtatggggtgggcagaacctggtcttctgctggtcagcactcccaccaagccctggaaccaggtggaagtgtgaggagggctgtcaggtggaagtgtgaggagggctgtcctgaagcacaggaagccggtctgtgaggtctctggtacctcccttccccgcaaggtaaatacctcagcagggcactagcagagctgggctctctggccctccctgggcctgccctgcccaaccagcagcagagggagatggagggagacgaggcagtggcagcaggcctcctccctccagagcgcaggctttgtgaggctttcacttctcttaatagtttgttggctcctggccccatggagtgcacagctcaactgagaaggtgggaccttttcagggattcattaatactaggcaggatggcttgggatctgcaaggtggaaggaggggtggctggccattgtgggagaggctggagatggccctgaaggacagaggagattgtgatgggctgaagggtgtgggtagggcaccctgcaggagggacagccaggcatgagtaaggatgtggagctggaatgagtttttgcttttttgttgttgttgtgggtttttctggtgttaatttttaacatggggtcttacttaatggcccaggctggagtgcagtggtgcgatcagggctcactgtggccttaaattcctgggctcaagcgatcttcccacctcatcctcccaagtaggtggaaccactggtgtgccaccatgcctggcttatttatttatgtaggagacagtcttgctctgtcacccaggctagagtgcagtagcccaatctcgatttactgcaacctccgcttctcagctctcgtgcctcagcctcccaagtagctgggactacaggcacccgccaccatgcctggctaatttttttgtattttagtagagatggggtttctctgtgttgcccagggtcgtcttgaactcctgagctcaggcagtccacccgcctcagcctcccagaatgctaggattacaggtgtgagccaccatttctagcctttattttttattactgatttgtttatttatttggtagaaacagggtctcgctttgttgcccaggctggtgttgaattccaggcctcaagtgatcctcctgcctcagcctcctaaagtgttgggattacagacgtgagccaccacacctggcctggcatgagcttgaaaagtctgagggaaggagaggggcccatcatcccggcaggagcgagggtagagcaggagatgagtctggaaaggaagtcatggagagtgtatcataagcaagaccttttaaagcaatttccgaggcgttcttgtcctcctgagctacccatcctcagtgagaaaggcccaggctacttagagaatgtggcaaagatcttcctgccaccctccaatggcccatttcaaaagtgagcgtgtcttttgaaggcgtcagcttctggcacatcttacccaggctcgtggtttgttttgttttttttttttttgagacggaatctggctctgttgcccaggccggagtgcaatggcacgatctcggctcactgcaacctctgcctcccaggttcaagcaattctcctgcctccgcctcctgaatagctgggattacagatgcatgccaccatgcctggctaattttttgtatttttagtagagatgggatttcaccatgttggccaagctggtcttgaactcctgaccttgtgatccaccctcttcggcctctcaaagtgctgcgattacaggcatgagccaccgcagccagcctctgggctggtgtttttaaacagtttttatttgcatggctctgggtcctcagcctgattttacccttggagttcaaagccatctaattggaaatgaaaggagcctgattgatttggcaactctgcggccagcccacgtggcggtgatgcgatggagaaagtgagtgctgctcacgtgtgtgtctgcgccacgctccctggctcgaggtggctgagccccactgcccaattggcctggacacacagagcaaggcggagcggggagggggcaggggcgtggcaagcgctccccggatcctggaatccccagaaggaggcagctagttggaagcctcaattccctcagccctgcttgcacagctgcctctgccccctcactcctatcacccagtttctcctgctaggaaaataggaagttggtccaaaagggaactgcatgggcaaaagtgaactgcagaatcttgagtctgctcattgaaatacagattcccagggcctgcccagacctactgaatcagcgtgtctggagtgacgcccaggtatctgcattttttcattttcttaagagacagggtttcaccatattgcccaggctggtctcaaactcccaagctcctcaagcagtccacccacctcggcctcccaaagtgctggattatagatatgagccaccgcatctggccgatctgcattttgtgtgtgtgcgcgcgcgcgcgcgggcgcgtgtgtgtgtgtgatggagtctcactctgtcacccaggctggagtgtggtagtgcgatcttggctcactgcaacctctgcctcttgggttcaagtgattctcccgcctcagcctcctgagtagctgggactacaggtaccctccacaacacctggctaatttttgtatttttagtagagacagggttacaccatgttggccaggcagatcctcctgccttggccccccagagtgctgggattataggcgtgagccactgcacccagccaatctgcatttttgacaggcttcccagggcttctgaaatcaagctagggttgcgtctttgatgggtcatccatgtgggttgatggccatgttcagggtagacaggcagcaagatggcagggggattggcatccccaagatgaatggtgcctggatgatgcctggatgggactgctccttgaagaacattcagttgtctcctgagatgggagggtgggctacgggggcaggaatggaggacaggactcccaagtctcttacccctgaaacacagcccagcatttggagtcttggagaatggctatctgaggggcctacccagccctgacctgatgagagacaccatctgcctttcatttccagaaggttttgttgctgggggaggaaatacccaaattgtggtccagcaaagaaatgtttcccaccgtggcccacggccagaaagtcactggttcctcacttcagcgtttggtttatagacacgtgacagaagaggcaacctttccagtgatgacaaagccggcggaaaaacaaagacatgggggaaatgtgcattacttattgttttagcacctttttctaatctaaagttacttttagaaacagaaaagtggtgtgtgtaacttagtcggcacgtggcatttttagaattggtctgtttcgaagtgtgaaagaaaaaaatatttttttcctgagtttccataaaacttagaagtttacaggaaaatcatgcttttccctgactctcttctttctgccttgccccctggatttcatcattgccatgtgtggcccaagcagccagcttgaaaatgtattttgttatttattgttagaataaagtcttgcaccaagacaactgggtcatgttagaaagtccctttgcttccttgtgctcagaaacagagtttgctgggtgtggtggttcacgcctgtaatcccagcactttgggaacctgaggtgggaggatcacttgagcccaggagcttgagaccagcctgggcaacctagtgagaccccttctctacaaaaataaaaaattagtccagtgtggtggcacacacctgtggtttcagctactcgggagggcaaagaaggattgttgagcccaggaggttaaagctgcagtgaatggtgatcgcaccactgcactccagcctgggcaatagagcaagaccctatctcaaaataaaacataaagaaggcaggccgggtgtggtagctcacgcctgtaatcccagcactttgggaggccgagttgggcggattacttgaggtcaggagtttgagaccagcctggccaacatggtgaaaccctgtctctacaaaaatacaaaaattagcttggtgtcgtggtgggcgcctgtaatcccagttactcaggaggctgaggcaggagaatcacttgaaccggggaggcagaggttgcagtgagcagagatggcgccattgcactccagcctgggtgacagagcgagactctatctcaaaaaataaataaataaataaaataaaagagaaggcagagctggccatctcttcaccatcctcccccttgtcactgcttctggatccctgtgagtaagggtgtcctcagctcagccctggagcaccttaggctctttgagtgttggaagaggatcaggtctgggtacataacttcccagctggagggtcagatccttgctatgctaagcagtgatgacaggctggtgacaacagaccaaactaagactgtctttgtatgttggcaatggcccccccagggggaccttgcaaatatgcagattttaacatccctcatttcagatctgtcagggtgggacaagttcttctggcctgtgagctcctgccatacacagtcctggagcctgctggctctgagttgctcatttgcatttggccacagggttctggtcaggggaactcccctctcccccacccttcctccatgacttggctcgctccttctgctccaagcccatggctcagtggacactaggcagctgtctcctggggcgcagggagggtacccttgaaggctagtggataggaagcaagtttctgaatggacactggtactaggtcttccttctgggatgaggtggctccttccagactaaagctggcttttctggctctggctgtgcctgccttctaggtttgtctactgcacatctgacaggtcttgtgatggaacctcagtgataccaagatggagacaatgaggtccttgtcctcagaggactcctggccagatgggggaggtgggcaaggaaacagcagttttaaaacagtgtcacaagtgctgcacggggctggggccacgccatgtaggggtctctgagcaaggcacacagacctgcatggctgctgagcctaatttactgagctttctaaatgggtcagctgggtgaagaggacagtacctgtgcagaggacatctgttcagtggtaggagccactgtccccatgtgccacgtcttccatgtggggcatctctttcatagccctggagcacctactgtgtggttctgtttcagaggagctattgcagattgctacttgttcaataaaattattgaagtttaaaatgttctaattaatatgtgttggcccaggagccacctcccaccttttccttattgttaggaagagcccagccgtttcctgggagacaaaggaggccatgaatcttgactccttgtgattccaggatcactgtcctgcagccaggttcctgacactaggagatgcacatgaaatatcctccatcagggaaggaatctccctccagtgagaactcccgagaggctgatgattgaccaggattgacaggacagggaaagagcagccctttcacatcccaggtcaagaccagtgaggcccagagaagtgtcccaaccttcccacgctgggaaaggcaaccagggccagggctgagcactgagcaccaggcctccttcctggcttctcccctctctggaagcttagcattagacagagccgccgagctgtggtgctgaagggttaactcggggctccccagagagccgcacactcccgaccctctcatcttccaggccctctcagctgcagccttctgggcatagctgggtcacgtgagagccagatgtggggatttcccaagcagtggtgtgtgcgtgcgcactgcgtgcatgcacagctctgtttacgtggcatctcagcgctcaggggattggtctggacccacgcagaggaggggagggatggggtaaggaaaggctcaggggctcccagcaaacaccatgggaggctgcaccaagccctgctccccccagacattacacatgaacgggtcgttcctgctccggctcctgtttcctgtagcgtccatcctgccagagactgtactgcttaggggtaatttttctaaaaatctctttgaagggcattaaagcagatgctgggagccaacgcccttcagggtgttctgcaggctcggaggcctgcacgggagccactgtgcccagcacaagccaggcctgtatgcctgtatgtggttccggaggccaagcctggactagagagggcagagccgtgggtatcaagagggtcctggggcagtggggtagccgggcctcagttttccatgcacccttgggcttgagagcagtgagtattcatctttccatcagccactgagggttaattgggcacctcctgcattcaaggtgttgtggggtgctgacagggataaggccttgaaggaactaaaggtctgattgaagagactcataacaaatctttaataagcacctactatgcgctatgcgcttgctaggactatagccctaaccagacgtttggagccagtgggaacagtcagtgaacaaagatcctgcccagggcatgataagggagacagaaaaccttgaaaagtgggtgtcctcaacctcagtccaggaatgaattctcctcctacccctgaccccccatccccacccctgtcttgcaccagtggatggcagcgtccagccagatgtccctgaggctccgtgagccctaccccaaagatgggtccagttataccttcaaggcctccaggactcagccctgccgtctcctccctcagaccttccgggacccagcctgtctccccaaacctacatgactcctgaagcagacaggaatgctggggacggtgtctgtggttgtgtgtctgatgctttgagacagagggtggagagtcagatggtctcaaccaggggccgttgatgctcccgaaatagttggcggttgattcattgataatccgatagcaagagtccagtctggagagaaggagacattccacattttgttgtccggggaggggaatgtctgtcctgagtccgttgctattgactccatcactcactcgcggctctcagggagactgagccagggaggaggcggattgcaagactcggggctggagaccagcgactgctgacttcatcccactgcccagcctctctgctgctccttctctgtgtgaacgcaaatactggctttggctcgggcttctgggggagctggagggtgggggaattggagggaggatctcccagtaagtgagggaggaccaccaaggcaggccaccccagggagggaggtggctgggatcctggaactcagaacaaacttgagtttgtctcttctctgcacacaaatgccctggggtggggagaggtgagaacctgagaactgagggggaggccgcaacccaaggggctgccatgggttgggcagcagctgctgggatcagagaggctctgaacctgccagcctccctggccagcacccctctgtccacccacggcacctctcactaacccagcacctatctttaaccaggaagcttccggtcttctcagcagggtggagggaggtgacagaactacctgctactccctgccagggcagccccttctaggcagcctcagtgctcctagggcatccttggcttctccgtccacacccacttaggctgggctgacccttctggccccaggcttggcctaggcaggcacccttggacttagtccctaaggggctgtggagggtctccaggcccagcccccactgcaccccatcccccgcctgagcagggaaactgctccttgactgcataacccagggccagagggtcaatagtgcattcctaccctgggttgggctgcccccacacgtgttctggattccagggaatgaggcaagtcctttcttgctgcatttacgaaaagcagcagaaataaagaaagccttggccagtggccagggaggatcagaaaatgacatcccccatgaggaccctttgttcccaattcctggccagcctgcctgggcttaagtctgatgccatcacttcttgctgtagggccttgggaaagaaccttaacttttcttttttttttcccccgagacggagtttcgctcttgttgcccaggctggagtgcaatggcgcgatctcggctcactgcaacctccgcctcccggattcaagcaattctcctgcctcagccgcccaagtagctgagattacaggcatgcaccactatgcctggctaattttatatttagtagagatggggtttaacatgttggacaggctggtctcgaactcctgacctcagatgatccacccacctcagcctcccaaagtgctaaggttacaggcgtgagccaccgcacaaggccagagccttaacttttctgtgcctcactttcctcatctgtaaattacagactgttgtgaagattaaacaagaaaatgctcataaatgtttagcacagcacctagcatgaatgttaagtaagtggaaactggtataattattctagctccagccctacgacttatttgctgtgtgatcttaggcaagtctcttctcctctctggttctgagaccctaaatagtccttccagcctgtgggggtaccaccaagaagccaaagatgtagcagagagaggggacctggagacaaacaatggcctggctttccatttgggatttgctttctgtctttaagaagatatccatcagaaattcagctctactagatttcttcttgagtacttctgtttatttagctcagtggccccaaaccctcaggtcttgggcatagctagctacataatttgcaggatccactgcaaaatgaaaatgaagactctctcattcataaattattgatgaaacccctgacagaagagcattaaatcagctgcagggacccttctaaacctgggaccctaggccactgcccagatcacacctccacgaagccagctctgccttggaggctctgagtgtaggagcaggcctggggtccgagctgctgcaataacagtattcacccctcgccctccagtgcaagggcactcttttttcatgccatgggtatctctgaccagctggctgctgcttatcctggaacaagcttttgtagagttgcccacatcagaagcagctcacacactaaacaactgccccctggaccagacttccacccaggtgtgcttggattggaagtcatacctgaactatttgttttctgtcatcttaattggtgtttgtttttgtttttttgttttgttttattttgttttgtttgtttgtttgtttgtttgtttttaagagacagagccttgctctgttgtccaggctggagtgcggtggcgtgatctcagctcactgcaagctccacttcccaggttcaagcaattttcctgcctcagcctcctgagtagctgggattacaggcatacaccaccacgcctggctaatttttgtatttttagtagagacggggtttcaccatgttggccaggctggtctcaaactcctgacctcctgatctgcctgccttagcctcccaaagcactaggattacaggcgtgagccaccgcgcccagcctggtgccatgttttttaagacttttaaagaattacgaattggccatccgtgtttttcccagatgacattcacgtggctttcactgttacgcctcagcttctgctgctctgagcatgacaacctgtttcaggtcctctaaagtgagtatcacataggccaaactactttgtaaaggaccgataaccctgttgggctgtcgtaaagatatgagttgctgtgtgcctatacagtagtgcctaccacaaggaagtgccctgttcatggcaacaatgacaattactgttactactgaataataggactagcatctcttaggccctaattatttgatggcctgaaagtggtggccgaatttcctggtttcctaaccagaaaggaaaagaaacgtggagtctgcaggaaacctaagaaatctagccctgtacaaagtttagttgtatgggagaggaaaggcttaaactgcagcagttatttagaaaccagttcaaaactgcaatgaggtaagaacagtattcccaaagagagagagggcttgagtgctccagtgtgtagagatactgaaggatggaagggcatggagaagacagggaggtgttcattccatcgggcccctggcctgtcacccctcccctccccagagcccagggtggggatgtggaaagaaactgacaaggctagtgaccctgccctggtcccctgagcctgtggttctctttcattctccgtggagttttcgctgttggctgtactcattctggtctctcccacctgggctcatggcccactctggatttattagtttggatggatggaacttgctttacaccagggaagcattcctggaaacatggtttcagactagatttggataaattcaacccaattctcactgctctggagttactcaaggttaaaagaagccttactatgaatctataagtgcccttttaaaaattattttatacttatttattttgagacagggtctcactctgttgctcaggctggattgcagtggcgtgatcatgcctcactgcagcctcgacctccctgggctcaagcaatcctcccacttcagcctccagagtagctgggaccacaggtaggcaccaccacgcctggctagatttttattttttgtagacatggggtctcactatgttgcccaggctggtctccaactcctgggcttaagcaatcctcccacagtggtctcccaaagtgctgggattacagacgcgagccaccatgcccagcctttattattattatttttaagaccagtcgagtgcagtagtgagatggggagaaagagtggaagaagaagtttgacgtgtaattcactgggaacagttgagatactcaccatcttcagagcagccaaggaccctctcctaacctaggcctatccagttgttcctatgaagtccttggatgtatgtgtgctggatggggtgggttgtccttaaagtcaggggcacctgcagtgttgttctttggtttctcagcatcacctgggcctgtcaagaatcaggttcagcatctaagtacctttgggtccctgtatttggccggaatctccaggcccctggttttctcctggcctggcttcttgctggtattgcgagcaatgccaggacggacagccatggcagggacatgagcactatgggctgtgtgagggagggacatggcatacctgccatttccaggaacctactgcttttgctttcagctttgtccctaccacttactcctctttgtgtccagaggcctaattcccagccctccaaaacctttcccaggcattaggccatttcagtcttaaccctgcaaagaaggcagggcaggtgttttttccccgtttacagaagaaggaacagatgttcagagatttcctagctatcccagagtcagcgagctaagtggcaaagccagcacaagaaccaaggttgcttttattcttgctccagatctctgccctctgtgcctcctgaatcatccgctattttggactcgggttgcctcaattgagcctgcattcaagtggttttcccaggaaggacagtccgtttctctggaaagattcatttccgctgtggtccccttgtgttatggagactaccagttttctgctgggaaggtctagaacgtcagacaactgcctcaggcaggccatcagacaagagcaataggcccaaatgcttaactgtacagatgtgagcactgaggcccggagtatttatttatttatttagacagagtctcactctgtggcccaggctggagtgcagtggcacgatcttggttcactgcaccttctgcctcccgggttaaagcgattctcatgcctcagccttccgagtagctgggattacagatgctcaccatcatgcccggctaatttttgtattttcagtagagacggagtttcgccatgttggccaggctggtctcgaactcctaacctccagtgatccacccacctcggcctccaaagtgctgggattacagggtgagccaccgcccagccaaagcccagagtctttaagccacttgcccagggccacacagtgtgttctcagcaagagccagggtgcaggtttccagtctgatgccctttactttctagcaggccagtgaccctgctctgtagggccgttggttctggatcaccagaggagatgaaggcagggacaggaggaaggcaggaagcagttggttcatgtcagtcacagctgctcacttggctgcgccccccgcctcccccccactgctccttcacccctgtccctctgtctctccaactccccgtcttcccagcccttagccaacagccttgtctgcctcctggctggagggccagggtttgtgagccaggggctctcctctgttcattgtaatgagggagaaggggtccttcccacccctcgagagcttgctagggtgggctagagagaagggggagggactttgagtgggagcagcagaactggattaattctgcaggtcaggggactgggaaataaatcatgttttagagagaggtttctttttaaaaagacaggcttacttctggtctgcttcccattttcctttacggagagatacgggaaggcctgcttatggggactgaaggggacaggcatgagctccggttgtctgctcacaggccatgtccggcccccttttcgttttataaataaagttttattggaacacagcccactcattcttttatgtattgcctgtggctgcttttgtactataagaatagagttgagtagtctcaacagagaccatctggcccccaaagcctacagtgtttattctctggccctttgcaagcacctgtccagcaaagcaggtcttcttgggttctccaggcccaggcaaaacagctttccttggctcactgaaagaggttagtgctttcaggtctccttatgaagaacccaaaaggaacccaaagtagacaaagtggtcaagcaaactgaagtggagagtggcatggagagagggccagatggcgctgggatgggcctggtgctaggcctgttcaggggcatttcagggccttgcagcaggcagcccacttggccacatctctgggatgcagcagcagggagttgaaacttcagcaagatgtgggcaccaggcagcaacacccacattctgaacccagacctccttggccataccagcttaaatccttgtggaggcccttggtgtgtctaccttgtctcagccctaccagggcttgaaagctgggccagcattgctcctgctccccaaggaggctgctgactgctgaacctggggaggggctgtaacctcagattttgccctgtttgtctctgggtgaggtcccctggagtccctctaccttccattccagataacccggtgtctgagagtgactgtggggcagtatctctaacagggtgccagctttttcttggtgcatccagtattgaacactgtctagttcttgtccttgcaggccgggggcatgattttctgggtgtccccagagctgattgaacccagggaggcaggcttatgctaaccacgttcatgggagttactgccagtggcggctaaccattatcaagcactgactatgtagtaggcactgcactgggcactattacatattatctaatttaattctcacagcaacccagaaggtaagtatatcacatcatccagatttttacaagttcaggaacaggctcagagagggtaagtcacttcttcaaaggagcagagcctatatttgaacccaggcagtcagaccccaaaggccttgctagaccgctccaccaaagccccactctgctaatttacaatgagaaccagaagggggccaggctttctagttctacaccgggagccaacctgcaattggaaggtggcttgctgagtgagggaaagagtcaggtgctttaaatagagagcagcatcaagctctgattagctgaggtgtgtgtccctgcaagagatggacactgctgtactagctgtgtgatcttgggcaagttatttaacctctctggttcagcttcttcatctgcaaaatggaggggataatagtactcatcgttgtaggtttgttgggaaaaataccagttactatatgcaaagtgctcagcaggatgcttggcaaaggggaaatgctgtataagtgtttgctgctgtttatcagtactctctgaatgggtcaggctgctctcctggcaagcgcctggtgggcagtgcgagagtttgtctctcagacctgcaattcagcgttgccttttaattgtccccactgcagccagtgctctgctcctttggaggtgatgagcagcccagcagagaaagcagcagcctggggatgccaccagacctggttccatgtctgagagtcctccccggtaaaatggggctaaacatgcctacccacttgatggggttgccatggggactaaatgagtcactgtagttcgactgcatcaatgcttttgacatggtggccctcttctcttctattctagaaatacgcaaaccattgattagaccaagagctttctgcctcattcagatgttaatggtatcacatctcaatcataagttctttatgctgctttgattttgctccttcctcttggcaggaggacaactctaaatcccatttcacaggtgaggaaactgaggcccagattggacaccactgtctgagcctggagtagagccctcatctcttctggtcactcaaggtccctgtccttctgctttggggttggggagcaagactccctaaaacgatgctccctctgctctgctggggccgatctgtcttcctcagtgggtggggctgcagtaagggctggatgacacatcagggtctagtgggtgtggtgcccccaggcctagagatgggtcctgggtgctccaaccctgacatttgaggttctgggtccaggccactgagcccgctggcctttgaggatccttgcaaccatcaggccccgtgggacccagccacccacatggccagaaaggaagggtcaggctgccttgtacagggctgtgataaccacgggccccgttccagggaggatcgtgtgggattctctgtgctccgaaggagtcctgcatttcggcggacacctcattatccctgtcccagccggctgtgtcccagcgcctctgtaatcacacgggcccacgcccaacagccagcccagggccaggaaatcactctcctccctcctccgccttccgcccgcggctggccgagcgcggcgcctgcagccactcactgtggacctcctgcctgcctaaccgttctctctctctggttctcctctcctgctgccgcttgctctcggggactcggaagtgtggctgtccagctgggctgagtcgcccaagaaggacgtgacaggtactgcccagcgtgcatgcatgtgtgtgagcatgtgtgttccaggtccgtgtgcgcgggagccggtgcctgcaggccctgcgcatgcttccctgtgatgtgcagcagctgtttgccagcatggcagggggtctgccacttgctgtgccctctgcctccccagtcagatctgaacatggggccctttgctgagtgatgaccacgtagctcagcgtgtaagcacgtgtgctctggacccagggtgtgtgggtctgaattccagctctgctacgtcctggccatgctgccttgggtggggtgtgtaacctccctaaggggaagccatcccacctcgtggggagcctggcacacagaaagtgctcaggcagtggtggggctttcgccatcttcagccttatctcaattggccgtctcagtgagagagcccagccaaagatggttcatctcactttaggcaggtaaactgaggcagagagcagcgggccctgacacccaaccctcatttccagtgatctcactggggagctgcagatttggggcagggggtggggcagttctgtgactgtgactgagggtgggtcacagcccccatgcccagcaatccagagcttggcctgcctggctgagatggccctcagggactagggccttggcctgtgtctgggaggagctgggcaggggtcagggacttgccttcaacctttagtcttatgggaccatggcagagaatcccggacagcagggttctcagctcctggatggagatggtcggaggagggatggaatttccagaagggtcttctatgggacccctccatttttgaggctgttacacaccctgaccctctagccccaaacctgagagcagaggttcaggctgggggaataggggacaaagcagaagggtgggagctgagtggggtggtggggctgggccagccccagtgtttagagcccaaagcccagcccctactgctgcagctgtgggcggggaatgggaggtaaacgtgttgggaggagtccagaggagaagagaaggcagtgggtcggagggcgttgcaatctccttctggagtttcctgtgacgagggcctgggcctgagctaatcactgggctcctgtccctttttcccctctccacacgccagtgagccagagcccacttggcccacagcaatacattttattcaccaaacgtatagcggaggggccagcagtcccagtccagcctgggaggaaccagttataaggggctagagggacttttgtaggatgcccagggttggggagtcgtggggagcctggggtggaggccagcacagggccttactagctctgtgaccctggggaggacacttaaccacgtctcaagatgatcccagctgtttggagtgagaggcccaggggaggcagtgtgggctgggggaaaacccagccagactgcgagtccagggccagagtctctctgggccttggtttctccatctggagggttggagggttctttgagatatgagacaggaaactcagaggtaagggctgatgttggagatccttatagatcaggggcctcaggttgcttagcctggcatccccccagagtaggcccagggggctctgagctgcctctcaatccagctggcaagtacccgttacctgctgaaggtagggtctgggaggggcatgttgcagggacacagcccccggcctcccttccccacccttctcctggcacctgcagccctggcaccgagctgcctgctggtgagcccacgaaggaaccaacagctttgctgctcctcagatctcccattccctccacttgctttaaaatgaccatctatgatttccataggacttgaagccccgtcacttcattccgtgctcagaacaattcccatgaggtaggaactgctattgttcctgtttccagatgacactaaagctcaagagaggttacgtgtcctccccaggatctcagagctagtaagggcaaagcaggactggacctcagacctttggactctaattctaagcatttccatcatgaatttcaggtaattactatgtcccatgtcatgtcctgaggcaccagtcctggagtgtcgagagactcttgtccaaggcacatactttggttggggagcaatgcccaacataaagtccaggagggaacagaaaagagggaacaagagtgatcaggagcctcctggaggacagagatgcttggggagaattgggaaactgggattggtagagagaagggaaagcattccagcagggggcagcagctagagcacagacttggaaagtaagaagctgcatggagcagtggtgttgggtgttggcgcctagtgggtgctcgatacatgtgttgaatcatgaatgatgtattgaatggtggtgtgggggacggggatcaaggaacttggggagctcagattggcaagaaagactgggcttgaatttgtcctttataggcaagagggagccgtggaaggcgttggagcatgggactgacttggcaaaagcccagttgagaagtttaagttggcagccagggttccatccaggtggtagttgaaggaatgcagatgtgaggcaagggtggggcaggggtccaggggacccctgggaccccagcaggtccagccaggggctctgtaataaagcacaagggtccatctctggatcagactcatgcaaaggccccttccaacccaggagaggctctgctgtctagaagaggtacaccccttctccatgctcctgccaagcactcctcatctaaagacaccaggctccctccactgccccctccccactcaggcagactcctccagcccctagttctgcaggccttggctgagaggggatccagagtggcctctgtgggatgacatcaccgcccactgcctgcctggcctgcaagtggtttctcatctggatacctgctcgcagctcccgcccgcccggctgccctggccagggaacaccctaagaggcagctgccagagggaagagctgggagcctgcctgtgcaacgggagggaagggcagccagaaggacagagtgtccgtgtgtccatcccacagcctttggagcagctcctgagagaggccatagcctgtctgtgctttccaatgcctagagaatatttccttaacttttctacctgtgtcccagagagtcagccttcaggaaggtcaggccaattttccaggaaagtggtggggggaaggggtgtgggggtgtggatttaactctgctttgaaaccctgcctcagattttcttggcttggattaaaatgagctgatgtctgtccactccccagcacctcctgctcgtcctccaggcatcttctggccacaaagctggggcttctttctcctccttacctcagtttccccatctcccctttctcccttcgagtttggctcattttcccatattcccatatcagagtcaaggtattcatattgacaccacaaaccaatgagtccctctgttcatctttctgccagttcacgcgtttcactggttcatttcacacttattgagtgcctgccacctaacaggcactgtggtctggtcagtagaggtggcaagagtcaactagaaacccatactctaggccaggcgtggtggcttatgcctataatcccagcactttgggaggccaaggcgggcagatcacttaaggtcaggagttcaaggccagcctagccaacatggtgaaactccatctctactaaaaaatacaaaaaaaaatttagccaggtatggtggtgggcacctgtaatcccagctactcgggaggctgaggctggagaattgcttgaacctggggggcggaggttgcagtgagccgagattttgccactgcactccaacctgggcgacagagcaagactccgtctcaaaaaaaaaaaaaagagagagaaagaaacccatactctagtctttattaagcagccgctgtgtcccaggtacctgggatgtaatgggcccttccctagggaccaggcgccggtggcccattataggccacatacagtgcagaagttaagatcataggcagtggtgtcaggtgggcttgggttcaatcccagctgtgtgaccttagagaattcacttaccctcatgaggcttgctttgcccatgcgtgaaacggggccatcacaggacctactgcatggggttgctctgaggattggacgaggcagctcgatgctgttggatgcctccaagtcagcactgatgaaggcttgctgtcactattgctatgatctggccatactcaggccttgcgggctctctaacctgccacagaactctctattcttgtttgttgctggagcctttctttcccactcttctcatccagtgcccccacactgggaaaggaggccccatttctcgtagggcagggatggccctttttgtgccgggtgcgcttaagaagtgctgttggccacagaggctccaggcatggaacaggcactgctgttcccctaggggcacagtgggaggtagtccgtcagcgcagcacccggcgctgcctctgcccagctggcaggggcaggcacagaagctggcatgcctaagtacagaggcggggcaggccctactgcccggctgttggttgcatttctgcctgaaatacaatcccggctttagcagggctgctcgggactgtgcacgtgcgaatgtatgtggcacactcagctgtgcagggtcccttctgcttctccaaagggctgagatgggcctgcagggcccacacctcatgggagaaaactgccggggggcagtgggtttctttccctggaaggaggcctccctttgggatttcctagagttctgtggccattgccgtctgccctaggttggagggagcctccccctacagaaggacccaaagatctaagtagtgcttcttgcacctgggtgcacacaagcaccatagggacacaggggggatgtccaaaaactactcatgcctgagtcccagaccaaagaaacctgtctctctggagcccagcatcagtacttttaaaaagctccctgggtgattctgtgcttccaagttgaggattactgtgctagaagaaccagactgatggaaacaaatcagaggcagttattctgcaatggaaagacagatgggcttgggcctgaacaaaatcatactgaatgaatgtgatgctcttcatagcagctgtgggagctagagtcgtctcttgcctgctgtagaggggcctctggttagtcttttgtgaaatggaagataagggggatgttgtgggcatgaaatggggcggttaatgtgcctggcacatcacatttgccaagtcaaactcaggcgtgtggggaatgtggctataggctgaggcaccaagggggctgtgtggaacttggagaccctcagcaatttttgtagccaggctagtgacatgaagccccctagccttcaaggagattggcagacatatagtttatgccagtcgcagtggcctatgcctataatcccagcactttgagagactgaggcgggaggatcacttgagcccaggagttcaagaccagcctgggcaacaaagtgagacctcagctctacaaaacataaaaaaattagccgggtatggtggtgtgtgcctttggtcccagctacatgggaggctgaggtgggaggattgcttgaatccaggaggtcaaggctgcagtaagccatgattgcaccactgcattccagcctgggcaacaaagaccctgtctcaaaaaaaacaaaagtatactaggaattccctttgggctgggggtggtctgagaaggcttcctgtaggaggtgactagtccatttctggctagtggatccttttcactcctagctaaaagcacatcataggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagctgagattgcgccactgcagtccgcagtccggcctgggcgacagagcgagactccgtctcaaaaaaaaaaaaaaaaaaaaaaaagcacatcatattttaagtgtcttatccccccccgcccccccccccgccaataatggtgatgggaagagttgaagtgcagaggtttaagcagcatccagtgccactcagctaggaagctaaaagggcacccagcctgtctgccttcctgcctggtgcctgcttagcaaatgtcgtgctggtccagtggctgaggaggacagagaagctgcttgctcctgggagtccacctgccctccctctgctgcacccagcttttgacccctcaagcccctcaaactgccggggcctgaccacaagccccggcactgaaaggcagagagaaactgagtcagtctctgcagccagagggccctctctggaagcagggctgggggcaggcctgaggctggtccgactgtacccggcctgggctcggtggcagcgcctgggtgagcccgaggggcaggaacggagcgaacttgaggaaaagttggcggggggcgggctgggctcgccagccgctggcgcggggactttcttcttgggtttcaagtaaacagtctaggcctcctccccctcccctgcctccacccccggctcctcattcgacgggtctcatgtgtttctatttaagggttgcgagtaaaccccagtgattggcggcctcaaaccctcttgactcctcgcctgggcctgggccgtggagaagctctctcccgctctctcctctccctctcccgcccgagggagcagggctgccttttctctcgggtttgcaggggttgggggcagaggctggagcctcctgcttgcctttcctttgcctctggcctcagccctcatgggccgcccacccgctggctcgccgccctccccgatgcccctgccggcccgagagggaggccggagagaccccgtcggccccaggcctccccgcaggctccctcatgccgggctgtgactaactcatcgcagcacaaggcttctttctgagcttccttggcctccgcctccgctctgcctctctctttcctcctcctcctgcccgtcccctccccggccccctggctccccatgtcccccggaccccgcggtgcagcgggccggtctggggccttgctatatggcctgtccttggcgccctgtgagctgcgagccccggctgcgggctgcccctgggagcggcgctggcgacagagcagccacccccgaggaggccgatggacagggggcgccctggccgcggggccatggctggccgctggctcaccgcgtgctttctgccctcgccaggtgccgacgccaccgccgagcccatgatcctggaacagtacgtggtggtgtccaactataagaagcaggagaactcggagctgagcctccaggccggggaggtggtggatgtcatcgagaagaacgagagcggtgagtgccctggccaatggccgtccactggggttccggtctggcccccgggccgagctggtttttgttcctccctcctcccccaccgctgcagctatacgttatttccatctggcagagagagggccgaggcggctgaagtttccccctgttggtttgggctgcaggccagcagtttgcctggtggtggaagaatgtctccttgctcggggtaattaaccagcctgtgttaattgcacgtttcaggcacagcgcgggaataaatggccagccctgctggggtccccgtgccctcggaggcccgtggggcagggtgctctcagctcagggatgcccagcaacaaccacgttctgagccagggtccagggtccaggcaggacagcccagccagctggtggggaaggcaggccctgctgtcaccatggggtccagggtccccgggtcgctggcaagtttgtggaagggccaggcctgcgggcgttggttggggtctggttggggatctgactgccccctgccgagctggaggccccaggacctggaaagcaagcgcagtgagggggatgcagccaggcctgggccaggcaaggtccggcactgacaggggccgtactgacagctgcccggggcagctggttctcagggtgccacggagggggcaaaggtaccttggtgtccctggcagcaggagtcatggcaggtgaagagaggagagcccaagcctgtcagtccaggcttgttcggcccccaacagggccagggctgggactcgagcccaggacatccatcagcccacagcctcccagggcttgcatgggtttctggggtgttttgtttcagtttcggtttgctgcagggaaggcccctgtgctcagagcctctctgagtggtgtttggtggatacttccagaggggaggagcctgttctcctctcctagtcccactctatgccttgccagtgtttaaacccggaaaggaaaggcaaagcataggacagcagtgcctgctccgtagagacaggaatcgagacacagggaggttgcggggaagggagtctcctgagatccaaagcagaaccctgtgcctcctggtggccaggagctgtggagatgctaaggaaatcccagtgggcctcctgggggaggtgggtgcaggctcctgccaccagtggctccagagaacagggctgtgatatgcgtatagggtctgacttgtggccctcctgctctgaggtcttcgaagtgcctgctcccctctcaggtcagactgtgtctgcccttgtgcctggagtcatcaccaaggtggtcagcagtgacagtcctccctggcagagccatgtccctgctgtgaggcctcaacctttcgtcccaggtgcccacactgggctcctccctgggcagctttgtcctcagcctttgtcatgctcatggtgccacgtccctgcccgcaaagtaagctagcaatgtcatgggggtctggctctggaaacccccagtacctgaagacccaaagcaatggatctctaatggtgacatgggagacctcaggcgagggagatgtttgttgtagagcttgcatcaggaaaggtggttggttcttctcagaacttctggctagggaagttctgagcaaaccaatggttctcccaccacgcctgcctgtcacaccatagccgtttaacccttgagcagcaggaggtagtgagcccccatgtctttgggggctgccagccactggccaggatggctgaagatgagagcacacaagaggaagtcatcctgctggaagactccaggattcccagggcatgtgcgccctctcccctcctatcccatctacaggaccctgggacactggagtcctaggattgggggaaggagccttgacaaagggggagatgcctgctctcctgaggagctgctgatggctgttagaggtggcccaggcaccccagctccccacggccacccgtggccagagcaggccagtctggcacgcagactgtgtgagggagctgctgttcttagaagccgcattctacctgccactgcctgctggggggcttcatgtcccttaacttctctgggcttcagttattccttccataaaatggagatgaccttgtggctggttggaagcaggggctggagcaaatgacctccctgagctctctctcaggtctgaactccaaggctgggaaacttggtgggactcaaggtgtcgggtagaaagagtttccctgaacatggcttttctacttctgggagtttcgtatctttaccgttggtagagacagctgctcagctgcagatatttgcacaggacctgcagtgctgtgcctacctattcaaacccgtctgttgctatctactaggaggcctggagtatacatccagcctaaccagagaaatgaagtgggtggaggggagaaaggaagagggccaagctgcagatctctgggatggtcgcttcccagttcagggaagctggaggcctgacggtgggggagaggaggcgtcttgtgcaacctgaaggagtggtgagtgaggcttttgaactcaggaacaaagacccaattgtgaagcctttgaccttgggacacagtgggtgtgttgaggcatttccatttgcgttgttgggcaatggccccagccagcaccatccccacctccctgggccttgccttgcccacagggtgccaggactctgcctttgtcccctctcacttggctgggagtgcctcaagtagagtgtccacagggggacccagccacctctggctctgcctgctcatcagagcccctctgtgctctcattggtctaaagagagatgtgcatggaaggtgattctgagtcagtaaacaccaggtggcaggccacatgcttcacatacatcattcttttgggatatcatggaacaacaccatgcagtagaagggagtttaaccaatttgtggctgaagtaataggctaagaggctaagtaattgccttagagtccaagagctaagatctctcccctcaacagaggtcatgcagggaggctgagaatgggcccatcccaggtgggaagggtagaagtccaagttggcaatgctgtaggttgaggcgagatgcaggctgggtgagatggctgtagagctccctggaacatctgtggggaaggttgtctctgcatccctccttccagctaatgggaattcatgttgttcattgatccattgaacttagggacaagaaacagctgagagggtctgaggaaggtgatgtgtacctaggactgaggacaaacctgttccagagaacaggagtcaaacccaaagtgagacttgaatagctttaaggaaagcatttgtgatcaaccagtgggcctagggccagaccagaagaggactctttttctccattgatatacagggacacatagagcaggaagattcatagctttggtagctttgccacccagcaagccataccagggcatgcagccgccattgttactttgtctttggaaacccctctacccttgacataagcaaaagtgcataaggcgcctcctctttaggacattcatttgcctcaaatactgcattggcttccctctccagcaggcataatttctggcagcgtggtgacatcagggtcctggtcactctgatttgtgtgttgagcaaagctgcatccaacttcctaggattgtttcttcttaggactgcaggccaggggaagaagtggggagatgagtcaacaaaatttttcctgcctcacctttcttctctgagtctttgcttacttcctggcaccgggcatgatacattgggagttcttatacttccatggaagcaagaaattttgagctcctggtccatcattttttttacaagtgagaaaaccaaaccttgggaagaatttgagaatttttactcccctctagggtcaatgctttagtcccagttgagttgtgagcggagaacagaaattcactcagactttctcaagagactgttgaagcaataaaggaaaatctcaccaaacccaggggtgagaagtaaatcagccttaggaggctggaactgggaaccaaaagtcagcacgagccaaagcagcttctctgtctctcttacttaccatgtagattttttttttttttttttgagatggagtttcactcttgttgcccaggctggagtgcagtggcatgatctcggctcactgcaacctccacctcctgggtcaagcgattctcctgccttagcctccaagtagttgggattacaggcacctgctaccacggctgactaatttttgtatttttagtagagacagggttttactatgttggccaggctggtctcaaactccttacctcaggtgatccacccgcctcggcctcccaaagtgctgggatcacaggcatgagccaccgcgcccagctaccatgcagatttaaagcacagctatgctcttctaactgtagaccagcctgccttctcctctcatccgaccatgacagcagcttgtttgagtggcgttggtttctcaggaccagacttgcatgacttttcagttgagatctctcccgacaactgagtttgacctctggttctctgagttcagaattcgaagtttgaatctgattgttttctcaccagcaatggattggcaaacgttagatcgggtgtccagccctggtccaataagctgtgtcctggagaaccatcacagagtataaacatggttacctaaccaacctcttcagcagaggctgttggtgggtaggttttaaagaaaagttacccaaaaacatggtggctacagccattttacttgttcagtacctgtgcatgtggtggagagggtgaagaatccagaattccagtacggggtttaagatctaagtctatatactgtgtgatataagtagaaatcaatttgttttctgatggttaagaggggctagtgatacatactacatgggctttctgtaaggatgaagtatactgtatgtaggagtggttcatttattcactcgtttatttcaccattcttgaatacttgaatactttgtgctaattgtgtatacatccatgaggttcctgcctttatggagcttagagtctaattgatgtgctcattctggtagactgtattgtgagcctgggatagccttacagactttgcttgcttttttttttttttttttttttttttagacagggtcttgctctgtcacccaggctggagtgcagtagtgcaatctcggctcactgcaacctctgtctcccaggattaagtgattctcctgcgtcagcctcccgagtaactgggattacaggcgtgcaccaccatgcctgcctgatctttgtgttttcagtagagatggggttttaccaagttggtcaagctggtcttgaactcctggcctcaaatgatccacctacctcggcctcccaaagtgctgggattacaggtgtgagccatcatgcccagcctgcattgtcttaaacggattttatgtgtatcttctacatcttgcttagattctgtgcttactatgtaaccacctgattactattataattcagacttccacattcgcctgctcctagaaaagaagtgtcccaacaaagataggctaggctgtttctagaagggcaggtttattgtagtctgcattgcggaaaactgaactaacatgcttatttctgcaacagtcttttaagagtttggctccagtgaaccagactccatttagatgtggtgccacagaggtggtgcctggccccacgaggtcctgtcccagccatcagaaagccttgtgcactgacagcccttctcttcagagtgcagcctgtgtgtgtgttcttgctatatcaggctaatcagcagagtcccttttggcccaagacgatctccagtgtgcagccgttacccacttcacagagctggctggaggggaaagggcctgggagcataaagccaggagcagaggcaggcatgctagcccagtcttgggcccttccactcagctttattcactccaggatcaagattatgttgagaaggagactgcaggatagcctagcagttaggaacatggacttcgtgttagagaaggctgcttttcatcttgatttggttacttcctgtgctgatcctggggaagtttcttgggtcctctcagcatcagtttccttacctgtaaaatggggataattgtacccacagctatagggttggtatatgctaattctaaaggaattcagggccaggaatggtggcttatgcctgtaatcccaaaactttgggaggttgaggtgggagggtaacttgaggccaggagttcaagtccagcctgggcagcatagtgaggccctgtctctacaaataatagtaataataataataaagacaaaagaaagttagtgcttcatgcagggcctgacacacagtgggtgctcaataagtgacagccactagaaagaccactgattggggcagctctgccacagatcgaccctgggacctgcagggggccagtttctctcttgtggcctcaatttcccccatctggtcatagaactgacttggtggtatctgaggactgtcactcctgagggtctgtgaggtggctatagcagcagaggggtttactgtcaggcagtgaggccaggacaacccattctggggccagactcactcccctggagttcttgcttgggcagttatccttgtcccagcctaatcaacagagtccagcaggaagaagggttggcgacacaagtcagggtcccattggtggcctcatgggattgggggctttcatgacaaccccacgctgatggtccctcagtagccctgttgcatggtgcagagctgaagtgtcaggggtgaagacaagcatagtcgagaaggcttcctggaggcattgagcagggctgggagaatgaagggattagacaggcagagcgaggagtacagggcgtggtggggctgcgactgcaaagcaggcatgcatctatgtgccccaagcagaagaaaagcgggagctgggcagcaggaggtgggagggtggggcctcgggaagctggtgagccggagaactccctgagaagggtgagccttgaggcaagccctccgggctgtgtggggaggagggtggcaggcacaggtgtggcaggggctgggcagctctgcaaatagtgctttcttccagctggatccacagtgcctattgtcagggaggcatccaagggcttgtcaatgccaagtgctgccagctacctgcgtggagccagctgccaggcaggcaggtggggcagtgagcatgggggtgctccctccaccatgctgtcaccctgcccaggttggacaggcctggtgtccagttgctgtggcctgactctgtggacctactggctctgtggacctctcatgtcccaaactcctccaaggccattttccttgaatagttatttctcagcaaaatatatgggttagtggtggcctcggtgtggcatgcagccctggaaatcccacagaagtgccagagtgacaaccactgctcacccgagttgtagcctcagggcaatacctggccgccttccctttgggggacaaacaggtttctactgactgagcccatgagcatctccaaaatgttatttttccaagtttgaacaccaaggggcctgtgaagctggtcttccgatggctggtcggtcggtcatcagtaaatctgtacgagctgactaagtgtcaggctgggatccagaagtgacagaggccaacaaagccctcatggggctcaaatattgcgaagagacatgtgacaagtaaaccaaggaagtaattctaggtgttgacaagtacaagtcaggaaacaagcaggcgctgtggagacgtcagcagcagggagggggcaggggtgtggtcaggaaagacaccactgaggtgttgttaaagctggggacaggtgggccttggtgaatgcagggaacagcagaaggcccgctggttctgggagggcaggagtgagcaagggcagagacgggtgccgggccaaggagtattattctaggtacagctgtcactgcctgcctactcgaagccccgcagcggagctgacagaggtgacttgcctcctctgactcaggtgtacctttgcacaggtgtcctgtgagtgggcaaccctggagatcctctgcctgcccccaacacacagacactgcctttgtcctcagtggaaatgacaggtctctcacccccctccccggctgaagtgcagggaaaagatcaccccacacattttctccactgttacgtaacagatttcagcaaagtgtaaagcaaacactttctggggagtataatttttcaggaccttggggaatttgggttgggaaattgccccttcctcattctctccccagcttatcctgtggccatgtgatattacacccttcagcagttgggttttctgtaattgttccggtgggagtgggggatagctgccctcatccctctcagcatcttttcagattccataacctcatcctctgggtttccagtgctgacctagaatcctggcctcattgtgggggtgtagctgtggtgacccagttcacccagatggcctgcaaagtctgggggagccagggctcagcaggactccccatcctgggagctgagctgtggaatcccaggaaactgacggaagcttctggctcatagaacccccgagttcatttccctctgaaatatgccgtgcatgattatcattggttttgtttcatccaactgtcttagccccagctccacactccccttcttagctgggcatctctcaggctccggctaaagttcgtttgcctcccctgagtttttattggatcggattgtggggaagtggcccaggagcaccatgggaaatgagcaaaggccaaactcagagtaagtttgccaaggactgtccataaagcaagtgaactgtgggtgggttttgagactggtgtgcgatagcagatccctctctcctcttgtgacggggcccgttggcagtgccacaggttgccctgggatccccatgtcctggaaagctctaaggacagtggccagaagcctgcatgttctgttcttccacactcctgccaggagggttattggggaggtcaaggccacctggagagatgcctgctcgtgctagctaagagggggggattttggacttttttaaaggtgatctctttctgaatcacagtattttatgttttacaagatataaaaccatgcagtctataaaacatcttggcaagaggcaggatggatgttggcattctgtctttccaaggaggaagttgaagcccagagaggtgaagtgacttgccccaaggttgcacagctgggaggtggggcatgagcttcagtcactgccatttgaccagggtttggagatctggatatttgcattgtagatttcacttctttgcaaagccaaactccagagtgcttcaccacatgagttccctggccacagagcacaggaaagcagcggtcagttgtgctaaagccccactggggcaggagaaaggccaggggcagcaggtcagagggaatctgaaagggaagagaagcatgttgactcttttcccacaagagagttgcacgagcattcccacctttggcttaccaggtccttggggaggggctggtctgtgtgggtaggtcagtctgcttacctggtgggcagcaccaagggtgtgaggtgtgtagctgtggggacccagctgccgggaggctggtcagcactccagcctacagtgccttcttctttccactatgcagacccatcctggccactcccccaaacacaaaccccctaaggaagacctgccacctgccaccctctctccttccgcacccctaccccagcattcatcacatctcagccctcagtgaaatcctatatgcaggggctgcttccataggatgtggtttgctcattcagtcaacaaacatgagcatctactgtgtgccctgtggcatggccagcactggggtgcacgtggacaagaggcagctgtccctgtcttcccattgctgaaggtgacagcatcctagggctgtctctttacctgcaaggtaaaaagcccaggtgtagtgagtcagtcattttcactctgcacctacagtgtgcaaggcagaaagcaaagtgtggctgaggactggagctaggactcaatctgctctgggcaccgtgagctttcatgaatactgtcaagtttgctcagagacagggacagggcctggactgggtgggtccagaaggcctacttctggagaaggtaggccttgaacaaggggcaggccccaggtggctggcaaagctgaaggaggaaggtgctccaagcagagtgaacctgaatgatgcatgtggaggtgtggagggtgaagtggacaggtggacaggtgtgatccagccacagtgcctgggggctgcctgagagaagctggaggaactggtcaagggctttgaagggccttaaatatagacaaagagagcttttcctctgttcttccccattgcgctgaggggctgagggatagcggaggcctggaaaagtgaagccacgtgcccagcatcatagtgagtttgaggcagggctgtggcacatctgtgggctgctggtgcagtggtggctgtctctgaggtcccaggaggactggggagtgatgcggcaggtgccaggtgaggggaggagggggagcagggctctccagctgctgccgctgctgagctgctgccgctgctgagctgctgctcacctggcctgggcccttccgcctgttactagggctagagcctggagccaggcaaaggcacctccccatccctgtgcatttaaagagcctgtttttctaactcccctctcctctccccacaagatcagcttcacgtgccccaactggagaatgcaaactcccccatctagcaaggcttctgggggccagtgtcaggctgggaaggatgcatggtgtgctccagggaaggtggggctgccctacagctggctgagtcccccctcaggtccagaggctctgcctcctcagccccttgtgttcctcccttcccccaggaagggggtgaggttgctgttgaggttggccaggcatccagctctggtgtttctggacatgatgtctttctcttttgttttctgtacttttaagcggcattctcacaggccccagccttctctctgctcagcgtgctcaccatcttttgattacagcagcatcttgagctgctgcgatcaggggtagcatacaggttggcaaggatacaaggcttggggtcttgcgcttgagactgcaagccagcacctgaagcactggctacttgagtctcccatgcctggtttggccaaatgacctttctgtgcactggtggggctttctgccagttctagacactcacttcttgctcgaggcattgggtcaaggaatagccacttggcatggtgctcagagtgtcatgttaatgggcagagcagtggcgtgccatcgagggaggaaggccaggctttgcgtaagaggagcttggtcaacccagactctaagctcagccaccaaacagccaagtgacctcaggcaagccacttcacctctctgagcaccggctttgctcatccacagcatggaggggtgattaggagtggagacagtggccatggttgctttccagataccaagcttccccattcccctgacgactgtgctgttaccaagctgggcaagaagcccactttatctctgcagttctggagctcctaagattccatcttacccctagggacctgaaaacgggccagtttcagctcagagggagcaggcgaggggaatttgaccatgttggcaagccttcagccagctcttccccgcagccaaatgggtcactggctacaaacgtctttgggtttgtaatgatgatcacagggatcgtggactcctgaacacctttggaatgggctttgtgcagccaaatgcatcacagattaaatttctggagaaggaacagctgagacatagtcttgagcttccctgagccacttctgtactatggcagccaaagggtgtgcacacgcacgcgagggggcacgtgcattttctcccctgacaaaagggtgggaggtggggcaggagcaaaagacgatctgatcttgcaatttgcaatagccagtgggccagctggtgcttctcgtggtttttaggatagtgccgggaacagaaagaatatgatgaatgtcatggaatttcatgataggagtttggggtggcttcccctcctttttaaaataatgttttgaaaagttgccctggagaactgctgaaagcagagaggctgatggacgtttttggttatgtcagatgaggacaagattatccaagtgagcgagggtgtctctccctgtcggctgggctgcggggttccagggccgccctgccagaaagcaagcaaagggcccgtaatcacaaacaggctgggatcagttacaaccagaagtattactttagactcttggctttgatggggaagaatgcagttttccttggccccctcccccgtccttctcaagttaaacaagagccatgaaagcaatagctctggcgcttaaagagaggcttggtgcagggatctcaaaagccaaacattggagggctcccctgacccccactggtatcggggtagggatttgcctgacccttttactaccccatttcttcttgtgtgcactggggaatcctgtttttccatactctttcttgtctacctgggcccttctcatcgcctcacctgtgtcgtgcccaccagcccgtgtcctggcattctctgagtgcttgccatgcatctttcctgcgtggatatgtgggtgggaaggaagtcgggcagggatagcaaagaagtggctagcacgttggagcagaccttaaccagctcctgaagataacagaataggagattctcatccctccgggctccaacccacccctaggggaccctcttctcctcccctccccctgccttaaccagtgcctcctgggcaagcatctgattgactctttcgtgcttgggcatgaacgacgctgctccggagcactggcattatgtggagtgtgctttccccagcattgataaccggagcagaaccagggtggcttgaacctcattgcccacagggtgggattttaactggctgctccttgtaggagagagaggatagttacctcggcacctgggctttgcatggggagaatgagcatccagggttcctgtctcgctggctccctcaggagaatttaaccctgttcttctgtttccaagcaccatgtgcaagcaccaagtgaggctccatgtcccaggcctgactgcacaaccagacacaaacttgcctccttggatttaaagggcctctacattcagtggagctagagcatcttgttggtgctcatgtgccaggtgagaggagcatttggacctcaggggcctgacctgccctccacaccctggtctctccactcccaggaggtcatcctaccacctcaaggcccttgaaggagaaaatccattctagaagtggttccagggtaaggggctgggtggaatcatagccaggttgggcaggaactctgacccagagacaggacagtgagatttgagggacggagacatccaaatccaatctaagggctatgccagagctggggagctggagctgatgccatgatattgcagtattgcccgcttcctggggagtgaagctgtggctcctcatgggtgacagctgggactcattgggggtatcttggcctgccacagccagggtatatttaaaggggcaaaataatcccctacctccatccccccacccctgactactattatctgactccgtctagacctccccatagaggcctccctccaagggaggtggttggaggaccccatggaggctgggagatggcagtgtggcaggcaggccaggtcagtgacttcccccagctttctacccatctctctgccctcaggtacttggatcttcctgttaaacagtggtagaatattgatcaaaggctgggccttattcagagcggagaaaaccagaacccagcaaccaagcaagggtatagtcaggagctagagatcagacatttgttcattcaattcactcattccccagcctttatctcctgctgtatgccaggcactgatgcacagaggtgaacaggaaagacttgatctccatctttatggagcagacagtctacaggggacacatacagttgcccgctctgacccagctgaggggactgtggttgctggttggttgtgggacaaggtggttggctctctgcaggcctctcccctgtgggtgctgggggtgggaggcaccagagattgacaggtcagtgtgggaagagctgtatcactcactggtactcatgggtgtcagtcaccactgcctgaccagtcactgtaactgtggcgagtctctagaatgagaaacctggtctgggccagtgttgtggggtatctggactaggggagtatctggtttgagtgtggccttttctccttggattggggtgggatccgtactagaccaattcttgggaaccaagaagacaagatggttcccagaggcaaaagagacaggaagggaatggggcaggaagccgctcagtgagagaacctaatcctaggtcaccacaaacctagctgaggccccaggatggttatcccaggacaaggggatttagggctcaagttagacccatttgctgctttctggagacttaatatcagaaaccgatgaaactgatgggaaagacaagaaagagattattaaagcacctcctatatgtcaggcagggaacgaaacaccttttttcttataattatcaccactgccctgtaaagtatgggtattgtgatgcctattttacagttaagaaggccaagggccagacggttcaggtcatccacagttctcccctgtacactctgctgcctcttggtgaatccactggaggcttgtgccatggttgtggagctatttttggtatgcctctctccccactgtcctctgggagttggggcaaacaggtctctggggctgcccattccagtgccctgagttgcacccaggaggactttgtttgtggtccctggatgagaggcagtgccaccaagattcccagtagaggcctgcaaacaacctgtggggctgccttgaatgggcttgggagatgctgctagtggcaccccctgcattcctccaggaatgtcggcccgttcctggtgattagcctgtggggcctccctgagctttgatcttccattcctgtaagcggagaggcccagatggaaatggccgggtcaggtatccaagcagactacatgagctgtcaggactggaagtattagctcactggatgatcctgggcaaattatgcaacaagcaacaaaaacctctgtgccttgggtccttgaagacagatcctcctgggtaagctagagatgcttgctgtgggtcgaagtcatttccccaaattggggaactggaagaaggaacattgcccagaggctgagtcaccgcacaggattctagcagagcagaagttgcgggggccggcaggaagacagctggagagaagatgcccagtgctgatcccgcattggccccaggagctgggcttcagagagtctgagcttgtcaggatgccaagatgagcaagattcggcctatgtcctcagagagctcttggtctagctgggggactggccaacccaaacctaaggtcaaggtgatgggggagccttgagttaggagagcagaacgctggctggcaggggagtcaggggaacatcacaaagttagtggctttgaaggacggggcctgggtactacagcaatgaatcaaagacatcaacacatttgggggcttctgaaccctgctgcatgtgcattcaaaaagcaagacggggtacttctcccaggccccaagaaaggcttcgaatcctactctgccactgaatagccactctgtggccagcatgtggccattctgctcctcagtttccatatctgtaacatgaggataatattggaaacccatgtggctattgggaaaggccagctgtgaaagaaaattgtcaagtggcatattcaccctcctatccttttctctgatggacagggatgggctaccatccagtttaggcagtaagttctactggggatagttaggagtccgtcgggtttctgaaatggcttagaatagtaacccctctgcccccaccagcctatagcctggagactttttttttttttttttttgagacttggtctcactctgtcgcccaggctagagtacagtggcatgatcacggctcattgcagctatgacctcctgggctcaagtgatcctcccacctcagcccccgagtagctgggaccacaggtgcgtaccactatgccccgctaaattttttaaactacatttttagtagagacaaggtttcaccatgttttccaggctggtcttgaacacctggactcaaacgatctgcccacctcggcctcccaaagtgctgggattacaggtgtgagccaccgcacctggcctatccttttcaaagcatttttctcatctattatctcagagtaactctctaagggtaagtagggcaggtggctttgtttccatttttcaaaggaaacagttgagacctcagagcttgcttgtggccaggcttggatttgaaccaaggttcggcagattctttttttttttttttttttttttttgggatggagcctcgctctgtcgcccaggctggagtgcagtggtgcaatctcagcccactgcaagctccatgtccgtggttcacaccattctcttacctcagcctccccagtagctgggactacaggtggaggccaccacgccctgctaatttttttttgtattttttagtagagatggggtttcaccctgttagccaggatagtctcgatctcctgacctcgtgatccgcccgcctcggcctcccaaagtgctgggattacaggcgtgagccaccgcgcctggcctggtctgcagattctttaccccaagcttcacctgaagaagatcagtggttccccgagagtgggtcgtgcaaacatgtgctgggcggacacagcattgagtggcattgaatctcgtcatgagaagtttctttcctttcagttctctttcactccacattgggtcaaggggagaatctccatttggggctcctgtgctgttaacatctgtcagacgctggctgatgtcatttgtttgtttgaccaagagcaaatctgacccaggcttagaatcttgctagaacttgccttgctctcttgttgaacttcatggcattgtttcattgtatgtgtttttccggaatctcccgtctatacctaggaatgctggttttccatccactgtagcataggaaaatgtctttttgaaatacatgtttaagttttaaaaaataaagtcaacttaaataaacacactaagatgacactagtgtaggtgttactcaggttcattggttcacctggccggagggcttggggaatgcagagttaaacgaccccaagtgggactctgtctcttaggcacctagggtgccctctgcctcttgtctcctagggtgacaccagtggctcccaaattccaactgggaaaggagcctggaaaagcatcggcattcgtggtggctgctccccacaccaagtagaagaatccacgttgtcagagagctgctaacgtcaggcggtactggatttttgcaagccctctatttaaaattccccagaaattaaataaggaggctttggagggaggaatgccctagacaaattgtggagtgggtttgttttgtttatggagatggtctttaaagtctaaattgtccccgttttatttttgcccaattgaagaggggctgaactcagctgggagggaggggatggttgtcagcctacagcttttagttgaaaccaagtccattctggggccaagaagcttccatttttagcaaagagagaaaggggaaaaatatacaaactcgtacatgtacgcatcttaggcactggagtaagccagttaaatggataaggataatctttatatttcaagtgaccacagctctcttctccaggctgcaaatagatctattaagcaccaggcacatttctgggcactttccattcttttcttttcttttctttttctccccacaacactggtagtaaatacatgctgtttcatattcccatctcaccaatgagaacttaagcctcattcttcagtctcttccttcagccaatctgaaggaccaggcaccacactagtctgacgttggcttcctaaagctgtagtccacccaacaccatgatacaggggaggatcttaggtggcagagaggcaatatcaatccttctgcatcacacagtgggaaaagtttgtctcattgcagttctcttccaagccttctgacttatctcagtttgatgttcgatgatctttaacccctgtctagcaaatctgtgtagcaaagaaagagcgggccacaggctcagcctcttcatttgtggcacggttcaaatgtactacatagctttgttttcatcgtgtgtgcttttctggttggagccagtggtcctcgttgtttattcatggtggcaatctgaagtttccttagcaaatttctttcttgaagttaaaaaaaaaaaaaaaaggcaaattgctttaaatatacagtccatttccagacttatgatggtgtgacttacaatttttcagctttatgatgggtcattgggggtattaagtacattttgaacttgggatattgtcaacttaacgatggctttatcggaacgtaaccccactgtaagtcaaggcacatctgtatatgttatatgaaccacagtatatgtaattcaaggatatagcaaaggttgtgtgtggtgtggaaatacctgaggtttggggaaagcagattcagagtcactcttgcctggcaaagcccttgggtgagatctcgtgccagaacgctctttcagcctgggtgtccctgcctcgccctaccatgtgggcttagaggagaggcaacttggaggcaagcctgaaaaccacctctccatgaggagtgggaaaagccacaccctcgactcttccaagactcagggcttcgtagacaccagtggagtggaggagaagcagatgagggactgggtttcttggctcatctgtcagatgggaatttggggcataatagagcaggcatttggggcactaatagagcaggcattgctggtttccttctgcaagacaatgaacagctgagctggagtggttttaagggtcgctgaatgaatgctgtactgggtatgagacctgagtgccaatcctggcacctccccttagccacacactccttgggtaagtctcccattctgagtttcctaaggcagcctaagatttcacggacctggggacagacttctgccccaagacatactgaacacatggtcctcagaactcctttctcatcctcactgccaggagggggacctgcacaactcaggctgcctggaccctcccagcttgcacctaagattttggcgtcatggttgttaaaattgatattgcccttccatttgctccaaaaagtttgaacagtaaattttaagatcctcatactaagccatgtccttttgtctctccatttaagactttgcatcttgtcagatttgagctgtcattaccatctgttcagacctcttttttggctcctaatcctggcacagcttttgctaaatgagatcgtgctgccagtactgtgtctctgtcctcatcctgggttgattaaaacatccaacaggacaggttcccattggagccactccgtcctgctgggttgtgccagccctcgagctgtggatctgtcagtgcttccctgtagcccccagggccctgggggatcatgagggacacaagggcctggaggtctcagctgtgacacatcccgggcccaccagtccagtagctcactcactgccaggccccctttcttcctgttgcacccttctgaccgacactgcctgggtgagtgtgcagagccccttcccaggctctcccagcattccttagggagtccatgttttacttaaccacgaccagcatgaggctgcccttctctactctggaattcaccgccttcttctctaaaagctgggaccgttgcccattttgtgtccttgggtgttgctcccatctccatgtctcccacgattgctgatgatgactggagggctctttgtcaaatgctcttgggacccttctctgcggccagctggtgagagtgcattgaggcagcctgtccatgctgtccctacctctgcctggggtctacttaccctctggggatccgtgtgccaggctgagacccttccttctgagagcgaatgctgagctgcagacaggagcccaggagacccctcctccctgtgccacaccctcctcaggaaagagacttagctctttctttttttttttttaatttttttagatggagtcacgctctgtcacccaggctacagtgcagtggtgcgatcttggctcactgcaacctccacctcctgggtacaagcgattctcctgcttcagcctcccaagtggctgggattacaggcatgtgccactacacctggctaatttttgtatttttattacaaacggggtttcgccatgttggccagactggtctcgaactcctaacctcaggtgatccgcccgcctcggcctcccaaaatgctgggattacaggcgtgagccactgtgcctggccgacttagccctttcttactctttctcttgctggaacagcagggaaaacaccctttttgttcccctgagcatgtcctcagggctccacctctgagaatgtaagtgtcttgactggattcttagcaggccaccccttcccgccccactctccttccctgactgccactcttccatcatcttccatcgtcttgcctttgacagcaggtctctctcaccatccacatcatttacagttgtgacattagagtttaccttcttgcatcttccatctttcctgagcgcctcatgtttaggaatctgggcacaggctcacacctctgtgctctgcttaataatggcactgagagagggcaccagcttgaggtgagtgcctcattttctttttttcttttttttttttctttttcttttttttttttttttttaagacggagtctcgctctgtcgccaggctggagtgcagtggcacgatcttggctcactgcaacctccgcttcccaggttcaagcgattctcctgcctcagcctcccaagtagctgggactacaggcacacgccaccatgcccagctaacttttgtatttttaatagagacagggtttcaccatgttggtcaggatggtctcaatctcttgacctcgtgatccacctgcctcagcctcccaaagtgccaggattacaggcatgagccaccatgcccggccttgaatgcctcattttcatctggaataatcccctatgaagccattagagtgagcccatgcagcctgtcactctgaggttcaattcaagtctcttctcctctaagaattcttttctgcctagtcattctcatctctggatatctctggttccttggcaagcattgtatcacccaccgccatgtccactgcatggggctgtctgggtcgccctgccgcacccagcacaagcagtctcgtgccaagtccccctgcaagcagccgcccttctcatccatccactgctctgcagctcctggagaggcctcatgccatcttataatctccacctcaacctgtctccgacccccacccgtgccaggcacagaatcagacccacatgttttcagtagagaccttctgaggtcaagggtaaatgacactgacaccacgagggtctctctctccccctgaaactccagacacccaagacctacctgcttccctggccatccctggccccagtcacccaggcgcattgaggtcttggttccttctttagaatttcacttcatgtcagcgctttgcgacttgtgctcgtctgaaggcactattctgattccaatcaggcactattctgaaggcttttcaaggattagctcctctaatcctcgtaacaacactgagatgtgggtactttgggtcggttttgcagatgagaaaattgaggcaattgcccaaattcatgcagctggcaagtagcagagctgggcctcaatcccaggcagcctggctctggcgccctcgctggaaaccattctccgctacctgtcatttaaccatgtgtccctctctgcctgcgttgcttgttagtcaggcctccttctgggtgcctcacccatgaccttggtctgctcagacacaccagagccctgtgggcttggcggggacccagcctagcactggcttctgggcctgttcggtgaggtgggcaggctggagctgagtgggaaggtggcagcagcccaggctgtcttgacacggactccacggagccttccaaatggtgacgtagcagcctgtgctaatggtcttggaatccaggccccaggtgcccaggggaggttctgggtccctggtggcctcagagcccgtctaggggagggaaggccctgggcaacggagcagggtgggcacaggtaggacccgctgagtggctcatgaaggcaggggctgtgtgggtgcacgcaggagggactggaggagtttctcgctcgctcctgtttgctttggaccatggaggcgcgtgtcttggcaagagctgcagtgacagggctttctgaccaggggaggcctggccgagggtgggcagcctttcactggtcttaaaggcacagcactcgcagacagcctgcatttccagcttctctggttccacaaaggcagaagccttagctctgcctggaggtcatgggaaaggggtcaggctgggtccaggacagcagcactcacttgggcccagccttgtgctgggtgtggtatgggtaggtaggcagcgctggtgccatgcgcctggccaggatgccctcagccctttcttcctctcagtgtctccccacccgtcgccacttggagctcgcaaatgccctattcccttctccaaacccgcaccaagcaaagaacttggaatgcctaggaagatcacccttccaaagggtcaaggtctgagctcaggtttaaatcatgaatagaggtgctttgagaagcaggtcagggtgctggctgagggttctggaagtgggctgctgctgttcacccaccccgagcctatatgaggaggagtttgaggcagggcctgtcttcctcttttcctagctccaccatgcacccttccccacctggataccaaaacccttacataggcctgggcatggaatgagtgcagcccacattctgagctctgaattacctggtgttaagccagatgtgaaggaccaagagtaactcacggggaaggaaaacatgaagcctggaagtcatctaaagcctcctgggtttttccaaactccaagctctgagtctcatcctgccttgaaatcctctgggtttgtgcccagagcctgaagcccagccttctccagcaggcctcagggccagggcacaggcggcaatcgaaccccgcgtgtgccatgcctgggtgatgggggagtagagcatgagtcccggatgcgtgttgttcactgcagtgtcctcgtgcctggaacaggacctggcccgtaccaggtgctcgggaaatacttgctggtgaaaatctctgggtattgcatacaccatatgttcctgatgccactgggcatccccaggtacttagtattactctggtgtgccagtgaggctcagagagggccagtgacctatctcaggtcacgccaacagtgagtggtaaagctaggatcctaaccgaggtctgtctaggaagaagggattaagaagcatccttgggctcaatcctgggctgaacagggctgggaggtttgggagtcagagcgggaggacgagaggatttcagagggagaggaaggagtggggggtctcccctccccccaccagctgttttgtcctaggctgagctgtgacctcagaggacttaattaacatcctaattgtgtgcagctggcctgactctggccctaacgagctcattattctccctccttaaggaggccattgtggcctagtcaccctggggacagcagtggcctgggagtgcccgtcacttcctgccgccctcagtcaggctcccccattcctggagagtctaaggccctggtccctctcctggcctcttgctctgtctggctcactctttcatttccctctgtctctctgtgtatgtcaatctgtgcctcagtttccatctctactcttttttttttttttttcttaagatggagtctcgctctgtcacccaggctggagtgcagtggtacgatctcgactcactgcaagctccgcctctcaggttcatgccattctcctgcctcagcctcctgagtagctgggactacaggcgcccgccaccacgcccggctaatttttttgtattttcagtagagacggggtttcactatgttggccaggctggcctcaaattcctggcctcgtgatccgcctgcctcggcctcccaaagtgctgggattacaggcctgagccaccgcgcccagcttcatctctactctttccctccctcctctggtgtcagcatcagtcaatttgagagagatttgaaattggccaaacaggtggactctgctgggccggttcactgaagatgcttagcctggatagagggaggacctggtgcttgggccccagcttttccctcccggggctgggacatcctcccttccctgccctgagctggaagtgctggccagaaccccccatgttgctgcctcctctcctcagcccctgggtcattgcaaagtgggttgttacttaaggctcacagagcatggctggctgtaaatgccaggctacatgttcgttctttctgggcctctgccatctggaaagggctgggccctggcacacagacatggcccgatggaaggacaggccagggtgaggcagctttggggtattgtccagtttgggattctcctaaacaacttctccggtctaggggtttagccctgaaaaccagggctagagactccagaataaaggtttctgccacacaccgtgtgtacctggggtcctctctcagggttcctctaaaacaggctgcagtttcccattcaagggaatgagcatggtagcccctcccctggcccctgtctgggaggggtcatctcagcataagggcactccaggcaagaagacctgcctaagcaaggccctggcaggcatcaaacgccctggcgggtatcagagggcctgactgccaggctgggctgaagggtgcactaaggggtctcctagccagcccaggccccttgggagggtccccactatctcttgctgccaccaagctccctgccccacctcccaaaagatcctgcttcctttgtacctggaaaccagggttgacttctcagggaagaagccaggtgtggcagccagccagagaacagctgccccgaacctgggcacagatagggccactttctcagtccacttccttccatccttctgaaacccctgaaggtagccctaaaaccccagcttagagcagatgcataggcacacgcccacacacactcaaggcagtttccccagatgagtgagtgcctcctgatgccctcaggctgccctctgcttgtgcactgcacagatgccacctggccacccgtgggtgctgaccctctagtgattaacgaccaccgccatgtggataatagctcaacctaagctacctccctgcagtgtctcctttattcccctcaacaacctcaggaaatacgctccattcattcctgtcattacaaagagggtgactgagactcagaaaggtctagtaactttcctcaggtcacacagctaggaagcagcaagccaggacctgacttcgagtctttctgactgaatacccctaattacctctgttcccagaggaccctcagctgtacacattgacacccaggtacatgcaggctggcatctctcctcatggtgtgcacatacaagacacctgctcagagatgtgtccattctcaagtatctgtgtaaagtaccaatattcagggacatacattctcaaggagtcaccttatactcgtgcatgcaacagacctgtaccttatccgctgacagtggctaagaacctgggttctgcagctggactccctggttgtaaagcctagagtcctcatctgcaaagtgggatggatgatgacaagaacatttatttctcaagatcctcgaagtgtgaataaagtcatatatgtggagcaagtgcctaacacagaccgccctgctcagtgttcagctgtcaatgtgtgatacacacatgtgcagacacggcctcggtgctatgtgcatatcatgtccaagcacacagggcctttctccttggctccaaaggcctcctgatcccatatctgggtctcttctccactggaggcatcctctcctcttcttcattcttggggaagccttccatgtaagtcctgctcctttccttccccaggagccagggatcccggatggaggatgggtctgcactcacaggcagctggaagctcccgggggcggagcaggcctggcctccgctcctacctctgccacacaggcctcagcacacaaggagagctgggcaaaacttgctatggagccgaatgtacggcacaggggcccgctgggcagggcagcatgatggtctgtatctcagattgtgtgggtggcccagggatgtgcccagggttgtctctgagttcttcccatctcaacatctctgctgcaccagaagcttctatggtggctggaccacattaactgctgaccaggagctcctcaccctaagatatttaatagcaacttaggatcctattagaatcctattctcccgctgtgccgtcaagacttggagctgagtcttttttttttttttttttttttttttttgagacagaatcttgctccatcgcctagactggagtgctgtggcatgatctcggctcactgaaatctccacctcccgggttcaagcgattctcatgcctcagcctcccaagtagctgggattacaggcatccgccaccacacctggctaatttttttgtatttttagtagagacacagttttaccatgttggccaggctggtcttgaactcctgacctcaagtgatctgcctgcctcggccttccaaagtgctacagggattacagccgtgagccaccacgcccagcgtttttttgtttttgtttttgtttttcagacagagtctcactctgtcacccaggctggagtgcaatggcatggtcttggctcactgcaacctccggctcccgggctcaagtgattctcatgcctcagcctccccagtagctgggattacaggcatgggccactacacctggctaatttttgtatttttagtagagacagggtttcactgtgttggccaggctggtctcaaattcctggcctcaagcaatccgtctgcctggatcccaaagtgctgggattacaggcttgagccactgcacccagctggggctgagacttttatcctcaccagcctgggcttgccatgtcatctctagcatgtgcagagtggggctgtgtggcttcaggtctcaggtccttcctgtgtcagactctgtttttgttttttggttttttttggccggggggaggtttgttctttttgtttctgagacagagtctcgctctgtcgccaggctggagtgcagtggcatgatctcagctcaccgcaacctctacctccaggttcaagcgattctcctgcctcagcctctcgagttacttgggactacaggcacacatcaccatgcccagctaatttttgtatttttagtagagacggggtttcaccatgttggctgggctggtctcgatctcttgaccttgtgatctgcccaccttggcctcccaaagtgttgggattacaggtgtgagccaccgcgcccggcccaggctctgttgatgccaggggagatgacagctgcagagaagagcctgccactaccttggctatgggcactccactgagcaaagatagacaggctcaaataccacctaggtgggcacaggttaacatgagcagaggcgcccaccccgactctatgcagacctccaggaaccctggcgtgagtcacactgttgggcctcttggaaagattccctgcgctgaccccacccatggctgctgacaggcctctgccaggtgccagcagctcagacgtcaattgtggcaaccagggctcctgaccaaagtcactggtgcaccactgaggagcaagcaaaacctgaacccctggatgtggctcagctccccagaagggctcaggcatcagctagtgagccccgtggggcttccaggctcccctccaatgcatgcagaggcaccgttttctttcccacaggatctgagagtgcagtggtagagaggaagtgtgctgggggaggtgtggacaagggtatgtggttggttttttttttaggtggggtctcgctctgtcacctagactggagtgcagtggtatgatcacggctcactgcagcctcaacctcccgtgcccaagccatcctctcacctcaggctcataagtagcagggaccacagacacataccaccacctagggtggttagcgtgggaagtgtcaggatgagacatgggaaccagaaccgtgcgctattaacatttttttttaagagatgggatctcactatgctgcccaggctggtctggaactcctgggctcaagcagtcctcccaccttgacctcccaaagtgctgggattacaggcatgagccacccccacctgaccgctactgacattagaacctgcacctgcgaagccatgtgagagcctcagctttcaagagcctcctgtaagtgactccaagttgggaattgtggtgacagctctttgggattcttgggggttacatcctggtaagcagaaatttggggagtgaccacatgcccagaatggcttggtgggctccgtccttccctcctgaggtctgtggcagcaggtgcctggttgacttttgttcctcagatttggctcacgatgggggaccttcaatcatgatccttagtgattgttaggggtggcatcagcaaggactgtctctgttcaaatgattgaaacccagctccagatacagtagtccccccaaccatctgcagttttgctttctatggtttcagctacctgaggttaaccgtggtccgaaaatattacagtattttgagagagaaaaaccacattcacataacttttattacagcatattgttataattgttctattttattaattattgttaatctcctgtgcctaacttgtaaatttctatttattattaaatttataaattatttatttatttagaggcagtcttgccctgtcaccgaggctccagtgcagtggcacaatcatagctcactgcagccttaaactcctgggctcgactgatcctcccacctcagcctcccaagtagataggactacaggtgtgtgctactacacacggctaattttaaaatttttggtagagatagggtctcactttgttgcctaggctggtcttgaactcctggccttaaatgtataagttaaacttcttcataggcatgtatgtataggaaaaaaatgtatatataagggcttggtaccatctgcagtttcaggcatccactgggggtctcggaatgtataccatgtggataagggggattaccgtaaggtaaacggtgcaggaagttcgttaactcattgcagctaggaagtctaatgggatggcttagctttagcacatctggaaccaggagcccaaatgatggaaatcaggactgagtcactttccatctcctttttatctttttccttttttttttttttttttttaagagaagggagtaggggtcttgctatgttgtccaggctgaactggcctcaagtgacccaccttagcctcccaagcagctgacattacaggcacaagccagcgcttctggctctctatctcttgactctgctgctgctttattgacttaattctcaggcttctcaccccatatgccccctgcaattcctgagttttgtgggactcaggttttagatcatcaaagcacccacgtttgctcctaaaaaagcccctgagtggctttgcttggaaccatcaacagtgtccagagagatgacagactaatcaggagatgagtggccagatgtgcccacatctgtggtaaaggaggcagggtcacatgacatgcagcccagggagacaggaaagccctgctctgtgacctccagccagcatctgtgggagaacagctgggactggtgcttcctggcagaggctgctggggttcctgagagtactcccccagaagctcaagaagggggaaaaacatcccaggcagagccccttgcaaagtccatgccctctggctgttttggggcctccatcagccacagcttctgagcaaccaaaccatggtggcctgggcatcagggaggatggtggtgctgctccaggcagccctctcagtgctccatgctgggttcagaatgtgcaagtggctgtgggcaagatgagggtgacccccagccaccttcaggcaaaaggcaggggaattgacatgcaagcctcagtaatattttcccaacctgaatcaggcagagggaacgaaggcaggtatccactccaggcccagggcaatgaggcagctgaaatgctccctgcatccattgctgctcctcccctcctctccccagggggacaggcctaggccctttgcctctgctggatgtctctgtaaagggtagacagggaaaggttgttgggcattctcatggagacagagccctgggactccttgactagctagtgaaggttgggcttttcctgggtcaagggaagtagacagtgaaaccccttccaccatgtcaacaaatgggtcctactggctttcctcccaatagccgaatgtggaaggaatggcgcctcttgtttatccaaatgtcagaacagccaaggtgcaagtagaggtcaggtgggggctccctaggggccaaagtccacctcctccagcctgaccttggccccagtgtgggcatcccttgcccactgtagctagctctcaagggtactgcatgccccaagcatggtctggacccttcctgagttcccataattacaagccacctggaagcagtctcatcacccagaagttgagtgagtacagatatctggtgctctaataaccactgagccccagaggccagggaaatgatgataaattttagtggtgtgtccagaagtctctgacctgccagcggctgctgcccagtccccaactagtgggttccagcacctgcctgtcaccacgagctgctcagtgacttcagctattcgctcctaagaggtacctacctttttctgtgatccagagaactatccagcctgccgatgatgcccacctgccctcttccagcctcagaccaatgtccccagcgtaggaggtctcaggggtagagagtttacctgagaattggtgtgggtttctcaccctggagattgcctgcctatcctggtcccacacaggcagcagagtgtaggggttagaggccagcctgcttaggctccaatcaaggctctgcagcccctcagtgccacagtgtctcattcacctatgtacgtgtttatgaaataaacgtggcagtaagtggcccgggcacggacagtctgagaagtgggcaatctgggagacacagggtttggagcaagagcaggaggtacaggaattggaccagtggcattgcttcaccagcagtgggggcatatccccagttcttcctgactctgatggcttgtgactcactggcccaggcttccttttttcaggtgtgtatgggttgtgtcataagagaaggttgtggtctccagggttggcagagcctaggggagggagatgggcacagggagcaagagggcctgaccgggggttctccggaagtgatcctgttacctctcttctctcaccccaggcagagagggacagaatctgtgggctgtccaggcagcccacagggccctggatcatggtgcttgagccagtagctcagaggtaacccctctccagataggaggacaccgagaccgtaaaagggcagtgacccaactgaggcccctgagccacataggcctggacctcaagagtccagactcctggtccagggcatttcatgggctttgcagagctgcaagcagagggttgtggaactccccagaaagggtaggagacagagggcattcaggactagactgctggctgtttgcaagcccagacctgtcatgtggggcggtggggacctagttgaagacctgggagatgagctggggttctaagtccttgaggtcttcccgcgactgtgcagtggtacctggcggttttcccctcctctccgttgttttcacagcagccatcacagagccttctctacctcccagtgctgagcccacctggaggcacccgagagcctcctcccaccaacgtgccttctagatccttgggcggccacttgccgcggtggatggtgacggggcctccagtgctgcccggggagaagccttgagctctccagacaggaaatggagaactgggccatgagcagaaaagagaatcagtaccaaatcacttttgggggcaaagaagtgtcagggaagaagggatgaggaggaagacaggaccgtgtgaagaggaccttctcggaagggaccaaaggcagttagtggagtcccaagacctggggtgctcagaggactttgcatgaatgaacaaataagatgaatgaggctttatcacgtggccatgatcgtcaagcatcagctgaggatgcagtgcccacttaccgcgactgaaacgtgaacacacttaaagggcagctgtgagtggcaccaatgcgaaggtaccgctgacccgcgatggggaaaaggcaaccgttgaccgttagagactgtctgtgaggcacttagcttgaaagctgagaaggcagccaagctccaggcaaaccagtcatcctaatgggtttcaaagaccataaatggtctctctgtatggccggagctcccttggcctttcctgcaagatgaattttcacacactggacatatcactatgtctatttcattttccatcagacatttgttagtgtggctcacagtttattggtcccacttctcgggaagtgtgctggtcgtttctgccttagaacagacgcaggctcctcgaggctggagctgggccaggcatttgctgggtccccaggccatctggctccatgctccgcttcttgtgcctctccttccatccttgtcctggcccccgagccacccctgccaccctgcagaatctcacagtcctgttctctcttgtcctccctgcaggctggtggttcgtgagcacttctgaggagcagggctgggtccctgccacctacctggaggcccagaatggtactcgggatgactccgacatcaacacctctaagactggagaaggtgagggcttgcaggtccaaggggcagggagcaacgcggcctctggaggcagctctctcactctttccctagaaccaacagaacccctaaagtgagctgagccatatcctagcctcctcccttgggatcccatctcagtaaggttggcccaaaagctcacctcccaccccagtccgacccctgctgctctgtctcaggggctcaggaactgagggatggctcagacccctacacagtcagcctctctgattagctttggcttcatgaggtttgtttttccacccacccccctttttcttatttttttttatttttgtatttttttctagagacaggctttcaccatgttggccaggctggtctcaaactcctgggctcaagcgatccacatgccttggcctcccaaagtgctggaattacaggtgtgggccaccgcacccagcccttcctttttttttttttctttttctttttttttttttaattccaaacacttaaaaactactcagtgaggtttttcagggtctttctccttgcatttcaaagagtctgcccctgccctctaagccagcactggcctgggcctatctgtggcttctgtactccctagagcaggctgcctgagcccagtccgtttgcgccacccccagttcttggctgcctgctcctaatggcttccaagcctcccatggcctggctgcgggaattctttccctaacggttggtggggatggtccagatggatgtctgaaagccagagggattgaggccaccacccggtgctcgggccacctccaggcctgctttctgctgccaggccaaagtaagcagccgccaagtgccagctccttattcattcttcccctaaatgtcggttactcggcgggcagctggggcttcgcccttcctcctatgtcgaggctttacttcagccccttgaccagagcctcggcccctgccatgtgcttccactgtgtgacaggtttccagggacaaggccccattgggaagggcccgcatgttcaggctgggctgctccctgagccctggggctgagcctgcacctgtcttccctctggttccattgcacctctgcagcaggggagagtcttggcccctgagctaggtctggtctcatatgcctgcagtccccagcctcacctcctacctagttccacattctttttgttgttgttgttgaaacagagtcttgctctgtctcctaggctgaagtgcagtggcacaatgtcagctcactgcaacctctgccacctgggctcaagcaattctcatgtctcagcctcctgagtagctgggattacaggcacctaccactacgcctggctaatttttgtttttagtagagacggggtctcgccatgttggtcaggctggtcttgaactcctggccccaagcaatctgccacctcagcctcccaaagtgctgggattacaggcatgagccacagtgcccagcccctagttccacattctatagggcatgccagggcctctcaaaaacagcaggagctcacaaagtaccagatgctagaccaggtcctgaaatgcccttgcccccaccctgggaggaccctgtggctatggccatccccatccttccagctgtggcaactgaggcttcaagatgtttatcaggtttggaccctagtccacctcctttgtcccttggtcctttctgctgtgccacacacctctctgtgaagcattttgctcgtaagcagtacaggcagctctagggcagtgcgtgtatgaatcagagccccagttgaaaaggctgcaccaggaaggtcagagcggagctgttgggtcgattatggaggacctaggcactgagtggggagaaggccagggcaggaaagcgcacgagaggtgtggagcacagatgccagcctggttggaacagaaggcaggtgctttgcgcacagaacaagtagtagtgggttgggcaggattttgaccttgatggaggaagaatcaggcagccagtgcagattctgcgttcagaggcggtgtgggtgtatgtgtgtggggggtgggtgtgggtgtgtgtgcgcgtgcatgcgtgcccagggcgattctcctaaaataggttcctgcgcacgcctctgacagggcctgtgtgccaattctcctggcaacttctggatagctgtggattccaccgtcacatcttgggcatttcccacccagatctacagaagggctcagggatgggtcccctgggcctaaggccccagctgctgtggtgtgtccgctagtctctctgcacctgcagccacatggccaagagattggccgacactagttccctctccagccatctctaccccagcgctatggccatcccatcataggtgccctgagccctgtagacagaaattggaagcctgcatcctatcaaagctttcctaatagctcatcttcattactttaggaagaaaagatgattggctgttctggtgtgtccttatcatgagacactttgatgtatgttcatgctgctcttgaacccaggtgtgctgtgggagttcagtatggtaggaagggtgggagttgagacttccttgtccactgacagaggtgcgggtccaagcctgacattcgcagggtgcttcagtgaaccaggagaggtgtgttacctctgtcaagccctcgggttcatttgtgatagagccaagaccagaacccaagtctctgcctttgctcctgtgtcccacatctaccagtatggacctgcttcctccagagtgggcgcatattgggacatgcggaacagaccacggtcttctgtgctgctgtaccaaaggcgtgtaccccattagtgagcagatcccccagcacccagaccctgttccctccccacatccccttcttcccagggcttggcagcccaaggggcagcagagttaggggaacagcaatagctcggggtgcagagtctgtgctaagagtctaggctttggagccagactgcctggattcacatgctgcctgacacagagtgttctttaaagccctgtgcctctgtctccccatttgtaagatgccaaccacatagggcttttgtgaggcccaagtgagatgatctttgtacatggtttaaactgggcctcgcacacagagtaaatgccgacatcaacaccttactgtgaaagctgcctctggtctggccatgagctgaaccccttcatctctgcagagaagccctacacacctcccccacctctccctgccccaccaggaggccttgcacaggacctgattcatgtttcccagagcccattcagccccttgtctaggctcatgccagggcaggtggtgtcactgtaagacagatgaggaaagagaggcttagagatgggtggctggcctcctagagtgacacaggttgctggcagtggggcctggactggagtccacacctcctacccttttgtccttataagaagcaggtcagacaggtccctcttcttccaggaaagcaaatgctttcccagggcctcggtggtctgggacggttttattttcactccagccactggcccctctcccacccccagacccgggcagcctggcaccttctttctgtggtggcaggaagtgaggccagctggcaccctggagccctggtccagtatccattccatctgggagtctcacaggaagacagaggcatctggagctggggtctgagcagagggtgcagggggctcagagccaagcagcagccaccagaggagcagtgcaggatgctgctcagggcacggggtcaggagcagtgagaagctggggagggggcccctgtcatcagatgtcccgatgggtggcctgagaggaggagcagagccagggcctctggcacccacccttgtgtcattccgttcagcaggtgcttcctgggacccagctgtgtgcccggccctgtgctaggccctgggaatgcagagacacagggaagggttcccagaatggcgagagctctcagccccgcaaggaagggatccaagtctctcttgggcacactgattcttccaagcatggtgcctgtccaaggtagcacgttcacagtcagtactcagtgagcgagtggacataagctcagatgttgcaggaccccacaccctcctgggaatcagcaccgcccagcagtgagggacactgatctcaccatccctggaggctgtagctgaggggctgtcttgcactgggctggagctagggaccctcttttctctaaggtgctgggattctaaaggctttagcccactcctaggctcaggggcacacgctgtggagtttggttgaatttttccctgtgtgccgaccatgacctgtcatatctgccccatccaacaggggcgtgccctttggttcagtccaggtgatggtgactggaagtgtgggcctcccctccctgtgccccttcctcccacccccatcccatctcatcctcatctccattctctccgccggttgctgttggccgcatgctccatcgccatctcccacaccagtgtccaagagacgcaaggcccatctgcggcgcctggatcgccggtggaccctgggcgggatggtcaacaggcagcacagccgaggtgactgcgggagctggcttctcctccctcgcagcgaccgcctgtctctcgctaacactgctctttctttccgggctctgctctctgccctgtggcctccttgttcacccagattcacgggccaggctttcttctcacctactgcagctggtgtggggtgggcctgcttgggaatcagggtggcactgggggtggctctggctttgtcaacctcctgggtatgagggtcatggaacacagttgtgggttccctgaaaaggtacaggggcttgaggagggggacaagggggtttcgggtctttaagaaaggccacattggccctggaagctgcagattaaaggagctaagcgtgtctagccctctgctggggccatcccactcccccatcctccatggcccctgtcctctgagaaaatgctccctcggccaaagttgttctatcagtttcttgggaacaaagcagaaagaaggactggctcacattcacgctcctcctgccagctccacggaaactagaaagggagcaaagccagacccagcctggcatcagggtgcagcccaacaggctctgctgagggtcaggtccagccaggagcagtaactgctggggcttcaggaggggcctgatccaggggagtccagggagccccccaggcccagcacatgggctgatcagatgtttgtgggtttagagctttctcgcccaggatctttctagcatccaggaacctgggaggtaagggagtggaacaaagccccagggctgggctgctgaacaaacccttaaacatctgcagtcccctgggccagggcttggccagccccgcatggagcagggtgtgtgtgcttctcacagtgacggcacagagagaggtgtatcataaacactggcctttctggaagcggggacacccagtgacccccaccctcacagcttggttctaaatgactgtaagagcatgttttggtgtctgccccaggcccaaagcagcaggaagcctggacacaggtggctacagcctatggctggctcagcatcaggcacagagcactggccatgagaagtccagcttgtcctgagggcacagcctgggctggaccctgtgggctgacacagggctgggggtcaagttgtagaaacagcaagaacaggctggacatagagcaatggccaccctaaagctgggacgcagctcaagccttggcggcaaaggagagtgggacgtaagtctggaaatgcatggcacggatgaaggtttggctccaaacacccttgcacactgagccccaaacacgaccatctccacaaccccacagacatgcacagccctcatggccacagatacgactgtgcgccctgtcacatccagcctccctgacacccacatatccacagtcccaggcacacagccactcacaatacacatacacaattccaattatgcagccacgcatacaccgtgccatgtgtcttctgtttataccaccacaaatgcatcatacacagtcacaaaatcatcacacacacacatatacgcaacatacacacatacgccacccattcctccacagcaacactcacaagggcacatacagcttcatacacacaacgccttgcaccacatatatgccagtcacagacatacagtgatatgtggagacacaaatacgcaatgaaatgcctaattcttggtcacccatacctaagcaaatataagcccccagctcttgctctctctctctctctctcttaaataagagacctaaacaacataatgtcccagcctcagcctgatgggctaagttaaaccaggcagccaagaaaaacttgcagagagttggcttggagacgcttgctgcaaacagcagagctggtcggggaggcaggctgcaggttgtggaggagctagacaagagaaaagcggagcttccccacggcctccgctccccgttccctcagccagccaggcccttggaaccaaaaggcctctctcagtggggttgggtaagtcgtgggggcaggaagggagtggggagactgctgacagaggggaaagtgttggggaagaggaggcttctgtggtttggaaactacaggacatccagcccctgcctccaaaaccaaagcaggcctatccccctcacccacccggctgaccgcctggccagccctccccagggcaggctgccaccgtctcctggtggcgtggtcagtgttcacggccccagtgcttcccagaagcccggaggatcccactggagctcacagcctcccttccctcaaccccatttccgacgggacatctcttcccaagaccctgaccaccctgaatcatgcagctgcccgctgaggccatgtccgtctgtctgggcctcctcttgtctggcgcccccagatggggtttgtggcccaggcaagtctctcttccttgggacacctgtgagttggaaggcctgagacccacaaggcctgtgtccacatggaaagtccatgcctctgccatctgagccaactgggtggaaacccaggagctgggacggcctggtctgcctgcctagccctgccagggaggagggctctgggttctcatccctgcaacctgtgcagtgaccggggcaggacgagcctcccatccaggagctctcaccagcagcacgtgaactcctggacatctgtggttgctgcagccccagagtccccaagaaccttttgcaggagcagctcaactttaccggccagaactgatatccctggttctgcccccacccccaagaggtcaggagaaagcctgagcttacatggcccacgggattctgtcttccacgcaccccgggaggctgcgaaggctggggctgggccctagtggcccaggaggctgagcccacatgatgggctagaccttgttctctgccatgaagcagggcagggctcctctgatcttcccacgagaagggctgtcatttttccctgcaaatgcaaccttgcctaggaaaaccttaatgatggcttcctgctcgaaccacagacttttaaaaatagcccagctgaacaaaggcaaaatgtggagcccaggcctcgcctcatcctaacctcagaatcctggattcccggagcctggcgctgcccctctggccgccgctgagctgggatttgccatgcctcactggaaaatggagcagaaccaggagcaggcaggagagcagagagagttggactgtggagccctgaacttctcaaagggccgagtcagaatctggctgggcagggttctcaggccgccttggcagcagtctgaagcatggctgggttggaatctgaaagcctccagagtaaggccctccctgagtcgatgctgaccaagttctgcagcagagaagggcgtactgaaaaatcctgcaggctcccatgggtcatcaccctccttctgcttttgggcagccgtttgaatttggctagtagcccatcagttctgtcttcacagcctggcagggcagccacaaccacccccaaagggagctgctatctcggctcagcacagggctgcagacagggccccgataatccaggggagagtggacagatggccctcccacagctgggggttggggtggcagctgcctcccacccccacggccaccagtcttaggcaggctgcccgccagcatccagccaaggagcccagggggtggctgtcacagctgggagccaggaggggtgggtgtcccagagaccagaggccagcagtctgctccagcatcccgctgttttgagctcacagcacttcccatcggtacccttgctcagccttgcctggtcgtgatgcagtcaacagtgtctcgctgtctgccaggcactgtctcagcccctggggagcacccacgccagagaggacaacagtggctcagggtgacccttcagaagggcatggccagattgccacttcctcctcctgtctcagctcctgttgccccagaaggtgaggtggggagtgttccactctgagcagccctctacggagtgtctcaggcaggaggcaaggactctttagccagccagctaggagcagagccagggagtactcagctctggggtctacctatcaggggcttcctgggacagggaaagctgaaccccagcaggcatggaagaaacaccctcctggaagcctgatcaaggacccaagcgggtggcacccaggcctcctgccaggagagaggctgaaagaaaccaggggaggcaccatggtgccccactctccccacacctgccctcccaagccttcctgagagtctacaaggcacttctttcccagcacctcgggaggaccttgggcaagaccctgaagtgacatccttgaaaacagagcaggctgccctccagaggggctaggcctcggctgcgtggttggcacagcatgttctgcagaagccacttgggccagtgctgcctgattgtgctgtgcttggtgtttccaagctcatttggccatcgaacccttgtcttaacaaaacacatgtaactgcttccatgagacctgggttccatggactcctcttgggagattacatgaccaggtgttaatggatgaagtgggtgctcagggaaggcttcaccgaggaggtgtccctagaacctctgaaggtcagacagaggaaggatgcaagaggctgagctgggggcagggataggagagttcatctgggacacagatggaaacagggcacatttcgaggaaaagcggtatgccgtggggcctcaaggcatgcaaggacacctcatgaggggccggcttctcctaatcctgccctcggcccagcaagcttctgagccctgtggactccaaggtcccggcagcctggccgccattatcaggctgggagagccgactccctgctcccagggccttgcctgacaacctgggtcctggctggctttggcacacactgggagcagcagtgacctctgctcccatggtctccctgctgccacctctggggcctggtccttccctcccctggagaagccagagccaacccagtggaccttcttggcaagcagttgagcaaaagccaggccagggcaggaggaggggacaggaagcaggacctgcaccccgacctcaaataatcttgcttgcttgctcccacccccagaggagaagtatgtcaccgtgcagccttacaccagccaaagcaaggacgagattggctttgagaagggcgtcacagtggaggtgatccggaagaatctggaaggctggtggtatatcaggtagggaacccttacattatgaacgagatgcctctcgcccacctgggccctgggcagagtgcaaagtggccatggccacctgatggcaggtagatactgacagctttgtgcccacggcacagggctgggctgctgcacctctgcacagctgaatagctcaaccagagaatgctcatcttgcaagttttctcccgggacgcgtaaagcagagcttgagccacagccagcggggcacagaggccccgggtcagcttgcaggctgtggtgcaatcccttcccacgtatctgccaagagagctcagcacatctgaatttggttttgtgtgtccggccttggctgcctggtgtgctccacagctagggctgcctggagcactggcgtccgcaggccttgctgaggtcccagcaggcaacctctgctgcccaggctcagtactcagggaggtgggctgggggcgggggcgggtgcaggtgcaggcctcttgcagccacgtccctggtggatggggactggctgtccaatctgcagggctggctgcaagggctggagcagaagtcaggcctcggctcaggccatcggaggcttcttccttctcttgcccctccctctcccaggcctaatcacagttcccagcgtagaatcctattgaatggtatgggtagggaagtggggtctttcctgacctgctggaggcaaacaatcccgtgggtttcactcaccattacctggccaagacctacccttccaggacccctgctctcaagaaatgctccaggagacttgatctcagtaagtgcttttggtgtccttggaactggctcagctgtgatgactttgcccaccttctctcttctctgccagttacccagctgacagggatagtcctatatccttgggctctggggaccccagatccactgtgggcaggacatgcattctaggtggtctccgacagaggggacaggattgtgcagtggcaccaatgtgccccaggggatgtgagtactcgtgggacagttgctcagaacatggtacaacatgatggcattaaaggctagtccatgctgaggtcactggccatatggagattgcaccttagtctgacctgatggaacatggctccatggcacgcaccacaccccccgcccctaccccgcccccaccccgccccaccccggagccctggtgcatatcagtcaggagggctgagatgtccctttctgtcccattgggtgggatgggactgtgcatctggatgtgtattgtccaaagccagtgcccctagacttttatgttctctgagcaatggaaactagagtcaacccaatcacccaccagccatgagttgaacatgggaaagccaggaaacattctggcaggctggtggcctagctcacttgcctggagcttatctacaaggctgctttattattatttttttgttttctaaaatgaccaacaaagtcactctgagctgcttctagtccgctcctatccccatggcctagtcttacagccagcaggagcttggactgagaaaacccggctgaaaagattccaccttaaaaaggctgccagacacccccttaaatatgccatttcccaacattccaggctctacgttgatcctcatttcctgtctttcttctcctcccccaacccctacacacacacacacacacacacacacacacacacacacacacacacaccctcgcactctccatcgcgccctttccagcttgcttcccgctggagtcatttcattctccattgctggaaagcagatgtgagcagagctggacccagacacacacaggcactcctgattcccttgcgtttctcctcctggaatcttaattttacccatgtagtgctgaaggaacacaaatacagcactcggggccctaagcaggcctgaccgtcacctccatgagccccctctccccatagctctacagtgtccatgtagaaaaatcgtcagtgagggccagtgggctcatctttgtcttttctctgagatgcaagagcaccaggctctgggccagatgctgctaagcgctcactgtgtgacccccttgcttttctgagccgtagttgttggctcacataagattaggtatttttactcgttgcttccatccacccttaaaattctgtgcttctgtttgcacccattgcatcagggagccaaagacaggcccctgactcccacccacgtgttaactcacctctgcctcccaatccctggggaggcgagcttggctcagcctgcctgcatgtttctgtgacagaacgtaaggagccacctcctacctgagctttctcgcaaagctcagacatgttgataggaacttcagctttcatattccttttctcccacctaatgagcgcccaagaacaaggtcagatcaggaagacggtgggcggggcggggggggaggtgttcagacatctggtgtggaggagccattccaaagagccagatgtgtccagggagcagatggggacattgcaacccagacttgggggcactggccagcgactactggaccaggaagtgaagtccccatgggtttgggtgaaaactcaacaccacgaggaaaaaaggaaaagcttgttttcagaagtcatcgaatcaccagaaattaagtcagccctatcatttgccttttgcctttgtttatgagcttttggttttgtttccttttgttttgttttgtttttgttttgctttggttttagttttatctagtcatgtgcttttgtcttttcacttatggtttctgcttttggagccccacttagattttctcaacccccaacattatgtcaatcttctatttgttaattctgctatatggtataaagccagtgtctgtcttacttgtttttcctaactgggtcatcagttttccccaaatcactttttacatttttggaggcagggtctcactctgtctcccagagtggagtgcagtggtatgatcatagctcactgcagcttcaaacttctgggctcaagcaatcctcccacctcagcctcccaagcacctgggactacaggtatgcaccatcacacccagctaattaaaaaaaaaaaaaatttttttttggtagagatgagatcttgctatgtagcccaggctggccttaaacgatcctcctgcctcagcttcccaaagtgctgtaatgacaggtgtaagccacctcgcccagccccaaatcacttattgaataatgcatctttgttccactacagtaaatttagcctggtttgtgaacttggtctgtgacagtctatagaggatccacctactctccctgcagtggcaccacagctgtcccattcagtcatctggcatggaggagccattccagctaagatgttggagacagcttagttgatctcaacatgtctgtccttctgggtacatttttagcagcgactctatccctgcatcttgcaaaagagacacaaactgagctccagggaagggacttgtgcaaggtaccacagactagaactcagactgcctgactctcaccttctggagtcaattccctctctaataatacctccccttcctacaggccatttacctctacataccacatccacaccttcttcttatctctctaattatcctcaactgactgggaagtagcaggccattatgaagtcctcctttgggcaacccaaaagttgataaatctgatcccaagctcccacatttgcctgactttgcagaacatgagagcccaccccaagagggatcaggcaaagaaaaaggagcatggtgggggggcagtgggaattggtgttctgggtgtcttttccatctaccctcggtgccatttctctccagagtagtgggattgccaagccttgcagaacatggtagggaaggctccactgggcaaggccagatggatcctagggcctgggagtgggctgtgaggtcagagtgctctaatgatagcacatcctgctcctccccacagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagtaagagcctcgctgacctctaggtcctcactgcaaagctccttagagaatgggcatgggtgccgtgaaagccaggggggtgcacaggacccccatggcgttttcctcctgggctacagactggcctttgaccctcactctgtcaacttgtgtcatgctcatcacaggagtggagaaggcagaggagtatgatgactcaactgctcccagctgctccacggaagctagatcacatgaggatgtgggtggtagcgttccctcctctagtggagagccagcaatggtcactctgcagatacacgcgttccaagagcaagaaatgttttcttttccttatggtaaaggctttataaatcaagatagatgatgtgtagctgacttttaaaaaatcaaaaaaacacatttccctgggctgttgaatgtgggtgctatatgcagggctgccctatggagtgacagtctgtagagaaacgtctttctgggccttagcagctccttccctatgactttccactcgttactggaaacctaagagacttgggagctaaggctttaccactctacacaggcagtttcaacagggcgttcttcaagaatcatcttcatttctacaggagactccaggcagtctggcaccctccatctctggcccaataatgccttttgttgaggcttaaaacttccatgttataggaacctagcttttgtttgtgtccagccattcttaaaatctggaggaaagctgtttctttagtttagctccactgggttaagttagctctcgtgcctgaaatcttttagggaaccagctgggaaacagttattgggcacctcctcttgcctggcattatgctagcttctatggatttaatagtaagcaaaaaacagacatggtctctgctcctaactttgaaaacctgataaatctatacacccgttaccctgaaaaatgcccacatagctgcacattttgaaaagtgcacataattttagagtgttcatagatcccctggaagcacagccaaggtaaaggtctatagtttccccttgaaaaagcccaaccacagtgcccatagtgacttagagtgtcaagtccttcataaaggctgagctaaagcatgaacttgaaggatcaggagttagtttcacctagggaaggcaggtatgggtactgttgcccatcgtctgactaggatttctgaagccatgtctcttcctctaggctccccgaacctacggacaagacctccaccacgcagagaatccagcctggtatgtgtactgaatttcttctcccctttccttccttttctgtgaatgcgctatagccacccgatcaattggctatcttgcggcagagcctcttgatccaggggttttccagagccctgctggggcttctagttttgtggggctaggggcagggagggaagcctgcagatcccagccttcctggaggcctggctggacagtttataatcggaaacacactgcactccaaagctaaataaatccatcccagccactgcattggcagacataaacatttagactgcccggcaaaagtgtccagccagggcattgccagaggctggaaatggggctcctgtccatgctagcctggaagcctttcagctttccctggtcaggaatgcccagtggaggtggtggatggcagagtctgggagggcagagggcagatcagtgaacgtcttccagggaggagtgtgagttgcaaggagtggctcacgccccagctttaagaggttaacactgccagggtccctggttcatgtgggtggggtttcctggtgtccagaccctcgggcaggtagatacgcatcaggggccagggcttggggtgcctgcgatgctggtggcaggctgagagccttggaacaaagaactgttagtaagcgcagtgggatgtagtggaaagagtgtgtcttcaagtgccaggcatggattcggattccacttctgacacttagaggcggagagactgtaggtaagccagttgccctctacaagcttcagtgcccttatttatcagacgggacagtactagccatctcttagggctgttgtaaggatgaaatgagatgatttatgtggggggctagcaaacaggtttccatttcctatgtcagctcttgcctgcttggtaatactacctggtgcactgggttaaggaggattctgaagtcacatctgggcttagcaacaagagttactgtggtcagtgacatcagccctggctaagggagatggcaccagtctatggaagagtaggccctccataaaaatatggtttttaaagatttcatccctggagatgagaccttccttgccttggccatggaccccagtggagtttctctttttcctcctgagttttacacacccaaacactgaattctccctctcaaccatctctcctagccacggctaattattttcaggcagacttgattttggcaagaatggggtaattccttccacacttaccaaatgtggggattgctgaggcagggctgctgtttccagttaggcccagctgcatcccacctggccagagatgtggcctgggctgagcctgggctgtgtctgctcacatgcacggctgcacagccaggccctggggccaggaaaggtggcagattctcactcaatccctcaaaaccagcttcctcccacccctcactcactctgcctcagctcagtttcaactggtggggttaggacatgcagagccttgaaggatgaggaaggctgggaagaagagaagttcagaaggagtgctgagttccagcttctatttattgagctctccctatgcccctcgctgggcccaaagtgatgtatgttatctcagggatcctcttcaggatgctggtattagttccattttacagatgagagaactgaagttcagagacgtcaagggctttgcccagggccacacagctggtaaattgctatgattggagtccagccccaaggttgaggtctttccaggtcttcctgctacaccaagcttcttcccgtcccctcatccctcccacctttttttcccaattgctttatttgaacccctttgcatgagggaggacataaatagcggggtacaaagtccattttagctgagtagagacaagaccattgaagcaaaaatatacaatccacaagggcagggggttgtccatttggtttcctactgggcgctcggtgccttagaccagtgtctggcacccagtagacacacaacaaacagttgttaaatgaatgggtgaggctcacaaaccatgggccaaagccagcttctaaatgtccttgaatgtcatgcttagatgctgctgtgccagtttctgaaaagcattgaggatctccaatgagttctaccctgcccacagaatattgcgagtttatttagtgcttgcctgcctatctggccttgtcatgatgaccagccaaagactttgctcactcaaccgcactgccttcttacacacacaccccagactagagaccactgtgctccattgccttgcctgtgctgtcagaagtcccacctgcagccctcacccctagactccaggacagtggctttccttcctctcccacagggcagtgtgcaagtgctttgttagaatgatttctctgctttttctttctttctttttttttttttttttcagagacagagtctcactctgtcagttgggctggagtgcagtggtctgttcatagctcactgcagcctcgaactcctgggctcacgctattttcctgcctcagactcccaagtagctgggaccacaggtgcataacaccatgtccacctaatttttgtgtgtgtgtgtgtatgtgtgtgtggtagaaatggggtctcactatttgcccaggctgatctcaaactcctggcctcaagcagtcctcccacctgggcttcccaaagcactacgattacaggagatttctctgctttttaattttcattttgagattcagctattgaggcatctgaaaactagacctccagagatgtaagattagaaattactgcattaataatgagcattttgtgctgggcacagtggcttatgcctgtaattccagcactttgggaggctgaggcaggaggattgcttgagcccaggagtttgagaccaggcaaaaccctgtctctagtttttttctcttttttttttttttttaaagaatagaataatttaattaaaatgtgcaatattttgatgaagaaaaatcacaaaaatgaattgaaggcctggcagaatggaaataaggtacatttatggatgagaagactcggtattattcaattttatccctaatctgtaaattcgatgaaattctaatttaaatcccaacacaatttttcttttttttttttttttttttcttgacatggaatggtgtctttatttttgggggctgctgtaacaaagtaccacacactgggtggcttaacagcagaaacgtgttgtctcccagttctaggggcgaggagatcagggtgccgacagggcctcgttccctgggaaggcgtgggaggaggacctgttccccgcctctctcccggcttccgggactccggaagcctgactccaggcttcacgtggtgttctccctgctggtgggtctgcctctgtcctgtgttcttttttttttttttttttttaaattgatcattcttgggtgtttctcgcagagggggatttggcagggtcataggacaatagtggagggaaggtcagcagacaaacaagtgaacaaaggtctctggtttttctaggcagaggaccccgaggccttccgcagtgtttgtgtccctgggtacttgagattagggagtggtgatgactcttaacgagcatgctgccttcaagcatctgtttaacaaagcacatcttgcaccgacctcaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacgcggcaaccatccgatttctcaatcttttccccacctttcccccctttctattccacaaaaccgccattgtcatcatggcccgttctcaatgagctgttgggtacacctcccagacggggtggtggccgggcagaggggctcctcactgcccagtaggggcggccgggcagaggcgcccctcacctcccggacggggcggctggccgggcagggggctgacccccccacctccctcccggacggggcggctggccgggcagaggggctcctcacctcccagtaggggcggctgggcagaggcgcccctcacctcccggacagggcggctggcctggcgggggctgacccccacctccctcccggacggggtggctgctgggcggagacgctcctcacttcccagacggggcagctgccggtcggaggggctcctcacttctcagacggggcggctgccgggcggaggggctcctcacttctcagacggggcggttgccaggcggagagtctcctcacttcccagacggggcggctgggcagagaggctcctcacctcccagacggggtcgcggccggggagaggcgctcctcacatcccagacggggcggcagggcagaggcactccccacatctcagacgatgggcggctgggcagagacgctcctcacttcctagatgggatggcggccgggaagaggcgctcctcacttcctagatgggatggcggccgggcagagacgctcctcactttccagactgagcagccaggcagaggggctcctcacatcccagacgatgggcggccaggcagagacgctcctcacttcccagacggggtggcggccgggcagaggctgcactctccgcactttgggaggccaaggcaggcggctgggaggtggaggttgtagggagccgagatcacgccgctgcactccagcctgggcaccattgagcactgagtgaacgagactccgtctgcaatcccggcacctcgggaggccgaggctggcggatcactcgcggttaggagctggagaccagcccggccaacacagcgaaaccccgtctccaccaaaaaaacacgaaaaccagtcaggcatggcggcgcgcgcctgcaatcgcaggcactcggcaggctgaggcaggagaatcaggcagggaggttgcagtgagcagagatggcagcagtacagtccagcttcggctcggcatccgagggagaccgtggaaagagagggagagggagaccgtggggagagggagagggaaggggagggggagggggagagctttttttttttttttttttttttttttagcaaattcttccagatcctgagagagcccatctctaccaaaaaaaaaaaaaaaaattaaccaggtgtggtggtgtgtgcctgtagtcccagctactggggaggctgaagtgggaggatcacttgagcccaggagatggaggctgcagtgagctctgattactccactgcactctagcctgggtcccaaagcaagaccctatctcagagtaatgatgatgatgatgatgatgatgatgatgatgatgatgatgatagtaatagtaatgtgagaattttgatagctcagacaagtcttccgtgagtcctgagtattattagaaagcctcatcagagtagtcccctggcgatatataccctgagactcccatgatagatacgtactcaggccagctgctgtccagctggtgtaaacggccatccgcaccccctggggactgagtggggaccaacccttggccaagttactcttctgatttaggcgggttttgcccactgtgtgttccttaaccttaggggttccaactgccaaagccaccagagcccccttctgttgaggtggagtactacaccattgccgaattccagtcgtgcatttccgatggcatcagctttcggggtggacagaaggcagaggtaagccttgggccatgaggccgagggttttaactcattgtggtggaaaacctactgcatttcccattttaggccttgctagtaagattcctgaggggcaggcaggcaggaaaggtacagaaatgagccccacaaagatgagcatctgcctggcgctggccagtgccatggcctaaactagatcccagctctcacgctccaccctgagctcacagggcttgtctcacaacatttcccagagcatgtgcaggagcttgtgacaggggggccttgaaacaaagggcttctttggtcaaatgagcttgcaggacagtggattaaacaaaatccaacccatttgttgttttaattgcagggcttcccagagcctaggatacaaggatgtcactgggagtgtcacctacaaggggtctagaatagacagcattgcccaaccccacaagctttctctcccaggaacatctcagggccaggatcctgcagaagccacatcaggaagtgttgttaggaggatgtggaccaggcaggtagactgagatactggggacctgggctctggccaagtccacaccacatgacccctggcctttgatgcagtcacttctctcacccgccacccccaactttaagcatttctctctgcaaaacagggtgatagatcctgggacgcccctccaccccccagcatgtcttccagcattcatgccactctattttgtggctggggctgagcatggtattcccggcagcagagaagagctgtaacttagtcaattctctgagtggctttgtgtagtaattgagttaactccatctaatacaagtgaacctgtcagactcattgggcagtctctgcctctaaagcagtgacattcccaatgtgaatgttttaaatcacatgcctggaacttgcaactaaatttccaagaaaaatcattctctctgtactgaggtttccaggagagtctgtaaagagcataatgtggcagaactgtcaggctcaggagccacctgtgcttgaactgtaggtacagggctggggcagggtgaaggacagaatgtaggacccaaagaaggagaaaatctttctcttctagtgggggatgcagaggactggtctcttcttgcctttgcattcttcacctttccctccctccttggccctcttcccatagtgccagtgttttcacgctaccccttccccaccccaggaccttttcctccaggagtgtcccacaatccccagttatctgccctttatgttccccagtccaaatggaccccagcacaaccagcagccacacttttggccattggttgatctccagaagttaaggaagaagctccttaaaccagtttatactaacatggaaatgactgaaagccccctgcccttcctacaggaaaccaatcaacccaaagaaatctcttcagctagtgggatttcagtgggattccagtaagatgaccacagcgggtggatcctggggaaaggctctgcagagaggctctggcctcgggcctgtacctcccaggtcacttcatctgcatcttcccatactcttctgaccctagagaccctttcaaggaactcaaagggaggacctagcaacatcgagggtacgaggagggaaggggcagcagaagggcagtgttttcttcatacgtgtccttagtctactggcaggattgtagggactgggaacagtgcagtttagggggaggcagagtgggccagctcaacccggctgttaacacagacatggaggatcagggagggaacttggcaagtgggaacccaccaaccatgagatgatagagacctaggtttgaattctggtgcattatttactatattgggttttgggccacttactcagtggctcggtttattatctgtaaaatggagataatttatcccagagccaaagtatgatactcctaccttgggatgtcatagggttccagatcctcccaactcactggcttgtctgcactcgtaccccaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaacggaatcacctcttaattctccctgtcaccaaaaacacccatccagctgaacagccaatgtcccattatcccaaattgcaaagtggacttcaggatcccagggccctctgaaagaaaggacactggagggtgggggcaggtaggtaagctctcgcttttttttttttttttaacagggtctcaccctgtcacccaggctggagtgcagtagcatgatcataggtcactgcaacctcgacctcccttactcaagcgatcctcccacctcagcctcctgagtagttgggactacaggcgcaccaccatgcccagatgatttttctattatttgtagagacaggttcttgctatgttgccaaggctggtctcaagctcctgggctcaagcaatcctcctgcctcagcctcccaaagtctgggattacagacatgagccagctctcactcttggtgagagctgtggtcaagctcctccagcctcttccccacttttgggaggctttctgggcagtggccaaggctttgaaagatgcagatcttggggccaaggacccacatccagcaggcctagctggctccttagcatggccccccgaccctctcctgcttttgctggaccccagtaagcaggaccaggtaaccctgatgcaaggaacaggccatggctgtgcaaggccatgcagaggctgggtagcctgagcatcctccctggaacaggatgggcaggcaggtatcccatgtgcctctgaggcctggtgctgccaaatgagctcaattccaacactgtgcctagaccttggggccagtctggctgcctcctccccaccacccctctcccctcagccttccccaccactcggatcacttagcgcatctagaacacttctctaaaggactctatccagaggcttcccttttctcctcagtggcaccacccatttggtataggcctctgcacccaccagtgggaacacagctgaactccctccagatgtgggggtctgagcctggggagaggggtggaagccttgttcctggggagctcagagcacagcccctgatgacctgagttgaccacttgtcatcctcccattagccccctaggtggcactgcgcacccccctacaagcggcagatttgagccctgctcagccttaaggagaagccccatcccagggcaccttccccaccacaccctgctcctcacagatgcagtagcctctcccaatttgcaaggctcacctggcattctagacccaagtcacgctccagcccccgactccagggagtcttccctgattgccccagcccaccttgaagcctcagaggcctgcaattacccctcagggaagggccacagctcctgatgactcccctagtatccaggacaccaggcctccacaccccagcctgcccccacatgtgcacgcacacgctggccctccttccccagtgctctgcgcacagcaccgccctcaggctggtacgaaatcacttttattcacaatcacagcgacccaagtgcacaagggaagcagcagccacccctgcactgacagaggtaatgagatgatggcttcctctccccaaccctcagcctctgggatccctggctggggggcccgctagccagcccccgctccctcccacacagaaggggtctcccagggtcagtgactgggtagtggagacccatagtgggacagtgacttccccacacacccactgcaaggccagcacaaaggcccagcctgaggtcctggcacaccaccccctggcagccctcacggaagaactcccgagtcacacagaaagcctgcccctctctcccgaaacaaccattttatagaaatggaagctgggctccagggggctacgactcggccagggccacacagctggtcagtggccaggactaaaacccatgccctgcctgccacacagaggtgcagtctctgatggatgcaaaaaaaaacaaaaacaaaaagccatctgagggggcagagggctgggaggctgggagagcccaggccagggcaggcagggctgagaggaccgacctcagcaggtggggcgctccctccccagaacttagagaacctggaggtgtgagaggcagcccttgcctcctcatcttccctacgaacaggctccctgccccgccatcacaaggtctccctgtcctgttcctggcccacactaggaacactggccctcctggaagtttgacgtccttatggaggggggacctcctgggccacctgaggtacctaagccaaccatgataacccagctctggcccaggaggaagggtgctctatggctctgggtgaccatcagccccagggcactaaggaggcttggtttgcctctctgtaaaatagacactgtttgccaaaaggcctcccaatttggcccctccttatggagttccagttcatgattggtagggctgggtatgagctttgtggctggagtcaggggaagatactgcattatgactgcctcagccacaccctttcccaggtaccccacacacaaaggcagcatttctaggggcccagaggatgggaactcacctacaaacaaacaaacaaaaaaaacccaaaaccacaaaccaaataaataaattaattaaactgaggaaaaaggctggtcttggcccagggaacccacacctccccacccagggccctggcccatcccaggtgtgccacaggctctgactatcagcctaggccctggacagcacaagatatggggaaaaggtcagagagggtagctgcaaacctgttcttagggaccctggcagaagaccaacccttctccccagcccataccgaagggctacccctgggcaatggcatccagcgagatgattggggcaggaaggctacagccaggacaggatcctccccttctcagccaggggcccagaacctggagccctctgcagcctgtccatgtgcccatcaggtagtgggagagagacatggcatgaggctgcagcctgcccaggacgggaggcaaccaccagcctctcacccccagctgccatgcccagtgggcagggaacgaagaaagagaaggtaggcataggtcagagagggagacagcagctcaggagcggcctgcccagggcggttgttgagcaggctgtacactgctcaagggcagttggctgagagggcaaatgagcctaaaatccactccatgctgcactagccaggccacatgtcctggctcagggctgcagctgcccagaggaaggtacatgttttctaattctcacaaaggtgccacatggactacagacacctcctagaaacctgcctcagatggggaaagattagggcaggctgagatcccaatttagccctcagcatgcagagaggagctgggtgcagagacgggagagacagggagagtgcggcctcctctcctcccctccctctgcccggtgatttgcctctgccccctccctgcctgatacccccctctccccaaaccttcaagggcttcagtttcccatgtttaatagaggaggaaaagtttccaaaatgaggaagagaaggggccccactggcttgttcctcagctgggactgggctgaagcccgagaagatgggtatgcgggatgggccaccgcaacgggctaggagctgcggtaggtcttgatgatgtccttgatggggcggcggcagatggggcagcaggcgtgcagagccttcttgaggcgcaggccacaggcgtagcagaggcacatgtggccacatgtgtagatgaccgtgtccaccgcgtgttcatagcaaatggtgcactcatcgctccactggcccagacctggggtcactggcgactcgggcaggctcactggcgaattgggggctgtccctgaggacaagggggcaccagtcaggaggagacatggcccaacccggcgctggattcacgggaagagagctccccggcctcttgtgtccccctccatttatcaggatctgcctgttcaccctgacaacccaacttccagggcacaagggaagaggctgagctctgagcagccccacttctgacccactccaaccccagatgaggggacagagtggctaggaggcagtgagagaaaagaaggcaagatggaggaaggaaagggtccagaatcttttaaggtaggtccctcctgagctaccctttggcactgcccagctaggggacaggaggggatgaccccagaaatcaccccccaacaagggtttactgagcccaactccagctcctctccactcccagccccggacacaaaggctgcatccttgctgcagtcccacatggtcaccaaggaacagaggagccagcctacttaccaccagcagagctacccagagggccagagctgcacgtgctgagcaaggggtcagacaggcggctgcccagggcactgggcgaggttggcgtggaggcaggggagcaggggagtgatgggataccccgctcggccaggatagtggagcctgtgaaaggggagggagggaaggacacactagctgcctgcccaggccaaactggagaaagctctgtccctcacagtgggttcccaggcctgaccacacagcccagccacagggccaagagcgggattttgcaggctggcgcggggatcatttgatattaccgccgtggagtatagctaatcagctaaagactttgaccccagacagcacccagcctggcctctgttctcacctatgaactggagggtcatatcctgctttcttcttgttaaaacagcagctccaaactaggcccctgcctggcacctacctccgcccctccccatgtatgctttctgcaaagcttcctgggccggagcatgtatattaccatctcccctgccccgcaacctcaccctcctgttcggagccctgagctcttcaccactgtccccagatatcacccaccttttctgcatggcacctctgcagtgccttcactttttcccaccttgttctgatcatagattctctcctcccctccttcctccttccgtcactcacttcctctcctttttttttttttttttttcagacggagtctcgctgtcgccaggctggagtgcagtggcacgacctcggctcactacaatctccacatcccaggttcaagagattctcctgcctcagcctcctgagtagttgggatcataggcacatgccaccacacccagctaattttttaatatttttaatagagacggggtttcaccatgttggccaagatggtctccatctcctcacctcgtgatctgccagcctcggctcccaaagtgctgggattgctggggtgagccgctgcgcccggccttcctctcctttttaacaatcctcgcctccctctttccctccttccttctctcctcccttcaacaaatccttaccaaggacctaccaggcatcaggccccgtgcagacagaaagctagagacagcccctgacttcaa

SEQ ID NO: 459 - DNA, 36030 bp, Homo sapiens
gttgccgggcacctcccgccttcccgcgccccgaccccgaactcctctccttagttctcccgggcaccctatcctatcaacgcctactatcccagccaatcgcgcaggatccgagtcgtgcctccggtccaccctcctcccagcgctcagccggtctgagctcaaggcctttaccaagcccacccaatcaacggcgggctctctcctaccccatcccaatctccctcccctcggccaatccgcgcgctccattccgctgcccgcccagccaacccgggccttgaaaccagcaggcgaatgggcgcgagacggcccttcgacgctgagcgcctggccagttagggattccgcgtggccaggacaacggccaatcgtcgtggagcgcggcgcctccgcggagaggtccggtccgaatatccctccgccttcctccctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactacccagacagagccggtgaatgggtttgtggtgacccccgccccccaccccaccctcccttcccacccgacccccaacccccatccccagttcgagccgccgcccgaaaggccgggccgtcgtcttaggaggagtcgccgccgccgccacctccgccatggagctgatcaccattctcgagaagaccgtgtctcccggtaggacgcaggagccgggggtagggctgaggtgattggggtgggggaggggaggcccggcccctctgaccccgctccgtctcccactttcctccccctagatcggctggagctggaagcggcgcagaagttcctggagcgtgcggccgtggagaacctggtgcgtgctaccccgccgcgcccatcccgccgcgtccccatcccctgcgtgcggggccttcccgccctcccggaggcccaggcctcgggaacctaccccgccccatcccgtccccctcccccctccccctccccccccaacccggtccaacctaaccccgccatcgggaagccggtgggtgtgtcccgccccgggcctcgcgactggccaatggcttggcgcgccgagctgcctgccgcccaatcgttgcgcggcctgagggcggcggtgcagcgggagggagaaagagggagggaagggaagttaggttgcgcggcgctgcgtgttcagcaggggtgggggcgggggagtcgggcctaggggccatgtggaagctccgggcccggccgcccgccctgtctgaccccggccggcttctccttcctatcccgtggcccctgtggctctccccacctatttcctagagctctgccctttcctagctaccttggtctgtactcatggccaggcctggcacccgactgcctcttaacccatttccactgatatttttccctctttgctcggttattcctctcttggggttttttctttttctttctttcttttttttttttcttctgacctggatgaatagagacctaatcactagggatctgcacccagaaaacagactgaggctcatctttgagatggggcctgtttgctgatgaaatcacaggggaaagttcctcgtttttcatattttaaaatttaaggggtccggagaaaatgaagctaagtccgctagagactggtcctttgtataaaaatgtgggatggattggttgaaacagcctagatgccagttaagtttctctttggtgtccatctcctgttgggggatggggtcagagggaaggattggatgatgcttgacatctttgagaaaggtaataggaattaagtctgagtaacactaaccatatgtgttcctttgtgttatataggcaaaatgtcaacatcaacaaagtgacaaggcttattttatacagactgcctttgaatgatttttttgttgtttttcatatgtgccaatttttacaactaacctgtttatcctttcctagaagagatttttccactagtataggctgataattccatttagggtattattcctgtttctgcttttgcaaattttgcaaaaagctttttatcttattcctaacattcttaacattctttagtggtacataattaataaaacttttaagaattatcttctgctgtgattgcagagcttgttagcagtaagaaaaatgtgtctgcttttgacttttcctgctaactttgctgtttgggcacggtttttggtggagaggtgtgtgtgtgctaaatttttaaacaaagggagtagtttttgaggcctgtggattacaaaaggttacaaaagaacatgcttttcagggatccactgtattcctcaactaaagtccaaatgtaaaggagcaagtaattgttgatcattagatacaaagttattttgcttgaacagcttgcctgaagattttttctttcactttttccctatttctaaatatcttatcacttttccttataaatctgcttttttcattgttccctttttgctgagtgcccacaaataaaacggaggatgaggctcctaagtttgttttaggcttatctgtatttccccctctcataaaagatcacctccttccatggattgaaaagctaccctgctgctgccatgagatggaaagttggatcattcttttgggaccaaggtttttgaaatttagataaacagttttattttctaccccccatcataacagccattcatttaacaaacattgagtaccagacattattaaaagttcttgggacacctcagtatacatagaagactgactactactaccatactctgaaaccttgcaattcgggggtctaacatgacaatttgggcactaagaatgatcttgatagggaaatctgtaattcctcattaagtgctaggctccacgagaaaagtggaagacttcctgttacactaagtaacatttttatagaagtcagtgaagtaaatattttgtggtttcctgaaatgcttatatcaaaaaaaaattagacattagttccccccctcgccgcccctctggtggttcagtgctctataaattatcctcagttgtggaaattcctaagatatttttatttacaaatttatcttcccttaacagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgtgagtaacgcttatctgtttggttatattgcccagagaacaagaaatcgctttctcagatcttttgctatttgcatgggatagagctaacagtgtgataggtttctgggacctcaactttacctaaagataaaaattgtctttgtcttaaatctttctcaacacagcttgtccattcccattgatggattggaattctttttagatgactgaggtaggctgcagcagtttgggaaactttaattacgtgccataattggtaaaatctgtttggcaaatgggagtagtgtacaaattggtgctacatttgtataaaaattagggaatttgttaataggtatttccaagctctccagaaattccgattcggtacttctggagtacagctcagggaatttttttttttttttttttttggagacagtcttgctctgttgcccaggctggagtgcaatggcatgatctcggctcactgcagcctccgcctcccaagtagctgggattacaggcacccaccaccatgcccagctaatttttgtacttgaagtagagacggggtttcaccatgttggccaggctggtcttgaactcctgacctcaggtgatctgcctgccttggcttcccaaagtgctgggattacaggagtgagccacctcgcctggctgttgttgtttttaaattaagttctttagtgatctgtcttacatgggtaaggcacaaagaggagtgagttaaatatctgtgcagtcatcattttgtccttggtatttgagtggaaactagtggggaattcctacatatgtacttgtgcaggacatggttatgcacatcatacttgctatttcctggttctagatatcagcattaggtaaagtagtgccctgtaaggcagtaacttctgtatctggttgtgtacctccttctgtcaccaatcttgcatacccatgataaggagccgggttattaaatccaacttggtttcaaatcgttttggagcatgtagagctgtttctattcatgttggttctgcttgtgtaataacaacattttaattccttctccctcagctaagtgacataaatggaagtatattctatcactggaaatctcgatactgatagtgcccattcagtttctcatcttccttaatttacacactagtaaatgggataagatgtaattggaattgtaattggcttattttttggcacatcactcttaacaccaaccctttaaaaaaaaattagacaataatggctgggcgcagtggctcatgcctgtcatcccagcactttgagaggccgaggtgggtggatcacctgaggtcaggagttcgagaccagcctggccaacatggcgaaaccctgtctctactaaaaatacaaaaattagctggctgtggcggtggatacctgtagtctcagctactctggaggcttaggcaggagaattgcttgaacctgggaggcggagattgtggtgagccaagattgcgcattgcactccagcctgggtgacagagtgacactccatttcttaaaaaaaaaaaaaaaaaaaaaattagataatttgtataggcatggttaagccctcgggcatgagaaaaaagctaacagtaccttggcctttttccctttcatagcacaacgataactaatactaagtttcactgttggtgatcttttttgaaatctggatattggggcacaattgggagctagtttctcttttctgataattgaatattactattaaggttacctctagtttaaacagaaaacttttagtactcaggaggtggacatccgtagtttctaaatcacctcaagtaatatggagtcttcagaaagcaatctaaaggaaaaaggtaaaggtagaatgggattcagtgcactccacatatgtactaggagactatgtagtgtggtgtgaaggcaccctggacttgggttaataatacccattcagcccctgatattttggacaattcaccttgtttttccccctcattccctcgtgtctttgacataccgtttttgtccattctagctctgctagtcctcgagagcaaagcctttcatttaacatcaatcagaactgtttgtagttgggtagagctgatgggggtgggggccagggatgatgatataccgtataagaaggaaagggggagttcattattggtgctagctgcaaagcaggatactaagtgatccgacccagtcagcagagctggcctgaatatctggcagctattctttgtcccgtgttcatgccagaacagttaactgtttgcctttgagtggactactgattcttagtgagttcattgactgaattagctgatcacggtaataattagctctaggtcaattgtggcttcatcttttatcatacctgtgcctttactctttacataaatggtggcgtggttaccatgtcaagcgagacatgtttaatgacaagtggatcttgttttgacatctggctagattttggtatctgtcagtgatagaacagttctttgattcttgggcaaacagaacaaatcctttcagattggaagttatataaagattagttcataggtgttattaacatcagcaacgttgtttttgtatttagtgatgttgttacttgaccaaggcctttctatgtaagtcaccccgaatgctgagttgttagtgattagaaggaaaaagttttgtttcagcccacgtctcatgagtaagatctccttggatcagattagacagtgatctactgtgaataagacccacctgaatgccccagaactagcttcattctagtgtccatgtctgtctacaaaacgagggtgtgaacatcctttccttataacagcaacaatgagcctggaagatgagttttgtccccatctctctcctttgccatttactgctacctcctcttgtaacttctggtttcccacctcgtgttgaaggttgaagtgaggtgggatgactggttttgtttctaggttctagggcagtgttgattatgctgatgttgctactgaggctggttttttctgacagcctttcctacttctccgtattatagataagaattctgaggccaggcacagtggctcacgcctgtcatcccagtactttggtaggccgaggtgggtggatcacctgaggtcaggagtttgagactgtcctggccaacatggtgaaaccccatctctactaaaaatacaaaaactagccgggcatggtggcaggcacctgtaatcccagctacttgctggggggagctaaggcaggagaatcgcttgaacccagaaggcggaggttgcagtgagccgagatcgcgccatcatgctccagcctgggggacacgagcgagactttgtctcaaaaaaaaaaagaattctgagacagctgcctgggcacagtggctcacacctgtaatcctagcactttgggaggccaggaatttgagaccagcctgggcaacatagggagacccccatctctactaaaaacccaaaaaagttagctgggtgtgatggcatgtgcctgtagtctaagctactcagggaggcctgggaggtcaaggctgcagtatcgttgtgccattgcactatcgttttgctactacactccaccctggacaactgactgaggccttgtattttcctttttttttttttgagcctgggcaatatggtgatgccctgtctcaacaaaagatagctgggcatgtcagcatatccacccctgtagttcagttactcaggagcctgaggcgggaggatagattgcaccgtagagattgaggctacagtgagctgtgatcgtgccactgcactccagtccgggcaacatagtgagaccctgtcttaagaaagaaagaaaaaaaagaattcagagacactaatataagtatggtggtgggcaaaatgtggtcaaatagtgttagaaatttgtatcttttgtctttttttttggtgcaggttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagtaagtgcttgcctaatgtatctggtttatatacctctgattgcctctagctgtgacatcaatgatattagtactaccttattgaatcacgaagaaagccaagctaaattgcacagttttgaaagtgagactgatttatttcccttaggcctgtgtcttcacattgctaatcatgccctaaagtaaagaaacttgaggatcgcaaactgaaaacagaagtctatgtttgaagagtcttagattctagacttacaaaatgaggatattctcatttggattatccctgacccagtcttttttcttaagatcccgaatgtaccatgaatgttgtggcgcattttcatttacaacattacggaaagttttgccaacatttgatgtagttggtttagccactggagacacagtattttagatgtagcccccccagcactgttgttcctgatgaggttaccactcttggtgtgtattttaatatatagactttatgaagcaaaggagcccacagcacttgacccagacttagactccctagatgtgcctaggtgtcgatccttggccttggcccttaaatgccctgaagctttactttagagtacagatggcctggaaaatacgaacagactgccatctccatttgcacagaagtggggaggaaagcgaatattacctcatacccagagtcattatgctaagaagtcaaagatgaagttgatgagtttgacttggttttgttcagttctggattgccagtaccatgagacattttgcaggtggtttgcagtgttattcccaaatggaaacgggtggggaaagatcaccaattcatgatactttcttgagtgaactttacagttaaaaggactgccaattaagccaggcacagtggcttacacctgtagtcccagctgcttgggaagctgaggtgggaggatcacttgaacccaggaatttgagggttcagtgcattgtggtagtgcctgtgaatagccactgcactttagtctgggcaatacagaccctgtctcttaagaacagaagaaggactgcttctgtcgtgaagctccttatggcagtcttttggaggggattgattccagcaccctcctcaggtaccaaaatcctcagatgttcaagtctgttacataaaatggtgtagtatttgcatataacctatgcacatcctcccatatactttaaatcatctctagaatacttacaatacctaattcaatgtaaatgctatattaatagttggtatactgtattaagggaatgatgacaagaaaaaaaggtgtacatgcaccttttggtgcagtacagatgcaaccatccattttttttcctctaaatattttcaatccatagttgtttgaatccacagatgtggaacccatggctgcagagggctgactgtatattcattgcacttctctgcttgttacaggacccagagcagctacaagataaatccaatgagattctgactgccataatccaggggatgaggaaagaagagcctagtaataatgtgaagctagctgctacgaatgcactcctgaactcattggagttcaccaaagcaaactttgataaagaggtaagttttttgacaataaggtatagattcagacagtaagggatgaaagagttgaatgaaagttttttgttttgttttcttaagtttatggtttagaaagtaccacctacttaaaagtatttgtttccagtttagtcgagttcgtattgtgtgagatatccccatggagtgtttgccgtttctcatcatgcttttggaaataaagtgtttctaagcttaggtttttccttttgcagtccaaagtgtggaatgttgttgggtttttttaaattatagggcatggtggtgcatactggtactccagctacttcagaggctaaggcgggaggattgcttgagtccagttattcaaggccagcctgggcaacaaagtcagatatcgtcccttaaaaaaaagaaaggaataggctgggcgatgtggcttaagcctgtaatcccagcactttgggaggctgaggcgggtggatcatcaggtcaggagtttgagaccagcctgacgaacatggtgaaaccccatctctactaaaaatacaaaaaaattagccgggtgtggtggcgtgcgcctgtaatcccagctactcaggaggctgaggcaggagaatcacttgaacctgggaggcagaggttgcagtgagccgagattgcagcactgtattccagcctgggcgacagagcaagactgtctcaaaaaaaataaaaaataaaaaaaataaaagaaagaaattatggtatgtactatatatgttggtttactttggtttcttttaagattgtgtgaatcttttgccttgtactaaagattttgtggaggccgggtgctggggctcacatccagtaatcccaacactttgggccaccaaggcaagaggatcacttgaagccaggagtttgagactagcctgtgcaacgtaacaaaaccctgtctctaaaaaaatttctgtggagaagaacaactgagttgttaaccagttttgtgagctcttgtgtttacagggcttataatggaaaaaaaataatgaaaaatgaaataaataaaaattatagcaattggtctgtttcataccaccttaggaaggtgtttttaagaaacaggatatatagccaggtgctttggcacatgcctgtaatcccagctacttgggaagctgaggtgggaggatcacttgagcctgggagttcaaggctcaagatttcaccactgtacttcagcctgggcaacagtgcaagactctgtctccaaaaaaaaaaaatatatatatatgtatatgtatgtgtatgtataatatatatgtaaacattttggctgaaaatgcaatgaataacataaaatttaccatcttaaatcatttttaaatgtatagttagttaagtagattcacattgctgtggaaacaatctccagaactttttcatcttgcaaaactgaaactgtacatactgaacaacaactcctcatttccccctttctcagccactggtaacgaccattttactttcagtttctatgtattttactactctaacgaaataccttacgtaagtggaatcatatttgtctttttgcgactggtttgttttacttagtatgatgtcctcgagattcatctaaggggtagcatttgtcaaaattggctttttaagggtgattaatattccattatatgtatatgccacattttgtttatctagtcttccatccatggccatttggtttgcatccaccttttggctattgtgggtaatgctgctatgaacatgggcatgcatgtgtatctttgagactctgctttcagttctttagggtaaataccgacaagtaaaattgccagggtcatggtctgaaagtatttctgtatatatgtttgttgacacttcagctgggtttttaccatttcttgactttggaaaggtctgaaaccccagagcaaatggcaattctaattgattagaaaactggatttttccttaatagattttggaagatttaggagggtagcacataaagttcattctcccttttctcaccacatttgatgtgaatttgctacctctcagaaaacaaatttggtctctgaaataaagcagatgttttgaattctcttatataaggaaactgattttcctacatgtaaatttttatcttttaaccatttttatttaaaacttgtgacctacatttttctgtttcctccctgaagtctttgttagtggtcattttggagattaaaagattagggacctcattggagggcaagtcacatagcagacaccgaaggtaaactctttatagcctttatagtgctgtaccatctcaagggagagtggcttgattgtaccaggcagggctgtgtggggccctgagggggagtgagaggttttccttgtagagggagtctggaaatcttcctacgtacaggttatgctctcctaattctctttatttttattcctcctacagtctgaaaggcactttattatgcaggtggtctgtgaagccacacagtgtccagatacgagggtaagtgtgaggttatatgaaaaatctgtcttacatctttcttaggaaatgtcaaatctaatataagtttgaaatactgggaatcagttgacttcagcaataaggtttgattaatattgttactaataattaatattctggctgggcatggtggctcacacctgtaatcccagcacttagggaggccatggcaggcagttcacctgaggttaggagtttcataccagtctggccaacatggtgaaaccctgtctctactaaaaataaaaaaaaattagctgggtgtggtggcacgtgcctgtagtcccagctgctggggaggctgaggtacaagaatcgcttgaacctgggaggtggaggttgcagtgagccaagatcatgccactgcaaacagactccatctcaaaaaataataatgataattaataaaaacattagagaagagggaagaattgtcatggaagttgccatcctcttaaaaaaggtttaaggtgccagtgtggtggctcacactataatcccagcaatttgggaggccaaagcaggaggatcactgaggtcaggagttggagaccaaactgggcaacatagtgacaccatctctactaaaaaatatgtatacacaaataaacagttaagggagaaaaggttttcgatcagcttcgctacttcattgccgtaggttattcaagccatttctactaaaaaatatatatacacaaacagttaagggagaaaaggtttttgatcagctttgctactttattgccataggttattcaagtgattgttttcccctgtagccattaaagcagctttgctattgctatacccaaaacctgacccttcaagaagatagaagtaatatcttcagtctgaatagtattagtgaatttagccgtaccatgggttccacacgcacctttaatgcaaaaaaaaagactgaggccaggcgcggtggcttacgcctgtaatcccaacactttacaggcgcatgtctgtaatccagctactcaggaggctgaggcaggagaattgcttgaacccgggaggcggaggttgtagtgagctgagatcacaccactgcactccagcctgggagactccatctcaaaaaaaaaaaggactggctgtggtggctcacacctataataccagcactttgggagaccgaggccagaggatcacttgagcccaggagttggagaccagtctgggcaacatggcgaaactccatgtccacaaagattagctgtgcgtgatggggcgagcctgtagtcctagctacgtgggaggctgaagtgggaggattgcttgagcctggtggttgaggctgcagtgagccgtgatcatggccactatacttgcaccagggcgacagagcaagaagactgtctcaaaaaaaaaaaaaagagaaaaatggccgggcgcagtggctcacacctttaatcctagcactttaggtggccgaggtgagtggattgtctgagctcaggagttcgagatgagcctggtcaacatagcaaaaccccgtctctactaaaaatacaaaaaattagccgggcatggtggcgggcacctgtagtcccagctacttggaaggctgaggcacgagaattgcttgaatcggggaggcagaggttgcagtgagccaagatcatgccactgcactccagcctgggcaacaggagcggaactctgtcccttccccgaaaaagagagacaaaatgggaaaataaaggaacagataatgagggaattaaagggagagaatgaattttagggaaatgataacgtatcccatatttacctcaattaatccttaggattattggcccatttgagtgaatctaactttgtcagattgcgttgttattttagtaaactatctgatctgctgttcataaaaggtacgagtggctgctttacagaatctggtgaagataatgtccttatattatcagtacatggagacatatatgggtcctgctctttttgcagtaagtatttctatttatgtgatttgagcttgtggctaattacagagcccatcatccttagtcgctattttgccaattctgtaatattttacttaatactatggaatcaaggaaattcctcgagactgttcggtttaagctcatcagtggtgtgccaagaaaactggtgctaactttgtgtgggtaaaagaccttcattttgaggtcaggcccggtggctaacgcctgtaatcccagcactttggaaggctgaggtgggcagatcacctgaggtcaggagttcgagaccagcctggccaatatggtgaaaccccgtctatactgaaaacacaaaaattagctgaacgtggtggcacgtgcctgtaatcccagctactctggaggctgaggctggagaatcgcttgaacccaggagacggagggtgcagtgagccaagatcacgccattgcactccaacctgggccagaaagcgagactctgtctcaaaaagaaaaaagaaacaacctgcattttgaaaatctgaggctgggcatggtggctcacgcctgtaatcccagcagtttgggaggctgagactgacagatcgcttgagtccaggagtttgagaccagcctaggcaatatggtgaaaccccgcctctacaaaaaatacaaaaataagctgggtgaggtggcatgcacttgtggtcccacctatggaggaggctggggtgggaggtttgtttgagcctgggaggtggaggttgcagtaagctgagattgtgctgctgtactccagcctgtgtgacagagtgagaccccatcaccaaaaaaaaaaaaaagaaaagaaaatctttcttttcctatcttttctttcaagcctagcttcctttttatagttacatttctgaaatttgcatgtctgtggttaaagccgggttggggcagggactcacttgaatcagtacttatttggggcctggggtgtttttcttcttaagatcacaatcgaagcaatgaaaagtgacattgatgaggtggctttacaagggatagaattctggtccaatgtctgtgatgaggaaatggatttggccattgaagcttcagaggtgagctggggagaactattactctgaatacgctttgggacatatctcatttgtggatgatgttccccttctaggagaactttattctgtctgggtttagagggtatctccattggcagagattttgatttttctgctagccagagcccttcatgaaggaggcacatcagtaatgagggctcacgttcttgccaagcagtcaggcatgattgatcgtaaatagtggtattatcactgtgaacacaagggggcagcaggctgtcgcagtttaccaaggtgatgcctgatgctgaattatttccttttggaagtcctaatgcaagcctaggatgtataattgatactttactaactctggtgaaagagtcagatatggaagagaatggggagttctgtacttgggatctttgaattcaagttttgtttccagcttggtctttacacacttttatttcaggacaaaaataaaaaggttttttttggcatctttaggcaaactgagtgtgtgttgatccaaggaacactgaaatatcaggttgtccatatgaattgaacttatgaaaaaaaagttatacttaatgttgccttggacctatattatatggcctaaaagattctcactgaagtagaccaaaaaattagcactttccaagatcacattgtatgttaccatttgtccttgtatgtttctgtttctgttaagagatccctgttcggctctcattgtatgcctttagtatacagagctcggttgcttttgtctagaatttgctttgtttctcctcaggcagcagaacaaggacggccccctgagcacaccagcaagttttatgcgaagggagcactacagtatctggttccaatcctcacacagacactaactaaacaggtgagttaccttccaaatataggtaggtaagctgtggaaccttactaagagtaaactgtggaaactttccatggaaggaacttcgcagcccatcaactatttgatgttctgttgttgatgacttagaaacagctaagctgcatctataagatcccctaggctctgacttctttgtgaaggagaactgagtcttaacatctcagatgcatcttgctcaggaatgagccacatgctgctctgatttcctgagtgctccattgtccaaactcataaaagaaaggtgctctgtcaaagcttcagtgaagcaaggttaggagcaaagatgtgctggttttaggccacttgcgtatctgttgtaatatccaggatactttcgtgagttcacagggtgtatgtttttaaaattctaaggaagttggatataagttattcagatgctaatgaaggaccccaacccaagaaagaaacccttctactgatcctttaagataattaacttcaattattaagattcaggatgaaagtaaagtgacaagacttcataaagattggggtctaatgagtaaatatagaagttcttttatgaggaccgtgtcctggttgcttttgttctcctgacttgatgcaacacagtgttttttgatacggtatttgggaagcttcttctggtgcatgtgaagtattaccaaagagctgctagtactctgacgaaacaatgttggtaactgagcattgcatcatttctttgtacacaggaatgtaattgtttttagggatgtgtataattctcaatatagcagtttcaaaagctaagtagggatgtgtttggattaaaatgaactgggtgttcccttaattttcatctctcctctcagggtttttttgtttttgtttttgttttttcttttgttttgagatggagtcatactctgtctcccaggctggagtgtcatggcatgatcttggctcagtgcaccctctgcctcctgggttcaagcagtgtcccactctagcctccccagtagctggaagtacaggtgcgcaccaccacgcccagctaatttttatattttcagtagaagcggggttttgccatgttagccaggctggtctcgaactcctgacttcaagtgatccgcccgcctcagcttcccaaagtgctgggattataggcgtgagccactgtgcctggcctatagttgctatttttatcttttgacttcgtgtctttacttttgtgtgtgtgtgtgtgtgtgtgtgtgtattttatatatatattatatattttatatattatgttatatatattttatataatgttatatattatatattttatataatgttatatattatattttatatgtattatgttatatattatatattatatattatgttatatgttatatattttatatgtactacatattatatataattatatatattttatatatattatatatatttattttttagacagagtctcactctgttgccaggctggagtgcagtggtgcgacctcggctcactgtagcctccgcctcctgggttcaagcgattctcctgcctcagcctcctgagtagctgggactacaggcatgcaccaccacgcctagctaatttttgtagttttagtagagacggggtttcaccatgttggccaggatgatctcgattttttgacctcatgatccgcccacctcagtctcccaaagtgctgggattacaggcatgagccactgcacccggcctcctttcttatatttttattgtgcttttcctatttgagaacaaattattctttgtgtgattttctgaaactgcataggcaacctgccttaagtttactatgtggtgtgaatggccacaattaggaagctataccttggattctaacttaagaggagatattagtggaatcttttcttttttgaacttttgtggttttggtttttggttttttggggtggcgttggggggtacagagtcttgctctatcacccaggctggagtgcagtggggcggtcttggctcactacaaccttcatctccctggttcatgtgattctcttgcctcagcctcccgagtagctgggattaacaggtgtgtgccactatacccagctagtctttgtatttttagtagaaacgaggtttcaccatgtttaccaggctggtctcgaagtcctgacctcaagtgatctgcctgccttggcctcctaaagtgctgggattacaggcatgagccactgcactgcaccttgcctcttttttgaacttttgattgaatcatgtcttcttcccagtcatgaaactcccttactttcctggtcttttattccataggttaatttttgttgattttggactttatttattattatttttaatactatgtttttttttttttctgacagagtctcactctgttacacaggctggagcacagtggcacaatctcggctcactgcaacctccgccttccaggttcaagcaattctcctgccttggcctcctgagtagctgggactacaggcacgtgccaccacacccagctaatttttgtatttttagtagagatggggtttcaccatgttgaccaggctggtctcaaactcctgacctcaggtgatccacccaccttagcctcccaaagtgctgggattacaggcatgagccaccgcgcctggccgattttggactttacataactggaatcatacagcatacattctagttctgtattttgttctaaatgtttggaattcattctttttggatgtagttgaaattttttcattcttgttgtgtagtactaaatggaatcttcttccatctgaatcttgtttaacaaaggctatgctgtgatgaatgtttgtggaagagacaaaatataaaggtcttatattttatttccctggagtttaagttctaaagacattcaagagtagtcagaggacctttagagttaaaatgattctttggacaaaatcttaactagtgccatattctttcaccaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggtgaaactgagggatttttggagtagaaagtaggatatttattgtttaaacttaaagcatatctttatttttcaaaacaaaactgtaaattgtcatctacaaagattatctctagatacttgtttacttttaatgagggtaaaatatatttcttaggtttttaattacataagtcagcatgatccagagacatgtgaaagaagccaaaagagaaaagtcatctttaatttcattgcccagaaataccactcttaactctgtatttatccttgaagctttttcctatgtgcatgtgtgtgcaacaggctcttcctgtgcagattgttttataacttgtttcttcatttaatactatgttgtaaacatttcccaataatttttttttgcacctagcactgattccccataatttttaataatggcattattattctattctttggacaaaatgtcctttatgtaatgaaaatgttcttatggaaatgttgtgcttgttttgctattacaagtcgtgccattgcactccagcctgggcaacgagcgaaactctatctcaaaaaaaaaaaaaagagtttgttatagttgagtttagtgcttaaagaattcagtcttcagtctttctggatatagccagatgccatcatagctgcatcctgagaattctgagtatctgagtaattctttttttttttgaggtagggaggcggggggatggagtcttactctgtcacccatgctggagtgctgaagtgcagtggtgcaatctaggctcactgcaacctccagctccccagcttaagcaattctcgtgcctcagccccctgagtaggtgggactatgtgccaccatgcccagctaatttttgtattcttagtagagagaccgggtttcatcatgttggtcaggctggtcttgaactcctgacctcaagcaactcctgacctcaagtgatctgcctgcctcagcctcccagagtgctgggattacaggcatgagccatcatcatgcccggcctctatctgagtaatttattgcagactactaaaagcatttacaccaaattcttaatataaaactctaaactggagttttgaaagatattttcaaatattttgaaagatgtttcacaccatgtcctgtaaaattacagaagtatcttggtgacttttttgagttaagccatccatcagtatttctttctctggggtagtagttaacatgaattttaatctttgttttgctttgctaataactgttatattttcaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggtaagggattttcttgctggtgagaaaaggagcttgcctgcgccactggcaagaaagtagaaggtgtgggagagaaatcaatctgcctcactggaatgctttttctgattttctttctaatttattcaattaaaatgtgggggagattccaactgcaagagccagtgggaacacttgacttatggttactggttcctgaaccacttagaacagtcatggtaacccagtggggaaactatctggacttgggttgctttcttgaattgcttggggacaagaagttttgattaaggtagagagtttttggctgtaagaagtatcattgctgagtagagggcaagagggaaggaaggtaggcagcctaaatgctgagtcagtataggctaatgtaattggttaaggggaggaagttcaaataaggaaggaatggggctaaacgtctttctgtgaaaggaaacagaaatgaaatggcaggtatggttgaaagtactctgctgcttagagagttgtcagattatcaaacaggatgatgagagatgtcagattatcagacaggatttctgtgattggaaacagaagaaatggcaggtattggtgaaagtactctgctgcttagagagttgtcagattatcagacaggatgaacaggaagtacaaatcaaataaataaatagttagtttaaaagatacctgtaaaatgctgtcttgagatgaccttggcagaaaaagttggaagttcactgacacggcccaaagtatcttaatgaaaaatgagataatcctaaggtgtggggttctttcaggattaacattgaacctatgtgcatttcaggctttctccagtctggctgaagctgcttatgaagctgcagacgttgctgatgatcaggaagaaccagctacttactgcttatcttcttcatttgaactcatagttcagaagctcctagagactacagacaggtaactgatatttcacagaaatgagtgacgtctttgcatccaagttctattgccttctgtgtggaggatatctagcttaatcatagaagcataatgagacaggacaagactctaccttctctagaggaattaaaagaaacccgctgggcgcggtggctcacgcctatattcccagcactttgggaggccaaggcggctggatcacctgaggtcaggagttcgaaagcagtctggccaacatggtgaaaccctgtctctactaaaaatacaaaaaattagccgggcgtgctggcgcatgcctgtagtcctagctacttgggaggctgaggcaggggaattgcttgaacctgggagatggaggttgcagtgagctgagactgcgccattgcactccagcctggacaacaagagtggaactcgtctcaaaaaaaagaattccatgattgattgattggtttgtttaaagatggagaaagaaatgcagattccacctaccttagaattgttcagtttacagctgaaatatgaatatagtgtaatttctctgctttctttgtagagagtaatagatctagagaggttccttcattttgcagcattgacagttaacaggagtatttggttacaagagaaatgatagtactcattatgaatttgattgccacaccaaatcaataactaccatttttattttattttattaattaattaattaatttattttgagacagagtgttgctctgttgcccaggctggagtgcagtggcgcaatctcagctcactgcaacctcctcaagcgattctcctgcctcagcctcctgggtagctgggactacaggtgcatgccaccatgcctggctaatttttgtatttttagtagagacagggtttcaccatgttggacaggatggtctcgatctcctgaccctcgtgatccacctgccttcgccccccaaagtgccaggattacaggcatgagccaccatgcccggccaactaccatatttttatataggatgaagaacttggggtaaatacagttgacttagaaacaagcttttgaaatgttgtttaaagggattataagttggagacaacctttaacaatttatgttttgtatgagctatacctaaagtcatgagcaaagtaaaccttcaggaagagagctgagcacaaaatcttccttttttttttttttgagacagtcttctcttgtcacccaggctagagtgcaattgtgcaatcttggctcactgcaacctcctgggttcaagtgattctcgtacttcagcctcccgagtagctggtactaaaggtgcccaccaacatgcctggctaatttttgtatttttagtagagatggggtttcgccatgttggccaggctggtcacaaactcctgacacctcaggtgatctgcccaccttggcctcccaaagtgctgggattgtaggcctgagccactgtgcccatcaaaaaaaaaatcttccatttaactagttcatgtccatgcctctttgagattatatatgaagacatcttttttaaatgaatgaagaaaattggggtatttttttttttctgggacggagtttcggtcttgttgctcaggctggagtgcggtctcggcccactgcaacctccacctcccaggttcaaggaattctcgtgcctcagcctcctgagtagctaggattacaggcacaagccactacacctggctaatttttatatttttagtagaggtggggtttcaccatgttgaccaggctggtctcaaactgacctcaagtgatccgcctgcctcagcctcctaaattgctgggattataggcatgagccatcacgtctagccaggaaaattggggtattttcttcatagcacttcagacaacctgttaaattgttcacatgattttttaccatttcaaaccattttttcctctataattttagcccatttccaaaagggccattctaaattttaactgtctggagaccataatgaacatagccattggctcaaaggacttgaagatttcattcttggatattgtgttttcaaactcaaaccaggtctgcagacataccggttcctgagttcttatttttggcaagacattgtctatgttcttccctgtccttttcatttgaggctttaagattttcgctgtgttctttacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggaggtgagacctaagagtgcccctgactatgggtgggaattgggtagtacttttgacacctaggtctgttttccagactgttctgtctttttagtgtttaagtatatattttctcagaaagataataaagcttatacaaaaaacattgcaccttaacgttagcattgtttgtcatggtttactcatatatgtgttacactatatgtattatgggttttttgttgctgttgtttactttcctatgttagtattagggaagattattaaatggtcccagcaaaagtggaaggttttcatgtagagtatgttttcttattttctttgtagtcacatatccagagcacatccgatagaatccagttcaatgaccttcagtctttactctgtgcaactcttcaggtatggtggtgccttatgacttaataactccaggttggagaattattagtatctcagtataacaagttcgtgtacacacagaactcgaaaatggtatagatgatgcggatcagaagctgttctcagaaggctttggtctgtgattggttgattgggagaggaattccccacctgccttacctgtctgtctagaaagattcaaatcctacttatttacagatggtctagatgtaatcttgataaaatcaaaccaacttgacttctcctaattcaacatacactcctcagacctctcttcctcactcgtttgtttcaactaatgtcactgtgtagagaaggaaactacttaatgtgtgatggttccttccagatgtatagctcatttgtgttggcagcttgaatggttttggtttttttattttgaaaaccaaaaaactcttggtttttcattaggttattcaagcctagctcagtcagatttggttcccagctatagttcacttggctaaaaataaagccttgaatttgtaccgtcatcttttgaaacatttgctgtttgacctaatgtcagtgacattagttgaaacaaacgagtgaggaaggaatgtttgatgggagaagtcaggttggtttgattttatcaagtttatttctaggtcatctgtaaataggtaggatataggaagggttgctttttgtttgttttatgaataagagctctaaggtgatagggccttctctaaagctgaagtaatttaactatcattccagtaagactggactatggcggctaccagcagggatttgtcagacagtaagacaaatgaaattgagaggacatgaccttctgcacaacggaggatcagctcacgtttgttctgaattgagaaacaggagaaatgttaaaatgtattgctgatgattggtactgtcaatgtttttgtgtataaaatacatttggcattcccaaaattaaaaaatatcaagggacttaattgattttaaaaagaaaaggtatagtgttctgattgggagatttggaatcaactgatcttgaactcttactcatttcacagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaaggtcggtgagaaatactgtctggtcagggaatgtctttggaatgtaggcatttcagtggccttaaataattgtcacccaggctggagtgcagtggcacgatcttggcgcactgcagccttgaaatcgtgggctcacatgatccttccacttcagtgcccccacagtagctgggactaacagatgcacaccaccatgcccagctaatttttatatttttggtagagatggagtttcgccatgttgcccagactggtcttgaactcctgagtcaagtgatcctcctgcctcagcctcccagagtgctaggattatagatgtgagccactgggcccagcttaattttgtttgtgtgtgaagatagggtctcactatattgctcaggctggtctcaaactcctgggcctccttgtcagagcattaaagaatttttgactatagaaagcatagtccttttactggggcatgagtcacttcaaagttagattgaacttaagtgcacaccacttaaatttgtataactgccttgtcagtccatttaaatggggagccagtttgcaacggagattggcagaggtgttgttttttttttgttttttttttttgtttgttttttttttgagacttgttctgttgcccaggatggagtgcagtggcaccatcttggctcaccacagcctccacctcccaggttcaagcaattctcctgcctcagccttctgagtagctgggattataggcatgagccactgtgccctgctaaaagtttctattttctttcctggtacttgtcatcacctggtttggtttgtagtgctttggactaagattgacacatcatggtgcctggtatgggatgaaatgaaacattgagcgagttctaggaattgattttctgatttttacatgtctgactgcaaaattggtttggggaagccatatctgacttaagactctttgaaggggcattacgaagcactttaggaatctgatatgccttttcaggggtggcctgtaagtacattgctaaggccatttacctgaggaccactctcctgaggactagacctatttttggcataaacagcctatgtccaactggtctgtcaacatgtgaccactcctctgaaagggcaaagaagttaattttggctcctggagtggctgatttggatctgaagcccagtgctgcttttcctggctgtggcttgtttagcccttgatggaattgcctaaggaccctgttttgaagctggcttgcagaaaggacatgctattatcagatgaggaggtggacaagagtcagtattgctggttcagcccatttaaaattaaccttgacattccttgagggtcataccacttggttgtattagtcagagtaaagccctattctgtggacagtgggcattgtctctgtggcgtatgaattagggcccttccagcagtaataaatttggcttatgcaagcctttaatgtcttcatgatggaatcggtaactaaagcacatttcacccaacctgttgagtggagcgagtacattttgggagaggtaggatgggttatttctgcctgcctctgtgttaacccgtggtgctgtcattggctaatagcttatttcattacagtgttgggtggtgaattcctcaagtacatggaggcctttaaacccttcctgggcattggattaaaaaattatgctgaataccaggtaggatgtgcttttcaaaatagtatgttcccatttatatctgacagtcactgtagtgcacgcaaaaccaggttcttatagcttaagtagtttttcctgatacattgtcctaaaaggcaagctactttattcattgcctgaacgtttgaactggaagtagtccatgaaaaacaggatattagatgtaccagataacggtggacaagatattagatgtaacagataatggtggacaagatgactgtttatttgcttagacagtactaatgcaggagcagctataaagttgagctattagcaccctggagagcaaggctttttttttttttttttttttaactttatcagtgatctctctcggatagtctttgttccctgcctgccatgttggttgttgaaaaattaatctcggcagagggatttaactctaggttcaagtgataaaagctcagcagctagttaaaaataatatcttgccccagcaggcagccttttctgttagaagattatttccttgattcttggcaggtttgtttggcagctgtgggcttagtgggagacttgtgccgtgccctgcaatccaacatcatacctttctgtgacgaggtgatgcagctgcttctggaaaatttgggggtgagtatctacacacaatctaattaaccagtcttctttgaagaaaacaacagttggaaagatagttaaatatcgaccaggctgggcgcagtggcctgtaatcccagcattttgggaggccgaggcaggccaggagttcgagaccaacctggacaacatggtgaaaccccgtctgtactgtagatacaaaaaaaattagccgggcgtgatggcaggcgcttgtaatcccagctactcggaaggctgaggcaggataatcgcttgtacccgggaggtggacgttgcagtgagccaagatcacgccattgcactccagcctgggcaagaagagccaaactccgtctcaaaaaaaaaaaaaaaaaaaaaaaatcagtgacagggagctgtaagtttctagaacattggctttgggcttataaagaggggagttgttcatttcacagatgactctgaagaaagattgtaaagttaaaggaatgtgtgctctattagagatttttaaaacaaaacagtaaaatgcaaaggaaaagtaaatacagttgttccttgacttatgatggagttaggtcccaataaacacattgtaaagtggagaaatcatcaaaccatcatgagcaggggaccatttgtatattatacctctctccagagatagccatcattaattattgtacatgtgtgttctcagacaagtcacttgattcttaagtcagtctcctcatgtgtaaagtgggaataccaatacctgggctagcttcttagagttggtgtgaggtgcaaatgggaaaggttttgtaagctataaaggaccatccaaatatttaaaatcaatagttgcttgttagaaatgaaattttcatgaatctttggaccaaacaagttttgacttaattcacttttccttttgttccttgtcagaatgagaacgtccacaggtctgtgaagccgcagattctgtcagtgtttggtgatattgcccttgctattggaggagagtttaaaaaatacttagaggttgtattgaatactcttcagcaggcctcccaagcccaggtggacaaggtaagcttaaagctatcttggctgttctttaagtctagctctaattggagggactattgacaaacatgcagctaaaagtgatcagtgtgatgtaggttctgttctttgtgtcttacagtcagactatgacatggtggattatctgaatgagctaagggaaagctgcttggaagcctatactggaatcgtccagggattaaagggggatcaggagaacgtacaccgttgagtatacaacccagttcccttcgtccgctcgccaatgtgcacttagccaagtgggctatgtctgtcattctgtagctcgcttgtgaacctagtgcctgttgcttaaaaggctgggagaagggggagcagtgccctaatgaagagagtggcttggggaaaactgtagactactgtttttgctctgcttcttctttcttttttttgttttgagacggagtctcactctgttgcccaggctggagtgcagtcgtgcaatctcggctcactgcaacctccacctcccaggttcaagcagttctcctgcctcagcctcctgagtagctggaactatacacatctgccactatgcctggctaatttttatatttttagtagaggcaagctttcaccttgttggtcaggctggtcttgaactcctgatctcaattgatccacccgccttggtctcccaaagtgctgggattacaggcttgagccactgtgcccagccttttaaatttattttattttatttttattttttggagacagtctcactctcacccaagctggagtgcagtggagcgatcacagctcactgcagtcttcacttcctgggttcaagtgattcttatgcctcagcttcctgagtagctgggactacaggcacacaccaccatgcccagctattttttttttttttgtattttagtagagatgggatttcaccatgttttgcaggctgctctcgaactcctgagctcaggcaatctcccaccttgggctcccaaagtgatgggatttcaggcgtgagccactgcacccagccctctgcttctttttctcatatttcttgagtattacaagggatgggattcagcaaaaatgttggggggaagaaacccaacataaatgcttcctgtatcaaccatgagtggcaggtcccctacccctttcccatccccacaagctaaattggaggactggggagtcataattcccgttacgtgttcttgttgctgattggggaaattttttacttcaccccccttggtatcattagctcaggaaaaagttaaatttgtttcttctatatttgcctataggaagaggaatatttgtctcttctgtcgacttgaggaacgacacattaatcaaaggaagaataatttgatataactatatgcatctagttatccagcttggaccttgtatgataggggtataatagttggaaattttgaaaaaggatgtagtcctgccatatgagggacagctgcatcagaccttctctctcttttttttttcttttttttttgagatggaatcttgctctgtcgcctaggctggagcgcagtggcgcaatctcggctcactgcaagctccgcctcctgggttcacgccattttcctacctcagcctcctgagtagctgggactacaggcgcccgccaccacgcccggctaatttttttgtatttttagtagagacggggtttcaccgagttagccaggatggtctcgatcttctgaccttgtgatccacccgcctgggcctcctaaagtgctgggtttacaggcatgagccaccgcacccgaccaataccttctctctcttttatagcggatgtgatgctggtacaacccagagtagaatttattctgtctttcattgaccacattgctggagatgaggatcacacagatggagtagtagcttgtgctgctggactaatagggtaagttataccctgcttctaagagctgaatagaacttctcacagaaaatgagaaaacatggagtaaggagttttgagagtatcgcggatggcaacagttcacttttttggcacagagatttctttgcagaacgcttcatgtcctgttttgagtgttcacatgatagtttattccagaccctcaaggtgtctgtattacaccccattaaactctgatgttggtcaacaattgcctctgtctagtgacctctactgagggttttatttatctttgaaatttgctaagaaacccatagcactggtttggaaggctcaaaacattatactggtatggggctaggagctcattctcagctgtgtttgttttgcacagggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttggtaagatcttgcctccactgtcctctttcttctacttcctggaggaggggggtatgttttctttaggccattctggcaagcactgccttctggcattttttttgtttgtactttttcccatgtaggtgcttctgagtcaggcagcctcagtttttccttgagccaaatgtttgactcctcatagtgatggagagcagaacttttaaaactggaattcactgaaattccctgagtattttgggtcctaataaaatcatcagtaatgccatttccccctaattctcttctgttttctattcctttcctcatgccctattctttctttacagcagtgcttttagacgttgcctagctctagagaagatttccaaagtcaaatgtttttttgtgtgtgtgtgtgtgtgtgtgtgttttctttttgagacagagtctcactgtcgcccaggctggagtgcaatggcacaatctcggttcactgcaactgctgcctcctgggtttgagcaattctcctgtctcagcctcccgagtagctgggattacagtcacatgccaccacacccgactaattttctttttttcttttcttttcttcttctttttttttttttttttcttttggagacagtctcgctctgtcgcccaggctggagtgcagtggtgcgatctcagcttattgcaacctctgcctcccgggttcaagcagttctctgcctcagcctcctgagtagctaggattacaggtgccctaccaccaccacacctggctaatttttttgtatttttagtagaaacaggatttcaccatcttggccaggctggtcttgacctcctgacctcgtgatccacccacctcggcctcccaaagtactgggattacaggcgtaagctaccatgcctggcccagtttttgtatttttagtaaagatggggtttcaccatgtttgccaggctggtcttgaactcctgattttaggtgatccacccacctcagcctcctaaattgctggaattataggtttttttttttttttttttttttttgtatttttagtagagatgggttttcaccatgttggccagactggtcctgacctcaggtgatccacctttgtcggtctcccaggtgtgcaccaccacaccaggccttggctcctactttgaaatgcaatcttgtttgtttggagacagagtctcctctgtcacccaggctggagtgcagtggtacaatcacacctcatagaagcctccagctcctgggcttaagtggccctcctgcctcagcctcccaggtggttgggactgcaggcaagcacctccatgactggctaatttttttttatttttagagacaagatctcctgttgcccaggctgggtttgaactcctgacctcaagaagttctccctccttggcctcccaaagtgctgagattaaaggcttgagccactgcacccagactgaaatacagttttaatttctttcactcttaattagttatcttactccacagatctcagtaaaattggctctttgagtttccctcgcaccctctgatgtaggtgttaataagagcaggtcaatggcacataggacaagaagaaagagtgtcaatccttgaaatgttgacaaattccattcaggcctaggagcatgtaattgtaggagtcagcattattggctctgttgggtatatgtgatctcaaagattgacctttttttccatctgttttcagatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattttcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgttgtgtgaatacacacacacactaactagaagtcttgtgatgaaaatggcacttggaaaaggttttatttttccactgaagttgaaggttaataaaatggtgtcaaacgtcccctggtcacacacttgaatatttttttagaagtgtgatgtggtatgattaccataaatcagacttaattattttcccttttacaagggaacagggcatcctgaattttagagcctttcagcaataagaagggatgttggtgagctttgatcctcttttggttttgcagttgttaggagtttttgctggcattttgaatatgctgctttcagaaaaaccaaggaagttttaaaattgcttcctggtccttagaggactaaaaacaagaccctcattcccactttcatttccactctagcaaaaactgggcttgcgtttttctccaactcctcgtttatatcctcccttccatgtccaagccttccattcctaagtgggattggctcagttttgcccatccatatggcagcatctctaatagctcttgtacagggtatcagatattgtgccttttggtgccaggttcaaagtcaagtgccgatctatgaaccagtgtacaaaaaaaaaaaaatccaggtatttgaaggagagacgctccattgtgaataaagagctcataccagctcctaagccctattaagaagaggcctggtcctctaatgccttgtttccatttcagttgttctttgagagacagaatgatgtactaaccattcgtgattattaagatagggttgggtcagggcttagggagggggcagaaatattggggatagaaaaaaaatctgatcattcctcagtgctacccatttctgtcctgtgtgggctgcttagctagacagcaggagaataaagtacaccgagaaccataatgaaaaaaccttccgtgtgttttgtcatgttttgttccagggaagcagttgatgagtgctgttactaatgctttctcccagatccattcagtggtggagaggaggaaaatgggctggttggatgtggtcttggtgccttgcagttactctgcactggttatgcatttaattctcctcttttctagttaaccttttgccagtgggttttccatagtctgggtatttgtccttatatcagttataccacctaaggcaactgggtgcaaaatgcattctgttcactcactgtctgggccttccccaccctagtcttggcacattccttcaagaatgtagttaccgtctgcttgggaagatgtcagtgcaaatgtgaagataatgggcatcggactaggctttggtttgccacaagtggcagctgcctgtatcaattacatttattaattttgcttttcatttttcccagttctcctcaccccccctttgttgaaatgttggacttgctgtcagaggcaactgtaatattgccttagggacttgtggagaaggggaattgctcagtgtagtgttttaactttcagaaccaagcaatctatttactcttacaaatatttaagaagtgtgttagtccaactttaagaaaaatccaaactcatcagcttttgatagcatcttggtttttgaaacaacttcaatctgtaattggcattcagaatgcccttggcatgccagtctgtgatggcatttaagacctgtaaaacacttgagcccaactcgattaaccaaaaccgataaccaccacctttatcttctaaataaagtccgctttatttttattttcaa

SEQ ID NO: 460 - DNA, 7164 bp, Homo sapiens
aggaaggtagtgacgtcataggtaaacaggctctgtatccgtggcagcggccgtggcaggctggctgggtaccggctgtcgctgacccaggagaagctgcctgtctacatcagcctgggctgcagcgcgctgccgccgcggggccggcaggtaggctgacctcgggtcgggggacgcgggcggaccaggggcgagaggagcctgacaggcccgcgtcctgaggaaaggcagtaccgggcggggagagacgtgggaattccgccccactctcaggggggcgctttcacacccagcttaggcctggagtttgatgcgttgatgcttgccacgatcttacgaggaaactgcggctcggataagttcggggagtttacatagtaaagagtcggctcgcagtgcctcgcatgcatctgggagagccggggcgcagaaagtatgccaccgcctcatgctcagggagcttagtcccagctcttgggccaggtgttgctcagatgctcagacacgcgtgtgatgggagttggtagataatctgtgaactctttccctgcacctcttcttccatcttacctatctctttaagccagcccttccaatcagataggtgggccaagccagattcatgggagtcatgcctgacttgtttttctcttatccccaaacccccacattcagtcagtccattgctaagccccatcacctcgacttacaaaacatctcaactcggaacacttgtgttcggctgccagccttggttactgcaatagtctcctgtttccacggtcattcattccacaaacatttactgagtgccagttatgtgtgggcaccatgctaggtgctagggttagagtgatgaacaagaaggtacttggggctttgccctctcttgttccctccaatcggttctctcaggctgagcaagagtgatctttctaagtctgattttgttggtctgctgagaacccgctggctgtcccattacccttctgataaaatccaagctcatgactgcgtctttcagagccttcggtgatccagctgttgtctccctgtctagcctcattctgttcccttctcttgctcagtctctgttctcggaatgcatcaaatttcctgttgcctcaggatcttcacatacgtgtttccttctgcctgcaatgccttgcttcccctttcacttgacatacttttggacagtctttaggtctgtttaagtgtcatttttttcagaaggcctctgttggccctcccctccaagtccgccccccatgaactgtgtcctcctgcagcacttcacacagcaccatgtacttttccttatagtaatatcacgatttgtgattatttctttaccatctgtccagaggcattgttttcactagtctgtccccagagcagggactgagtggatgtttctgaataaatgcatgctctcagggaagggggtggaagttgaagcagatatttgctccctcatgttacttcaatctttctggagcagctggtcagattaatgacctgtagctgcgaaagacagattttttggttttttttttgagacagggtctcactctgttgcccaggctggagtgcagtggtgtgaacacggctcactgcagcctccacctcctgggcttaagcgatcctcccagcttaccctcccaagtagctgggactacaggcacctgtcaccaggtctggctatcttagaaatcttttgtagagacggtattttgccacattgcccaggctggtttcagactcctgtgcccaagtgatcctcccacctcagtctcccaaagtgctgggattacaggcatgagctactgcactggccagatctttttaaaaagccctattttaaggaagctacagatgaacaaaatgcttcaaaaggatgatgctagctcacttacatcagtggattccagtgaggccaaaggccagagtcgtctacagacagctcatagacatgtattagttggcccatgcagtgttggatgtgggttttcccccttacttaaaatttttggattacataccaacattgaggtactggatttctggtcatcttaaaaaccagaagttctggaaacagtgagacttgattattttccagccattgctcctccttggcacacctgccctggacagccaaccccagaatcaccccattcagaacaggacttctctaaggaagccagaagggaaacagctgaggctgggggcagtgggggcagagggaaggggctggtgcaagtccaggtgatggtagactttggagcacctgggttttagaattggcatagcagccaattgctagatgtaagtagcattgcctccctttttaaacaggtcataaagatgtctatgtttaattgtgtgtgtgtgtgtgtgtgtgtgtgtgtgtgtgttttgagccagaacaagagtgagttttcagtatttccttcctagaattgaggcatcctttggaacaggaatgcaaggtggcttggtaagggagaagatatctctgttagttctctgttgcctacagaaaaaatccaaactccttagcttggcatgcagggtcttcctggtctggctccagctcacctttccagctccattctttttcctctcgtccttaggtgagataggtcctttcagtgacttcaggcctttgtccatgctgttttctctgcttggaatacctatccctgttctcctgccttgatatgttcttgctgatacttcattcctttttgtgttttctgctaggaagagaatgacccaactttgattcccaattcaggcaagcatacgttttgagtaatattcttactcctgactttttattttttaaccataatttttaatttactcggatttcctttatttggtttttgtgttgttccagtatatgtatttgagaagccttttcatgtgcttttcagtacataactggtgatatataaagtaaatacactgatggcttacaacttagttcacatgtcactccttcattaatggctctgtcctcctctggctctttactgatgtttctaaacaagcatttaacgcagtgtggtttttcagtttccgtgtctgtcttcttccagctgaactatgtgctcttcagggcgggcaccgtgttgcattcatctttgtacccccagcatctagcagtgttggcatgtagtaggcactcaagaaatgtgtgttgaatgaacgatgcctgtgacaagcaagcggactttattctttcctgacccttgctcctatgacacacctcctcctgactgccactgtcactccttcagagcagaactcctctagggaacctggatgggaaacaggtgaggctcagagaggtggtggcagagggaacggggatcctttggaacacctgggtttttggcattggtgtccaagggcaggagtggggctggcttggcagcaggcatttccttgggtggctgggaagtgatgaggaattgggcctgtttctttacagccatggccaaggacatcctgggtgaagcagggctacactttgatgaactgaacaagctgagggtgttggacccagaggttacccagcagaccatagagctgaaggaagagtgcaaagactttgtggacagtgagtattggggagatacagtgccactcagctttgagctgccatttcaactgtaccccaggctcatcttggccctgccacagtggagctgctggctccctggaggttgaatctggcgtctgtgagttcccacgtgccacccttttctgtctgccctcttgtgctctcatgtgtccccaacagggcaccagtcaaaccaaacaccgggatggggaggggagggtgtctttagatatgccatctttcatttcttgctcttagaaaccttaaactttctgggaacacaaccatggcttgggtgtgggaaatagaattatgtactcatgatttgatttcttcagagaaagtcttctcaggggcaggttctctgttatttggagttagaagtgataggtgaagtttctagaagcagctcaacagacttactgaagtcatcttttggctggaaatcttcaggaagcctcctgtcccagcagccaagcaagcccaatgcccgtacagagccagatctagctagaacaagggacttctgagctttctggggggtttcctaggttgtggagagagcttggttagtgaaaggtagcttgggttctgtcactaacctgtgattgctgtgccatgcacacacctctctgggccttagtttcccctcagtaaattgtcacatccaggacattggagaaagtgagtgggagattaggcacttaatgctgtgagcttgcttttttgtggttacaagtgggaagcccccatccccactgttaattgaaatctggtgtcatacctgtagctagtccagaggcagcgcttgtgtcctgaggctgcccttttgtgaacaacagtgcttcctgtcactcctggggaagcagggttggggtctgtctggagaatgagcccagcaagggcctagtgctttcatagccggaggtcatagcggctggctggctcagtggggatgcaaggtccgagtatgccctggtccagctggccacccttctctaggttcagaccaagggtaggagacaggccaacaggcaccaaagtgtttaagcgacagggtcttgctatgttccccaggctggaatgcagtggcagttcacaggcatgatcacacatcctctaactcctgggttcaagtgatcctcccacctcagccccctgagtagctgggactacagttgctctccaccacgcctggcccacaccgaactattttaacacaaattagaaggggcagtccgctctgccctctcactgccttagcactctaccgaaggggagtgatgatactaaggaaatattttattttttgttcttttcctaaaagaaattggccagtttcagaaaatagttggtggtttaattgagcttgttgatcaacttgcaaaagaagcagaaaatgaaaagatgaaggtaagatcagcatgtcttccgcctacatcttggcctgggaccctagttcactaccctctcatccctcttccctcttgatttatttagaggggtagagggctgggtgggtgaatttttatttaagattttaataacttctggtccacttaacctactgaacttttgccaatctttatttcctttaatctttattttttttttttttttgagacagagtcttgctgtgtcacccaggctggagtgcactggtgcaatctcggctcactgcaagctctgcctctcagattcaagcgattctcccacctcaccctcccgagtaggtgggactacaggtgtgtgccaccacacccagctgaggtttttgtatttttttttttttttttgagacggagttttctctcgttgcccaggctggagtgcaatggtgcgatcttggctcactgcaacctccgcctcctgggttcaagcgattctcctgcctcagcctcccgagtagctgggattacaggcatgtgccaccatgcctggctaattttgtatttttagtagagacagggtttctccatgttggtcaggctggtctcaaactcccaaccttaggtgatccgcccgcctcagcctcccaaagtgctgggattaaggcgtgagtgactgcgcccggccatttttttgtatttttagtaaagatggggtttcaccatgttggccaggctggttgcaaactcctggcctcaagtgaactgcctaccttggcctcccaaagtgctgggattgcaggtgtgagccaccacacctggcctcgtttcatcttcatatcagcactgatgtagatggtcttatcctcattttataaatgaagaaatgaaggcttacatagtatgattggtgaaaggcacaaggctgaatggcaccaccaaatgtgctattgtgcctgtgtccctggctctaggaatactcctagacctgcctcaaagctgccgtctagttcttgaggcactttgtgatcagtaggttaatccttctgacttaacccaaaagctttggggctccactttcttttcctctctgaagactgacacagctcccagataacccctccccactttgaggacttgatgctgtagatggttttaatgaagccatggccttctctggcaatactgtaggccatcggtgctcggaacttgctcaaatctatagcaaagcagagagaagctcaacagcagcaacttcaagccctaatagcagaaaagaaaatgcagctagaaaggtaagaagtcatgatgtaaagcaagttctttacacagctgaatttccactcttccttctggaatgatcacttcttgtccttattcttcatcattgttttcccaggaatagcatctcacttgtcatcctgatttgaagattttaaaaaataaaattacatttgatgggaaggaaatagaaaacttgttaatatcaaaccacctctagtagtttgagcatgaaagggtccacgaagttggctggctctctgaaagaagactttcctagggctggagatttctcatgggtggctctgggtagggctttgcctctttctttcttcattctgaactcacaccatttcttgaaatcatttaaacctctatatccttctctagaagaattaggtctgtggtttacttcatctttttttcagggcctctaacaattttgtttttcaggtatcgggttgaatatgaagctttgtgtaaagtagaagcagaacaaaatgaatttattgaccaatttatttttcagaaatgaactgaaaatttcgcttttatagtaggaaggcaaaacaaaaaaaagcctctcaaaaccaaaaaaacctctgtagcattccagcggcttgaccaatgacctatgtcacaagaggtggcgtgtaaggaatgcagccccctgaagacagcactacaagtctgggggagccagttttaacatcagtgcacagctgctgctggtggccctgcagtgtacgttctcacctcttatgcttagttggaactaagcagtttgtaaactttcatccttttttttgtaaattcacaaagctttggaaggagaagcaataaatttttgttttcaaatgg

SEQ ID NO: 461 - DNA, 33042 bp, Homo sapiens
gagacttttaatcatctatcccttgtgctttacgcagaccctacaatacactagaggcttcaaagaggtcaaaaattcacatgtgtagacaaattaggtcccttaagatgccaggcaaacgaagtgctaccaaaacacgcaatgactgtcctaaaagtgcgttctgggatacacctgtaaacttggatcaagttccctcccctctcctcaaaatatatcgacttgtgctgaaagaaatcacgaccgatgctcacaattctgacctcgtaattatatagggggtggttttggtttctgcgtctttccctgattcagtggcaggtaacatatttcatgtacaaaatgaactgcaacaccacggcaaacaagggacaggccctcaaagttgtcggtagggagccaggaccccgccagtggcgtggggagacaccgtactaaacaagcttgcaaacagcaggcaccttcctgccactgaggaggaagggctggctaagggaggccggggcggaggaagccaagctctgcaggccctgacaaagtcctcccggcctccacgcgtcgccatggcaacgcggggtctgtgctggccgggattggccggcctggcgcgcgcagggcccgctgggaaagcgcgtccccgccgcggctccgccagtttgaacttggcgggccagatgtgggcggcggggcgctgggggcctacttttccctcttcctacgccggtttctctgctgactgcagacccaggtctcggccctcctcggactcctgctcagtccctatgacgggcgcacgtgggcaggggctggaggtggtgcgctcgccgtcgccgccgctgccgctgagctgcagcaattccaccaggtcgctgttgtctccccttggccaccagagcttccagtttgacgaggacgacggtgacggggaggatgaggaagacgtggatgatgaggaagacgtggatgaagatgcccatgattcagaggccaaagtggcgagcctgagaggaatggagttacaggggtgcgccaggtaaacccgaggccgcccggccgattcagcccttttcaagattccttagaccctcttaagtacccccttctaacatcctcctgccctccgccccaaaggcagagcaggcacttgcagactgaggtgccgtggttttttttgcacataaagagccctgtgcaaattcttgcaaatgaccatagatttcctatggctcttaatccttttttcctgagatattatgattgctgcagtctcacttcccagaaaaatgtacatagtctcaaacacacaaaactctgctaccatttcaggcgttctatgaatcctcaaaagccagattgtgcactgcagaactcttatcccaaacctgaacaccagaacgtggtttactgcaccttagtagtacctgtggttggttattctgaaaacatactgattgctagtgaagtaggttgtagtaaacaggtcactttttataacataaagtgctgaagcacagagattagcaatgtcaacctcagcatgtggagacgtggttagagaggatctgagcatgcacagaggaatggatgtcattgtatcaatgttaggaccaatggggttattaaaactgtcttaatttgtttatttctactgttactcactcagcaaacattgtttgccacatattagtctacgtactggggaccgtaaacaagatactggtctctactctcatgaattgaagcctaaatcaatccacttattttacagataataaaaccatggctcagaatgcaaaaagtgactcaaaggcatgcacctagttattagcagacctgggtctactacgaagatagacagatcatgttctctttcctaaactgcatgcctagtattgggtatacagaagtaggagcaaagggccaatccctgaaggaatatttctgagacaggcccagtaatgcaggtctattctgggatagactcattacgttttcttcggaaatcatttacaagtttatgattgtcaagctgtgtaaggcacagtacaggagctctaagaaatacaggccagagaactcatgctttatgtgtaaatagcaagattcccccttcagtacagggtgttcatatccagcatgagtgaatggaatatggaacccatatgaagtaacccgtatacatggttacaggagtgaattagttacgaatgagaagtaaaagtaagtacattggtgggaatggagatcagaaagagtaaccaagcaagccactcatccaggctggttgtagcaacaagaaacaggcctcctctgatcaacctgatagtaaaatttaatggtagagttagggtttcagtaaattgttttcatctgggcctttgtaggtattcttcaggactgagttggtctcaaaggtatttaaagtaaatttgaaggctttaggaaatactttctgagcataatcaactggactaagcaatctggacacaagttagtgacctgcggaataaatgaccatcggaactatagctcagctactgaaaccttgcattagtttccaagagccaaagccctgactaagtggagcctgccaggggaggaggtgaacgtatgtacgtctcacttatccaaagccagaatgagctggtagcaccacagggctaaggctgccttccttatcacatttcagtccctatgaatcaaaggagtagctgggacgtgggtttgaaaagagaatgctgaagttgtcaagcattgtgtgtggcaagtgtcagatgcttattaggtgctcaataaacgtttgctgactgcatgtccatttcccacttcctaaagaacagatacatgcagtgattattgtcaaatgcttcagaaacttagcacttcctttcaggaaaggtagatttttagaaaatttcctcattctttctctccattggtcctaacattctttgatacaatgacatccattcctctgtgcatgctcagatcctatctaaccatgtctccacatgctgaggttgacattgctaatctctgtgcttcagcactttgtgttataaaaagtgacctgtttactacaacctacttcactagcaatcagtatgttttcagaataaccaaccacaggtactactaaggtgcagtaaaccacgttctggtgttcaggtttgggataagagttctggagtccacaatctggcttttgaggtcaaactgctgacctctctttggtgccctggacagcttgggggtgacaggatgaagagagcaggcaacctgagtcagccctttcattgttctgggttttgagtattctgtgtgaagcagagagcaacctagagctgtgtgggattttatgccttttctccatgcctcacctgccatattgatctgactggcaaaacgaatcgggtaaggcttctttgagctaggctcaggcatcagctgcacataatggatattacctcaaggtatttttggtataaatagtgccatgtttagaggatgcattgaccttcaagggtattggtcagaactgagattaagctcaaagttagcttcagacaagataatgagaagcgttttcctggaatattttacaatgtgctctgggcctgctgtttattcagctttatcctggtttttctaccactatccattaggaaaaccatgctgtaataaatatcttgttcacaaatggccacttgtcaagcctttcttgattataagtagagctgtagtgtgtgcgccacacattttgaacacatttgttataaatattaaggaaggaaatttaatattcaaagtgtcatttcttaaaagaaaagcccactgatctgattgtctttcaacaactgtttcctaggaccctactatattctagaccctaagccaggctcttgaaataaaaaaatgagttgagatatattttctttaaggaactcatgacctgtggcagagatgagcaagtgacaggaagcccaagagttgtggctccaggcagtgctggagttgaattttgaagggacagtaggagttcgtcataaatgacttactaagtacttactgagtgcctggaactatattaagtgctttagcatggatagtttcatgcaattctgcctgtaaggtagccagccacaactgtcatctccattttatagacaagaaaacagaagcttaaagaagttttttaaaaaatgtacatagcttagctgggcgtagtggcgggcgtctctaatctcagctactcgggaggctgaggcaggagaatggtgtgaaccagggaggcggagcttgcagtgagcggagatcgcgccactgcactccagcctagacgacagagggagacaccgtctcaaaaaaaagaaaaaaaaaagaaaaaaaatgtacatagctaggaagaagcagataggatttcaccccaggctgttttacgcccaaatctaagctcttaatctgactttatgcggaggtggaagaaaggaatttcagatttaggtgaaagttacagggcatggggcgtggcacattcatcaacctgcaggggttcctagtgagtgaaatgtagagtctggatcagccgttggtgaaagaagaggctggaagataggcaaagggcagattcatgggtgtcaggctaaggagtttggattttatcctgtgggtaaagatgccattgaagaactttaagatgaggagtgacatgatagaaagataacatttgagggatgaatctggcaagaggtgtggataatgatttgaaagggagaaagggaggccagttttgtccagatggtggttgtaaggttggaggaaacaagaatggctttcaaaaatggaaagaggaattaacatgactaggtgatcatgtgggtatgggaggtggtggcggtggggggggggggtccacatgttgacaaggagcaggtggagtcaaagagctagggcttctggcttgagtaactggctggagggtgataacattcactgacgtaggattgtaagaggagtatactttcttggtgggaagggtggtgggtggatggtagaggatgattagatttgttttcaactgattgatatttaagttgagttatgtatcacatagttggaaataaggatctggaactcaagatgacggtctggcctggaattactgatatagacatcatcagcatgtagtggtagttgaaactgcactacagtgggggcagatgggttccttctgcaagactgggaaggaaagacgcatataagaaataacacatcaacagtgtctctttcccactagaatgcaaatttcataagggcatgaatgaatgaagaaataatagtagcagaaaataatgagtaagctgaatctatgaagtagaaaagttgtgcaaagcagtgggtgaagcaattggttgctataagcaggaatgtgaaagagacaaagaactgagtctgtaataaactagtctttagagctaccttatgtcctgaacaaccttgctttctatggctgctgattgttaagctttttctcagtttcatgaggcttgtgtatctggccaagaccctgtgttctttatttatgtatatacttatttccctgcccctcttctctttaccctgaattgttatttttccttaccctcagaagagacagactgacagaggtgcatggtggagatggagactatggtaggaggtaaccagactagagagtcatacacaccctgtctaaggattggcaaaagggtgtcaaccaaaatgttaaagaatgttttgtggcttcttatttcaaaacaatttcaaacttataaaaaaggtgaaataatataaagaactttcatttacccttcacccacagtccctaattgttacatgtttgctctattattctctttgtgtgcactacataatctttttttcctgaactacttaagggcgggaaagggaagagtctgcttcagtatctgattaggattatatgttgtaatgagtaattagttatccaggtaagatttttagaaataaaaaagtgttggcattgaggcaaatgtatagggtgtgggttatcccaatggggttttaaataacgtggttttagaaggtgaaggaattcaaaggcagtttgataggtaaactaattcaaatattagaatttcttttcatgattttttaaatgtatacttatgtataattcctgtatatttgtaaaaatcacaatattgaaaatacactattaagttttgcttttactgtacagttaagtgatttggactaggaagcaaaagaggttcttgtacaagtactatagtagcctctcttttgtagcactcaggttgaatcagaaaataaccaagaagaacagaaacaggtgcgcttaccagaaagccgcctgacaccatgggaggtgtggtttattggcaaagaaaaagaagaacgtgaccggctgcaactgaaagctctagaggtaaaactagacagtgttctttttatttaatctgtgagctcacaaagtagagctgcagttgtaaattaaaatgttaatgttattattcctgaaaacaaagtctttgcatttatgttagtttactatatcaaatttaataactaataagttataataatagaaatatgttcattgttagagcatttggaaaatacagctaagcataattaagaaaattaaaatctcttctaatttcactgtctgaagataatcattgttagtattatgacatagctttccagattttcttctatgtaaattattttgaaatacgtacaaatgtatgtataagttgtatgtctacatacactggagcatcaacatatgtacatttaactaaagtaaattcaactgtatacactcggcaaaatttttaactttactgaaacaaaatagaggcaagaatctacctgcccccccccaccacccccaaccccaccccaccccaccacccccaaccccaccccaccccaccacccccaaccccaccccaccccaccgtgtgtcactcagtgagcatgtgccctatgtgctgggcggtgggaaactgcttgctagtctttcagggtgtttcagtttctctgtgcctccctcacttatggacatttccatgcgtgagtctcttttgaacttttactatatgaactcaaaaaataaatagttgtagatgcattttcacatctcttctttaatgagaatattcacatattttttgaactcttactgtttcagaacatggcaaccaaatagatttggataatttggcatcccctaaacccactatctagactatctgaattcttcctatccaaacactgaagccagatagatttgaatgatgagggacacttcttctttttaatgaaacaggataaaactctttttctctatcattaaacatttttataacatttaaaaatggctgtctaatattatttaaatatatttaaaatgtattacatatttgttaaaatatagttatctgtttcactcttgttggatgtttcagtctattagtaactgttgctaaaaaaaaatcctgggaattggccgggcatggcggctcacacctgtaatgccagcactttgggaggccgaggcaggtggatcacctgaggttgggagtttgagaccagcctgaccaacatggagagaccatctgtactaaaaatacaaaattatctgggcgtggtggtgcatgcctgtaatcccagctactcaggaggctgaggcaggagaaccacttgaacccaggaggcggaggttgtggtgagctgagatcacaccattgtactccagcctggccaacaagagcaaaactctgtctaaaaaaaaaaaaaaaaaaaaaaaaaaaatcctgggaacaaaagcttcatgatcttccttagaataacttttctgttagttttgaaaccagttattatttgataagtttctaaccaggcaagcagtcacatgtcccagaggcttggcataattcaaatgattatgaaaactaatacattctgctgttttcctattgtatgatactttgtattctagattacaaatttattcctggaaaagtgcgctgtgagagtggcacttatttcctcttgacagtacacagggcttgagaaagaccttacggttgatgttaggcaagaataataaaaaccctggttctttttatttgctgggtgtaagcaagttattgaaacttttatgtttctattttctcgtctgcttaagaggaataaaataatacctgtgtcacaggggttttgtgaggattaaatgtaacaaagtataaagatgcctggctttgtttttatttgtattgttatttatatcattactattcatagtcttcttaaagctttttcatttattttcagaattggggtgtatttttgaattcccagacttacttctcttacctcaatgactaagtccattatttagttagtagcttttaagaatatttgttcatagtgagcactctatttttttatgttataaaaacacatacctacatatatctctctatatatatgtatttatacatatgtatgtgaaatagcatcttaattttgtgcaaaacctggtattctattcttttttcaaaaggctggtcataattcattaaattggttttaaacttacaattcggaaaatactgatcctgtgagttaatggtagaacaaaattcaatttctggtattgggctttatctacagtctcacaagaagttacttgttatattaagaaaaggagggtcacttccagtcatttttagtcagtgtacagagagaagttaattgaatttcagaaagttagtaaagcccgggcttggtagtcacacagaacaaggctgaaattttagccttgccattctaattctgtgacattagaaaagttaattaacttctctgagcctcagtttcttcatctataagccagatgttagagagacaatagtggagtagttaaaagtgtaaattctgggttttgttttcgttttttgagacagggtctcactctgtcacccttgctggagtgtagtggcgtgatcacagctcactgcagctttgacctcccctcctcttccacttcagcttcctgagtagctgggactgtaggcacacgctaccacgcctggctaatttttgtttttattgttgtttgttggggtgggggtgggggggttgccatgttgcccaggctggcctccaactcctgggctcaagtgacacctcccaaagtgctggggttacaggtgtgagccacggtgcctggtttaaaaccataaattcttgagccatacttcctgcattcaaaatttggactttgggcaaatccttaacctttctgtgtctcaatttccttatcagtgaaagggggaggataatatttgcttcatagtgttgttatgaggactaaatgaacatcaggatatggactaatatgtacaaagcactcaaagttattatatgtgaaaggagatcataataactgctatgaagatttgttttgagaacagattaaaataataaatataaaccctatcacaatgataagcatgtagcagggtataattatttgtaatttggttcaaagattaaaacctttttatatatttagtagtttgacatttcttatggctactttattactcaactctgaagtgattcagttttagcatgactcttacatatcagttatgccagggatatcctaacatataggccaactactcagcttgttgtaagctcatgttgagctcttgtggtattcacattctttcactgccttttcctttattttgtttttatctcatgttttccttatttttctgtatttactgtatccctaatttgtttataaaccatatcaaatttttaaccataaagaatagtcatctcagatccctattaaaactaaaaagcatgaaaggcagaaaagtaattttgccaaggcttcgtccatggcagaactgggactggcacctaattctttgacttccatttaaatgcttttcccacaatatcaagatgtattttagaaataagtgagtcagacttagtatttattttttaatgaactctggctttcgtattttcttcctttaagatttaagagaacatttgtaggataatttaatcattaaaaagatcatccacactcataaatttgatttgagcatcagacatttggtttgtttcagacatctctgtgggactaagttaaaaaattattttaattcataaaaattacccacttacaaaatggtatacatttgtaacttttgttgagatgataaatatggtaaatattgaatcaattatcaagcattatgaaaaactagtatattggttttataggtcatttaatttttatttactttttaattattataaataattatttagccaactgctccaggttctctatggtcattggctgattctaattcttaatatttgctttaatattataatcagttgtaaattataaaaattacctagtttgtgagtagtcctggtgccttcttttttctttttttttttaaccatcttgcctttggccattttattcattagcccttaatgagcccttaacgaacgaatagggcaggatatagagctgttggtgaaactcaaaactgtcagtttttctgattattattaccttcagtggtaaaaaattatttgaaagtaggcaaaacctattaaaataaaaatgcatgtttaagatcttctttggattttggttttccataatcaagtgttgtattccacgggaaaatattaatagctatctgtaatcctgttgaaattcagtggtataccagaagaccatgtaggggcctttcgaaggaagactccagctgtgtcctgaaggagactggcctttgtggtaaacatggagtcattcagggtgggaaattctaagaagggccagacttggaagggagggttgtgtctcaaaatgtgatgtatattctggtttgacaaattacttgaacagacatccaagattagaacactgtttgggttattggtagcattttctagatacattttgaccctttttctttaacccttcaatcaacattaactaaaatttgttagccatcaaataggagtacagggtttctttttttctgattttttagtttaggtaaatgaagaatcttaaaaggtacataaatatatagtcaatcatgtctttagttatacatttaaataattacttttcttgaaaataaaatttgggactattttggaaaatttttgatatgtagttgtcaggtctatatctagccaattaattaatgtctttcatatttatatatttgtatatatacacacatgcacatataaacatacatatatacacatgtatttgtatgtgtacatgtatatatatgtataatttttcccccttttgtttcctaagtccaaaccctcttttccttttccttttcctttttttttttgagatggagtctcactttgtcacccaggctggagtacagtggtatgatttcagctcactgaaacctctgcctcccaggttcaggcgagtctccggcctcagcctccccagtagctggaattacaggcgcctgccaccacacctggctaatttttgtatttttagtaaagacagggttttacgattttgcccaggctggtctcgaacccttgacctcaagtgatccatccgcttcagcttcccaaagtgctgggattacaggcatgagccactgcgcctggcccagaggcccaggccttctttttcttataactcatatactatggcacactcttcgtcagtcttcctcagaatagttctcatcccttcaaatgcagtcttcagcctttgtcattaagagctctgaattttcccttttgccgggtattcttgtttcatatagttcactttactttgcctgtctcaaaagaccttctccatctacctagtaccacgctcaaattttctaccccctcccacctcccaatctctctcctttcgaagccatcttttcactgttccttgtatggtgctcatttctgactagcctggtagactaggctagggggaaggaaagatgtttctcctcatcttcccttcccttctctgaacttttatgatatgcaataactcgcaatgtagcacttatttctttagtgtatagaaaatcagatcagagacttctgggatttcatctttatatcagatttatatcagttattgctaggtccatagtaggtgtaccataaaagtatactgagtaagtcatcaaagaacaatagctgctgaagtgatgaaaaatccttaaagatggatatttgcttttgggggtatagtgtttaaaagttggaagacttcctgagtgagggcggctatcttctatgcagcagaattttaggatgagtgattatggaagacagatttcctgtgaccagttgtttaaaatgcaaaagagatgttcttggtgtcaagttttatcttcatttaagacactggaattagtctgagggttggaaaattgtctttcccactaccacccatgcccaagtaggtaggtctttgggaaagaaagggctatggaggagtgtggagaccaacagaagatacgtaaggtatctgactattagtatctaaagacggagaagaaaaataaccagtaattatggttgtggagtcctagtgaagtctagtttgaacagcattctaaaccaatgcagtaatttaactgatgagtgacagagtggtggcattcaacttgtagttttatttggccatacctttcacattctttttcctgaggaaatgcccaaacgtgtagattcgagtgacagcaaggcagttaaataatctgggatatgaatgtgattttgttttacacttcagcagctataaaaccagtgaagaaaactctgggttcttttttccctaaggaaaattgaatggtttctttgtatttcttttgtgtaactgaattaaatttttaatatagggattatttaatttctatgctttatcttcatcaggaatccagaagcttcttataactgtttaaaaaaaaaagttgcaattctcttgagcttctgccagtagcttagagtgatgccaaaatttatgtgtgggaaagttgatttcaatgagggtaatttagctgaagtttagtctaggaaactagtgttttgctgccaagcaattatttgcacatttctaaaaaatgacttatacttttaccaatgctttttttcatcatagactggttacttaagtaagttattgccactagtggcatatgctccataaaggaaactatattcttgtttaatttggttaataacctcagacttttaaaatgtatgttatttgggtacttctattaaatgttgccttttgtctaaataaaatccacaggaattaaatcaacaactagaaaaaagaaaagaaatggaagaacgtgaaaaaagaaagataattgctgaagaaaagcacaaggaatgggttcagaaaaagaatgagcaagtaaggaggggaaaatggatacacacattgacatctcttttgcaaaatatttcttcctattatacttcattacctaggttttaaaaaatacttctcttagagtctttcttctttggcttgttttgtttttctatcctggtggacatttatcaagtctctatcttctgccctttgccctctacttttctcctttttccctcctgtggcttgcactaatatttgcctgcaggcagtcaccaagtctgtatttctaggcctgaccttttggatccttatggcaagtgcctccaagtctgcaaatctaaaacaacccattttgcccatttctccttcgtaaatccatcctcccatttctctgtttcattcagctgtcttctcggtcatcaaggcttaattagaattcttctgttgttcctaatcatctcctccttttctttacaattactactcccctgtttgtgatctctttccattatatctttcaacttgttgtttacttcttatactggattgtaagctacataagggcagggatttttgcctcttttgttcagttttccaggagctagatgaatacctgcgcatgatatatgtccaaaaatagtttaattgagtgaagatgttcattgaatggctgcattttttccttttaattttaatatattcttctatggatcacacacattcgaaattttaaaaatacttattctgtggtcaatttgtcttctgttgtgatttttacatatttagagtggtactgcttttattattataatccagttttacaaatgtggaaaaatgtttaaattgtaggacaatattttaaattttaattctaactttttatctttattgttgaatctaatgcctaatggtattaataagagtactaagtaaataatttcagtaaattgaagatgatataaccttcttcatccaagtattataagaaggaaattggttagatgtatgtgtgttataaccatatttgtttagaagtcaattactttgtttttttaaaaaagtttacttcatcccatgatataacatgaaagagatctttgtgaataaattcaaaaatcaaaataaatctctgtgactgttataaaactttgggtaatatctttttgaaatttgtaactataaaacaaaattattttacacatgcagaatagtttgctctttcctctaaaagtccttcttatcttctaactccattaagctaattttaccatgccaatcaaacctagttgttgtttgtctaggaatgtaagatacttctgggagacaatatattcactgttttaattagtggcagtagacctaatccaattatttgaagaaaaaaaaaattatttcttttggagggaagtggcttgccctgacataaatcactagttattgaaggcaaaattccgtaatgttgagaattatttaaaaataaaactgagacgttatatttacctgttctgcagaactcttgttcatgttaaggaataattgattattcttttttttttttttttttctttaagacctatcagatttcttctttcagacatagttacatttacctctatttgtaaagactgctctcctggttcttctcttcctgtctggcatctagcttttttctcctctgtttacatttcatggtgtgtggtcctcagctgcctccagcttcattcacattttagctgtatctgtggctgctattttctctaagtcatattcactgtgttttatcaaaaaatcagacacaaagaatttatgcattcattagcaaagctagtttcttataatatgactgtaaattcttaagtgcttttaaaataaatgttctatctcatctggtactcctaacatttgtgttgccgtggtaatttattttctggatgtgtttattacagtgttatcacatattttgtaaaaggtcctttacttttaatgtttttaaaaattatttaaaaataaaatcgtttttcgttctcaaaacacaactgattttctaatgtaagacattaattcagatcaacaaggtatatgatggataacactgttatcattgcattattcatgctttcaacaaatatttactcagcttttactgtgtgcgaggcactattggagaaagcaaaacagaaatccagaaactttaagtagccaattgttatgttagtttcctttagttgtatgaaacaaaggttctctcggtgcagcgtctttaaaaaaggaagatttattgttgtgctctgtgtggtgtagaactagcgtgccagaaaatctgaagccacttagtggctggttcctctctcggtagtagtgactgctctgagtgcctgttgtgtcttccttttgctaactaaaggcattctgttcacacttctttagtttaaatcctacagaagtctgtctgattttttttcagaattaattctattgagctgtagtttgcatacaataaaatacaactattttaagtttgatgactttggcaaatttaggtacccatgtaaccatcaccattaaagatacagaacatttccatcaccccagagagtttccttttgcccctttgcattcacccccactccctgcccccagccagcctcagctccaaggaaaccattaatctgctttctgtacttgtagattagagttgccttttctataatttcatataaatggaatgatagaatatatagtcttttgtgttggtcttttgttttaaaacttatcctgatatttcatgtattattcctttttattgctgactatagtattctatgaaatacatttcatagaatatgtttatctgtttcattcaatttcatagaaattgtttatctgttcactagttgatggacaattgagttgttttcagtttgggatattatgaataaaattctgtgaccactcatgtacaagtctttttgtggacacttgttttcatttctcttgtgtgaatgcctaggaactaaattactgggctatatggtaagtatgtgtttaactttataagaaattgccaaacatttgtctaaagtacatgtaccattttacatctccactactattataataagaaagttccagttgctccacatctttggcagatttggtatggccaatctttttcattttaagtccttctagtgagtgtggagtggtatgccattgttttaattttcatttccctgagatctgatgatgtttagcgtattttcataagcttattatattagtcttctagagcttccataacaaaataccacaaattgggtggtttaaacaacagaaatatatctttactcacagttctggagactggaaatcaagataaaggcatctgtaggtttggtttctcctgtggcctctctccacggctgtctttttatgtccccacagggcttttctctgttcacatatatccctggtgtctcttcctcttcttgtaaggacaccagtcctattgaattagggtcctacccttatgacctcatttaaacttgattacctctttaaagatgcaatctccaaatacagtcacattgaggattagggattcaacataggaatttgggagaggggcaggaatacaattcagtccataacatatattgaccatttctacatctcttttgttgttggcttgttttgtgttgttggcttgttttgtgttgtgttaagtcatttgcccatttttgaaggggttgtatggcttattattaagatatgagaatttgtatattcagactataagtctcttctcagatatatgtattgcaaatatttcttcccatttaacttttccttttttccttccttccttccttccttccttccttccttccttctttcctctgtcttccctcccttccttcctcccctcccctccctcccctcctgtttccctctcttctgtctctttttttttgagtcagagtctcactctgttgaccaggctggagtgcagtggcatgatcttggctcaccgcacctctgcctcccgggctcaagcaattctcgtgcctcagcctcctgaggagctgggattataggagtataccaccacacctggctaatttttgtatttttagtagagatggggtttcaccatgttggccaggctggtcatgaaatccccatttaatttttcttaatggtattttttttttcactaacaagaagaagcactgattaatggtattttttaaagagaagttttaaattttgatgaatttccatatttcagtttttttaattgttggtagtttttgtattctatttaagaaatggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcaattcctcagggatctagaaccagaaataccatttgacccagccatcccattactgggtatatacccaaaggattataaatcatgctgctataaagacacatgcatgtgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactgtcgcaaggacaaaaaaccaaacatcgcatgttctcactcataggtgggaactgaacaatgagaacacatggacacaggaaggggaacatcacacaccggggcctgttgtggggtgggtggagtggtgagggatagcattaggatatatacctaatgctaaatgaagagttaatgggtgcagcacaccaacatggcacatgtatacatatgtaacaaacctgcacgttgtgcacatgtaccctaaaacttaaaatataataataataaaattaaaaaaaaatgtttgcccaccacaagagggtaaaaatactctccactgttttcttccagaagctttatagctttagctttacctgtatgtctatttgagtttaattttaatgtatagtatgcattaacggtcaagattcatttgtttgcatgtggatatccaattgtcctaacaatattgacaagataatcttttccctattaaactacctttggcacctttgtttaaaatcaattgaccacatatttataggtctgtttctggattctagtctattctattgatttatatcctgtgcagtaccacactaacttgttagtatagttttatagttctgaattttattattcttgaaatcagatagtgtaaatcctccaggtcttcaattctttttcaaacttgttttagttgccctgcatctttccatatacagtttagaatcatcttatcaatttccctaataatgcctgtcctaatagtgcttggcactattgggattctgctaaatataaacacatagatcattttggagaaaattcctatcttaataatatcaaattttaaatctataaacatggtttttctttccagttatttatgtcttctttaatttctcttagcagtgttttttagttttcaatgtatagcagtattttgttaaatatatttctcagtatttcatgtttttgctgatgagggcagttatcttgccttgttcctgatatataatatatattttatatatttacacgtatgtacaacacaggtttatagcatatatgtaatgtacacatgtttataacatgtaacaatgcgtataacacaagtaacatgttatagcatatatgtaacacacatgtttataatatatagcatacatgtttgtaacatgcagcatgcatgtgtttataacatgcagcatgcatgtgtttataacatatacatatgtttataacatatatatgtttttttcccagccacactcatatggaacgtttctgatatcaccttgtaatttccatgcctggttttgatgtcagaataatgctggactcttaaaatgagctttgatatgtttactttttctctgtgttctaaaatcatttttttaaggtttgatactattaagatatgccacaataatattttatgttattaaaatatggagtatctttaactgtaatggaatcaactagtgaagctttcagtgactggagtttttgtaggaaagtttttaattttgaattgtttttataagtagaggattattcagacactactttttctcgaattcattttgggaagtggcatattttaaggaattttgacatttcatttaaaatattgaatttattggcataaaattggttttaacattctcccattttgatttctgtatgatgtctgtgtgatctgtcactcaccgtctctatgaccttaggcaaattagcctccatgtgccttagtttcctcctttgtaaaatgggataataatggtatctacctcacatcatgattataagaattgagagtgtgtacaaataaagtatgtagaatggtaacaggcatagttagcactcaataaatgtcagctgctataattaaaaacaatgtaagaactggttgatttcttataggtaaagttgtggaggacagtcatgagtcacatggagattaagcaagatgtactccaaggtccttttcaatttgtagatcttctgacagtttgaagtagttaaaatccagtattgttccaatggctattgagttctcagcatgaaaagattctgtttcacagctattggctgcccagcaagaaggaaatacagcaactttgatacaacttggggaattacttgagctttgatttttttttttttttttgagacggagtcttgctctgtctcccaggctggagttcaatggcacgatctcggctaactgcaacctccgcctcctgggttcaagcaattctcctgcctcagcctcccaagtagttgggattacaggcgtatgccaccacgcccaactaattttttgtatttttagtagagacggggtttcaccacgttggccagcctggtctcgaactcctgacctcaggtgatccacctgccttggccccgcaaagtgctgggattacaggcatgaacgaccatgcccatcctgagctttgatttttaagacctgtctttcctgcacagccctggacatatcttgtctataactgatgtttgttggttgagtcttcattgaattgcttatattaatgtattctataagctgctttcaagggaagaatttcttttcttggctcataattatttgcctgggtgatatgtatggcatttgtattgcatatactttttatgccttccagatttgtttccaaacctttgataaagaagactggctatgtcattggttatttagaatttagctgtgttggtagattatcatttaaataaggaggaaaaaatattgagttatagtctgtgtcaaggatcaatatttttttttctataaagggccagttaatgaatattttaaacttttggggtcatgcagtctccgttgcagccattcagctttgctgtcgtagtgcaaaagcaactataaacaataaatatgtaaacaaatgagtgtggccacattcctataaaacttcatttacaaatacaggtgatggtagatcagatgtgattgtcagtgcttagtttgccaccctttgttctatggaagaattatatagccagagatttgcctggatgtgcccttacatacagtgtttaatgagcattattcacttctcctctcttaattcactgatggcaaagatttatgcaaatattaatattgacaaactgtcctggaaatatgtgtgtgtgtatatataaaaatatatatacatatatatttacatatacatatatatacatatatttatatataaatgtgtgtgtgtgtgtatatatatatatatatatatatatagcccctgttttagaatgagagtaagcatccattaaaaaatactaagattcagacaatctaacagattgtaatttttactcactatcatttattcaacaaattttgattgaacactgtattagtctgttttcatgctgctaataaagacatacctgagactgggaaatttacaaaagaaagaagtttaattggacttacacttccatgtggctggggaagcctaataatcatggcagaaggcaaggaggagcaagtcacgtcttacatggatggcagcaggcaaagagagagagcttgtgcaggggaactccttttttaaaaaaccatcagatcttgcaagacttattcaccatcatgagaacagcatgggaaagaattgcccctatgatccagttacctcccaccaggtccctcaaagatgatatttgggtggagacacagccaaaccatatcaaacacctgcttttcactcagtactgccccaggctctgagtggacattggtgagcaagatctttgtcactgacctcatgaaacttatagcccagcaggtagactgacattgtactgttaattgcaggtatgttatatattttcataaaccatgttgtgccaactgccatgatatcatgtctatttttaaaaataattgaagtttagaaaattgctgaatgcagcagtctttccttagatgagtataattactggtattacaattaaactttatctatttttatttaagaaaagaaaagaaagagaacaaaaaattaataaagaaatggaggaaaaagcagcaaaggaactggagaaagaatacttgcaagaaaaagcaaaagaaaaatatcaagaatggttaaagaaaaaaaatgctgaagaatgtgagaggaagaagaaagaaaaggtatttttattaaagtgaccagttagaatacataactttggtgttcatatgtgtcaactatatcttagaaaaagtatctaatagaaaattggcactatcttagcataaaataaacacaagaagctatcctgttacgctgtgtttaaacttcaaaaatgaatatgcatttgtagttttcttaagttgagaaatagtaagcctgttgatattttttcagtcaggtttaaaactggttgctgttactccttttaaatatttttcagtgcattttatgggaagtcttactgccattttataaattactattctttgaaaacagcaaatacttttttctttgtgggtttgatgtcttattgtttttcagagccagacaccttaatgtatgtccatgatcatgttcaatattctactcatattataaaaatatgattcagtattatggccagtaagccattggggtaggaagctactggagaaaaaaaaatcagtagaatttgaatggaatgtatagttacagaatatccctggaaatattttggtcttgtcattttaaggaaaaagaaaaacaacagcaagctgaaatacaggagaaaaaggaaatagcagaaaaaaagtttcaagaatggttggaaaatgcgaaacataaacctcgtccagctgcaaagagctatggttatgccaatggaaaacttacaggttggtttttatgttgtgtggcttacataaatatggtttgcagaagcaaatattatactccttttgacagaaatagaaatgtgtaaaaattatttttctttcaaattactattttccagaagattatattataaacatgtcatgttcctatggagatgctacaaatgtactgtcattctccacatttgtatttcttaaaagcagtagttacaaaactgcaaacttattctttaaagtagtgatttgtaacattaagaaatgaataatgttctcttacattttttcagtgataaagccttaatcaggatatattttaaggggtcgttttgcctcctctccttctaaccctctctaaggcagagcttcccatgtccttggcacattctttgtgtgaggtagaatactagacagcacatgaaccagacacaaaaccgattggcctttagtcttggtctgattataaagggtagtgcatgtttttctttgtgcttcatgttggaagctcataccttgctgacagctgccttcacttgtttaagtgatttattattaaaatactcccattctgttttgttcacacaatagaacatattccagactttgttttgaccatcttggtgaagtgagtgttggcatatctatgccaagtgggttgccagtgtctgaaagacacattcctgctgtcaggattaggcctctctcatatgtcacgaaggtcatctgttttagctactgagcatgtcccgctccttctttttgtttcttgcttgaaaaaaagagtaataagcagtggctttaacccagtaattgggtagtaaagttaaaagtttaggtgggaatactaaacatattgactagaagttaactgctaaaataatggattgttttattaattttttgcatttttaatgagtttaattctaacaaacagcatatttgtctgcaaatgctgtacttaagtttctttattctttatgctcatatcatttttataaattatgaaataaaggaatttttgtgtcagtagtgactgaaggatttggagatgatatgtaaaatgttcttccttcaaatgtgtttattagatggcagacatcacaatactttaaacacttcatatacattagcaaaagaatgctccgtaactcataatcacaattacagtgatattgtgaaatcttattgacactgattcagaatttctgtgattctaaacaagaaccttgatttactataacttcatatgaaaaataaatgtttttctgtaaacttcagtatctgacaagaggaagctagtacacaatcagtagtttcccagactgagttaagaaaatgaaagttttgttgaatttaaggatcataaaattaatttcttagtaaaaattttataggagtttgatttacataggttttaacactaatgttatttggattcttagaattatcatttatgctttaattttaactaaatatttactgtatttggaaagtgttacttatttgaaaatatcaaggagtttaagtttcaaataagtcacattggcttattagtgataatttgtccatttgacattttaacatttttctagaagttttaagtggcttctttgatgtcaagaaagtttttccttgttttgatctgatttttcaataattttaggtttttacagtggaaattcctatccagaaccagccttttataatccaattccgtggaaaccaattcatatgccacctcccaaagaagctaaggatctatcaggaaggaagagtaaaagacctgtgataagtcagccacacaagtcatcatctctggtaattcataaagccaggagcaatctttgccttggaactctgtgcagaatacaaagatagcgtatgtggaaaataacatgcttttatctggagctatttaatttaaaaatcagaaattgttttttactgctcagtcaataactcaacacttaatgtgattattgacaaatagcaatttttgcatttgtatatggagtccttagagttgaggaagatattttctggattttggtttttataaactttttaaggttgatcttggcatgttgttttgcagaataagtggctgaatatgtaagaattgtgtttgtatttagcttgtattaaaagtacactgtaataccaataaaactaacaatttttcttgtattgttttatattgttactagtttacatttatgaacataagattaatttgttcaaaacaagcacctctaaactgcatgcttgagtaacccttagaagaatttaaagcaaaaaaaaggaaatagaaaaaaagtttaagggatggtgggttagaatttaagtgggttagcaccctagagtaatcaaaaacagtctttgctgatgggttttggcatatttttccctgtgtaaatattttaattttatttatattacattaatttatttattttgagacagggtctccctctggctctgttgcccaggctggagtgtaatggcatgatcatagcttactgtaaccttgaactcgtgggctcaaatgatcctcttacctcagcctcctgagtagctggaatcacaggagcatgccaccaggtacagctaattttttttttttcttttggcacagatggggtcttcctatgttgcccagcctcggatatttttaaattaataactgaaggcatgtttggttacaaataaatcagggttggggtttccaaaggaaatttttttatttttttatttgttatttatttttatttttgagatggagtctcgctctgttgcacaggctggagtgtagtggtgcaatcttggctcactgcaatctctgcctctcaggttcaagcgattctcctgccccagcctcctgagtagctgggactacaggggcacgccaccacgcccagccaatttttgtatttttaatagagacggggtttcaccacgttggccaggatggtctcgatctcttgaccttgtgatctgtccacctcggtctcccaaagtgctgggattacaggcgtgagccaccgcgctggcctccgaaggaaaattttaaaacattgttttatacgctggctgggtgtggtggttcatgcctgtactctcaactctgagggaggcagaggcgggagcatagcttgagcccaggaattcaagacctgcctgagccatatagtgagaccccattctccacaaaaatgaaaaaacaaaagacaaagccattgttttgtactctgatcttagattaacgtgtagtaatcttgagacacggataatattttgccacactgtaaaaatacataaacattaattataattaggttgctagtttcaaaattaggattactgcattattttttaatattaaaaatgttgaatgttaagcgatattttactgaggtagaaatcacagatcttattaataaatatattttaagaatagtggttcaaccgggaggcggaggttgcagtgagccgagatcacgccactgcactccagcctgggcgacagagcgaactccatctcaaaaaataaaataaaataaaataaaagaatggtggttcaaatgattaccaaaacaatgcctagcattttttattaaatttaaaagtgttttatcttttttagaggatgatcaagaaatgaaaatttattgtggcagtataagaatcaatcaattcatttaaaagtgacttctatttagaatatattccatgtttctgccagatgagtcatctgccaagcttctggtgatctgcagtggtgctggtcaatgcaagaaaacagcaatacactctttgaagggtattcatgtcatcagaagtctaggaaaatttaattctaagcagagaacagtttattaggaatcagtagggttcattgggtccaaatgttgctgagatttagaggcatgagcatacttctcagaacctgtcagatacagtgaaacttccagatgatcattctacttgagcaaattcactcatatagagagaacatagagtttgcctggatagcaataatcttgtttataagaaacatatatagtatacatattcctgaatttgtgagggttttatatacagttgttacatcttacaaaccaattctacagagtaggttaactttcaactataactataatcctaataagtctttacagtcattcaatcattaatcattcatatgtataccgagttcactagtttgaattttattctaatcataataggaagtgtccggaagattttaagcaggcaattgataagatctagtttatcttttgagattactatggctgctctgaggaagttggcctgttgggggcaaagaatggcagcaatgacacccattgggatgactttgcagtatctggcagagaagtcatgatagcttggattaaaatggcagcagtgacatggtaagaagtagagataaatttgggatttattttggaggtggaacaaacaaacactaacattcggatgtcagattgagagaaggaagaaaaatcagatttgactagttttttggcctgataactaggtgaatgatgatactataccagaaatatgaagattgagaagagcaggtgtatgggctgagatggggagagggaagtctttaagaattctgtcctagatttgttaggtttgcgataccaacttaatgacctggtagagatggttaaatatatgatgctctggggagagccaggataggaaatacaaatttgagcaacatcagcacatacatggtatttaaaagcatgggacttgatcaggttacctcagaagagtttagatagtaaaaagggaaggctgagtaatccaatatttagagattaagcagccggcgaggatcctgaaaatatgcagccagtgaagtagaaggaaacccaatagagtaggatgtcacagaatccatgagtagaagtgagatgtggactctgtccagtgctgcttgacagagaggagtcttcactgttgtatttcataagatgaaggagggtcattgttgactacaatggcaagcatgtcttgaacaatttctatatgactggtattcttgtgcttttatatgtgctattttaatcctcacaacagccctatgagatagttacttttattatcctcattttaagttggggaaactgaggcacgaagttacgttgcttttataactagtaaatcacagaacatggattagaacccatgaggtcaaagcccaaacttaataactgtatttcctctcctatataatatatatgataagaaaaacaggtataaaactacaatcgaataggctggagagagaatggaaggtgagaaagagcctataactaaagacattctggaaacgttttatagtgaagaagagaagaaaagtgggataggggccgggcgcagtgtctcatgcctgtaatcccagcactttgggaggccgagatgagagaatcatctgaggtcaggagtttgagaccagcctggccaacatggcgaaaccccgtctctactaaaaatacaaaaattagccgggcgtggtggcaggagccacccagctccttgggaggctacttgggaggttgaggcaggagaattgcttgaccccgggaggcggaggttgcagtgagctgagatcacaccactgcactccagcctgggcaacagagcaaaactctgtctcaaaaaaaaaaaagaaaaaaaagtgggataggagctagaagagaacatagggtcaaggacattttctgtttgttttgcttaggctgggtgatactaaatatacttctctgaggctggtaatgatccaattgaaagggaacctgaagatttaggagagattaggggtgattttaggaatgcagttcttaaatagcaaaaatgctggtttatatagaagcaaggaaatttcttctattcacagggagaacaaattgtacatacaggttctgatttggctggattgataatgttggtggcaggaagacaagataggcagttcttgtcaaatcacttcttgtttctcagtgaagtgtgaagggaaggcaaggtcatcagcagagggatagaataggatgttccaagtttgaggaaaaggaaaaggttaatagaaaagtaagcattttggagaaagaaatttgccagagagattagcgagactgatgggcaatgttgtttgccatttgatatttttgggcataaagaccaattagtgaagttctgttatgtttctctttatttctggagaaaatttagctagttagatgtagacccagaatcacttataattggagctggacaagtgggcaagtaggatggagggaaaaaggaacaaagcagttaaagtgttttcaagggagtgattatggtactgaaacatattacttaacacaggtggtgaggaaggggtcttcgtagatttcccgtgctgttttgaggttgagtggggggtgcttgagggaagctagagagataggggcttttggtcaggatgttgatgacaagaaccagagtatggccatggcagtcagtggcccagatggaacataacaacaaagttgaagaaattaagaatgttagaggccagagccaggtgcagtggcctgcacttacagtcccagctactcaggaggctgaggcaggaggatcacttgaggccaggagctggagtttccatgcactgtgagtgcacctatgaatagccatggcactccaccctggcaatgcagtgagaccctgctctaaaaaaacaaaaagtatggaagtaactttttaatgtggatattgaaattgccaagattatgatagaagttgtggtagagaggaagatggcaagctgggtgctagaatttcagcaaaccagggtaactggctagccagatgacagtcaaaaggagtaatattggctaatgtggtcagatggaataatcttcagaagagtaggaagttttgaaggaggaaggagatgaagtggtttggaggtgccaatggggaacaggatgggtagagaaaacaccttcctacctaccaactccaagcccctggaggttggaggctacaaacggttaaaaaacttctcaggagtccattgcaggcatgaaaaacgtttaaagcatggccgtagcaagatggttttgagggacagagaccaaagacagagccaccagtaatgacattatggaacattccaggaagaggtgattgaggatccaatgagggtagtagggttgaagagaagaaatgtgtgaaagatccatcagaagtagaacttaggccaggtgtggtggctcatgcctataatcccaacactttgggaggccgaggtgggaggatcacttgagcccaggagttgagcccaggagtttaagaccagcctggacaacatagggagaccccatctctacaaaacattaaaaaattagcttggcatggaggcttgtgcctatagtttcagctactcaagaggctgaagtggggggatcgtttgagctcaggaagtcaaagctgcagtgaactgtgatcatgccactgcactccaatctgggtgacgagcgagaccttgtctcaaaaaaaaaaaaagtagaacttaaagggctgctttggagctgacgggtgatgataatattagcagagaaagggaatacagaaaggaatgacagctttgggggtgagaaactgagggttttttttttcccctttcaaattgtttatcaaagtaatatatgcacatagtttaaaattcaaatagtactaaatgttgtttgatggaaaacaggagcgttttgcttacttctcactgcctcacagtcttgctcccaaggggatattttattgtattatttatttgataatttcctctcataatattctctggtcccttttttctagaatcctgttaggcaattactggtcttcctgaattaattctctaataatttaaaaggaaatatttttctcctgtcttacttttttccccctaccctggtgagggagaccactttctgtgagaagtccttgatgttattttccaattcttgaataatttttttatggctaccttattttaaattccaaacattcttttctgtttattcctttttcatagcctcctatacttattttatggatgcaatatcttttttcatctctaaggacattagttgcagttttttttcttaattggctctgtttcttccagatgcctttttttcttcattttctctttttctgaggttttattagaggttttcctcaaacgttttttaatccttgtctgacatttatatttgttatatgaattcctgtctgttcctatttaagaatagggcattaaaaggctgaatagaagctatgtgggcataggtagggcttgttgatggtggattttttattgttgtgggtagacttccaaatacctggaagtctttcccccttaggctgttcattttctcagagaaggatcttctaatcttccggagagatataagcctagctgccagcattccggagtaggacctgggaatgtagttctgtatatcacagttcatttcttggtaaactgtcacttcctgtgttttcagtctagctagttagtgtataagcttcattctccttagtagctagtgttcccctatgctgagcccttccaggattctgcaggctgaatttttgttgttgttgttgtatttatttcagcatttagaaacctttaaacagtaaaagagaaaaagaaaaaaaaaaggcactcagaggaaacagagccaattaagaaagaagaaaaaaaattgcaactatcattaatgtccttaaagatgaggaaaaacactacatccatactgtcctaactccagtactctcctaagtcagttgtttcacctctatcctctctgcaccatcccaaaatttgtaggaatctgtggttaaccattgtattctcttctgtttgcccttgtggatttgtacattttttcttaaaagaaattcctttgccatcatcttagcagagattggagtgggaaaggagataattctgtatgattaatctgctatgtttaattggacatcctgaatttagttatgaacatattgacataagggggtgttacagataaaggtttgttgcccagatgagaagtgtagttttgggaatatttagaccttattagtttaacataatcattgaaactatggaggtgaatagcatttctcaagaagagtctgaagcatgacattcttttattccttcattccacccatattaagtgcctgccatatttggcccagaaaagatagactaggatggaatgtagaggttgagtataaaggtaaggcagaaggaaagaagccactggaagaccagtgaaaatggtgggaggtgcaaaagaggaaagtgtgccacagtgagagaggggagctttcaggaaggggaagtagaaggtcttctagaatatcaaatgctgtgcaagcagtcaggtagaatgagcaaggcattctagtatgtattgaattcctagcactatgctagaatctggggattctagtggtaaacaagactgaactaatcctgaatctgttagcatttacattctagcagagattacagttaaagccatacttaccttaaagcacaagctgtgagggcatatgaggaggtagctaacctttgttggagtcaggaaaagcttctgggacaaagtgattaagctgagactcaggcttgaggcacccgaataaacaaaacttagaatttaataattttggaggctggagagtaaggaatggacttagaacactggtggttccctatgtaacctttctttctttcagattccaaggataggtgatatgacagcttt

SEQ ID NO: 462 - DNA, 19360 bp, Homo sapiens
gggacccggccggtccggcgcgagcccccgtccggggccctggctcggcccccaggttggaggagcccggagcccgccttcggagctacggcctaacggcggcggcgactgcagtctggaggtgagcgggatgcagcaatggagtcccaggcctggcctgggcacaggcggggagcaaggcctccgggcgcggaggtcagggcgtctagcagcagggcacgggccacgagtggagatttgggtcacacgggaagaatctgagccagggtgcaagttttttctgcgtccacctcctggccgtggccttctcactgcttaaagcgccccttggccttccctggaagtctgacctccgcaccctgcccgcggcctcgggagggctggggtggcctaccttcttaggccgactgtggctgagatgaagactgagattgtactacattgagtcaaagaccaacctgcatacacactcccctgctcccaggctgtctcaccactaggcaacaccgcctccatcttacttacccttttgcagggcccttttcctggttcttgagaatgtagcaagatttccccgctcaggatggggatgggtcggaggagccactctggaagtttcccgggcaagaaagtgttggcaataataataacgggctggtcaggaagtagaagagaaaattaagacttagatatcctgtggaaaaagaggaataatatctactgattgatgcggggagagagggaagcctggaaagatcggaggtgaaagtaaaactgagatttgaaggtagaggtgtggagggcctgtgaactctatgcagatgacaaatgtcaaaaaagtgcagttgcttttcagggagagaataagtgtcctaaaaaagagacagccaattcctctgtcttccaaagttccgtgaaatagaattacacaattttgcttaatggtagaatattccatgtatctattaaaatcaacaaaaggccgggcgcagtggctcacgcctgtaatcccagcactttgggaggccgaggcgggtggatcacctgaggagttcaagaccagcctggcaaacatggtgaaaccctgtttctactaaaaaaaaaaaaaaaaaattagctgggcatggtggtgcatgcctgtaattgcagctactcgggaggctgaggcaggagaatcgcttgaacccgggaggccgaggttgcagtgagctgagattgcgccattgcactccagcctgggtgacaagagcgaagctccgtctcaaaaaaaaaaaaaaaattaaaaaaaatcaacaaaagacttaaaaaaaaaagactacactgttagcatttcagaaccaccttagtgtaatgatgatagctcattgtggtactaagaagacaggggttatagtcttatttctggaaaagaaattaataaagtggcatgcttagttaaaatatatataaccacatgcaagtactaaaatgccactgtataaatacaatacaaattgtaaaagaaaacatgctttttaaattagagcaagtataatagcctgtgaaataaatgtcaccctctagagttgttcagtgcacaagctgcacaactttacatgggccttcagtagaggtttccattttatgtgaggttttgtaaactgggagatgatttttccagtagtgtggcaatagtacaatctgcctttcttccctgattctgtgtgcactggtcctatttacaaagtaatataaaaatcaaaaggcttggccagacgcggtggctcacgcctgtaatcccagcactttgggaggccgaggcgggcagatgacctgaggtcaggagtttgagaccagcctgagcaacatggtgaaaccctgtctctactaaaaatacaaaaactagccgggcgtggtggtgggcacctgtaatcccagctactcaggaggctgagacgtgggactcgcttaaacccaggaggcagaggttgcagtgaactgagatcgtgccactgcactccagcctgggtgacaaagtgagactctgtctcaaaaaaaaaaaaaaaaaaaaaattaaaatcctttgtcttgaatggattatgggatcagagtttcatcaggactcctaattaccatatgctttcctattctagcatcttccatttctgtccatacagtcattgcaagtgatctatttatattatagtaggcaattatagagatttccacatatttgtagctatcccatccatttctgtagccaaatattctgaagcttcaaggagatctttgtcttatctccaacccagtcccatttttgccctttgaattgcttctgtctgctgtaattttagccttcttttgtcagtaaagcttatctccttattatctgaggtctttacaaaagtccatggaatgtttacctgggcctttaggctcatgttcctggtcatataaagaggagcacctttctctaaaaggacctcttctcagcctaaacaatctctaacatcttgccactatttgcattttccagggtccacacttgtgattctcaatggagagtgaaaacgcagattcataatgaaaactagcccccgtcggccactgattctcaaaagacggaggctgccccttcctgttcaaaatgccccaagtgaaacatcagaggaggaacctaagagatcccctgcccaacaggagtctaatcaagcagaggcctccaaggaagtggcagagtccaactcttgcaagtttccagctgggatcaagattattaaccaccccaccatgcccaacacgcaagtagtggccatccccaacaatgctaatattcacagcatcatcacagcactgactgccaagggaaaagagagtggcagtagtgggcccaacaaattcatcctcatcagctgtgggggagccccaactcagcctccaggactccggcctcaaacccaaaccagctatgatgccaaaaggacagaagtgaccctggagaccttgggaccaaaacctgcagctagggatgtgaatcttcctagaccacctggagccctttgcgagcagaaacgggagacctgtggtatgtggtcttccagggaaaggggtgagggagcccagcctttcctctgtagtggcaaggtgtgtagtcagtcttgatgcttacaacagtcaggcttctggccgagcacagtggctcatccctgtaatcccagcactttgggaggctgaggcgggcggatcacttgaggtcagcagtttggactagcctggccaacatggtgaaacccgtctctactaaaaatataaaaaaactagccgagcgtggtggcacacgtctgtagtcccagctactctggaggctgaggcaggagaatcgctgaacctgggaggtggaggttgcagtgagctgagattatgccactgcactccagcctggccacagagggagactctgtctcaaaaaaaaaaataaaaatgaaaaaagaaggggtctcaaaaataaataaatgaagaaggggtctcactatgttgcccaggctggtctcggactcctgagctcaagggatccaaccatatgggcctcccaaggtgctgggattataggcatgaacgacagcgcctgacttcattttccttcttttttttttttttttttttgagatggagtcttgctctgttgcccaagctgtagtgcagtggtgcaatctcagctcactgcaatctccaccttctgggttcaagtgattctcctgcctcagccttctgagtagctgggattacaggcacccgccaccacacctggctaattttggtattttttagtagagacaggggtttgccatgttagccaggttggtcttgaactcctgacctcaggtgattcgcccacctcggcctcccaaagtgctgggattacaggtgtgagccactgcgcctggcctcattttccttcttgataaaggagaaaactgaagcaagaggaggaaaatgactttttctttagagatgcggtctcgcactgtcacccaggctagagtgcagtggcgcaatcacggctcactctagcctcgaatgcctggactcaagccattctcccacatcagcctcccaagtagctgggactataggcatgcaccatcattcccagttaattttttttttctttttgcagagatggggtcccactatattgcccaggctgaaaagtgacttttttggtgtgcatatctcaataattcttttgtaagcctgccttgattgatctctaaggctcagtgtggctcagcttgaaatgcaatttgaactatgctcctaaatttgtcctgaaatgcataatggggcagagtaacttagagccacaatagattcagcatgtgttctccgtccctaaaggcagaggtcttggacaagtgatccctagccaccaattctttcttttttattttttatttttctgagacagagtctcactcaggctggagtgtagtggcgcaatgttggctcactgcagccttcgtctcccgggttcgagcaattctcctgtctcagcctcctgagtagctgggactacaggcgtgtgccaccacacccagctaattttgtatttttagtagagacgaggtttcaccatgttggccaggctggtcttgaactcctgacctcaggagatccacccgcctcgccctcccaaagtgctaggattacaggtgtgagccactgcacccggcctgctagccaccaattctgatggacacacctgggcatctgatgaggcagctaagtggggtgttggattattttccctctagcagatggtgaggcagcaggctgcactatcaacaatagcctatccaacatccagtggcttcgaaagatgagttctgatggactgggctcccgcagcatcaagcaagagatggaggaaaaggagaattgtcacctggagcagcgacaggttaaggtgaattgttccgtccctcactaaagaaatcagatccagtgtagggaattcctaggtagggaaatggatcaagtggcctgatggaccagaatttccaagttctggtattagctctccacttcatgctattctgcataacttttgagctatttttctgcctgggatcttttctctcccatctgtgaaatttccttgagggcagagtcccttggtcactctgtattccagccagcactgggtttagtattttgtccttagtaggtattcaggaaatgattaagaggtcttcattttgggaatccacctgaactttaaagatgcttcccaacagtatgaacagtatgaattgaatagaatacaacaagttaattttattagaagatataatattaatagcagataaagtcagttatatatatacacgtatatatattttttttttttaagacagcgtcttgctctgttgcccaggctggagcgcaatggtgcagtcatggctctctgcagcctcgacctccagggctcaactgatccttctacctcagtcttccaagtagctgggacttgccagcttggtgcatgccaccatgcccagctaatttttgtattttttgtagagatggggtttcgctatgttgcccaggctgatttcaactcctgggctctagtgatcctcctgcctcagcctcccaaagggctgggattacaggcgtgaaccaccagcctggcctagatacgaattttaaatacttctctagcaatcaaaattgatctaacccaattgtgtagtctgggtttttttcccacagttaccaatataacacatctagattctattgtatatatgtgtaaatcactcattcaacctttattttcttttttttctcaacttttattttaggttcagggggtacatgtgcaggtgtgttacatgggtatattgtgtgtcgctggggtttagtgtacaaatgattttgtcacccaggtagtgagtatagtacctgctaggtagtttttctgtctccccctcctcccactctccaccctcaagaaggccctggtgtctagtgttcccttcttcatatccatgtgtgctcaatgtttagctcctgctttttttttttttttttttttttttgagacgtagtctttctctgtctcctaggctggagtgcagtgctgcgatttcagctcactgctacctccacctcccaggtcaagtgattctcctgcctcagacttctgagtagctgggattacaggtgcccgctgccacgcccggctaatttttgtatttttagtagagatggggtttcactatgttggccaggctggtcttgaactcctgacctcgtgatccacctgccttggccttccaaagtgctgggattacaggcgtgagccactgcgcccggcctctttttttttctttttgagacggattctctctttgttgccaggctggagtgcagtggcacaatctctgctcactgaaacctctgcatcccaggttcaagtgattctcctgcctcagcctcccgagtagctgggactataggcgcccgccaccacgcccggctaatttttttatttttagtagagatggggtttcaccatggtggccaggatggtctcaatctcttgacctcgtcatccacccgcctcagcctcccaaagtgttgggattacaggcgtgagccaccgtacccagcctagttcctacttataagtgagaacatgcaatatttggttttctgttcctgcattaaatcgcttaggatcatagcctccagctcaacaatctttaaaagtgaaaatttggccaggcgcgataactcatgcttgtaatcacagcactttgggaggccaaggtgagtggatcacctgacgtcgggagttccagaccagcctgaccccgcctctactagcaatacaaaattagctgggtgcagtagtacatgcctataatcccagctactcgggaggctgaggcaggagaatcacttgaacccaggaggcagagcttgcggtgagccaagatcgtgccattacactccaacctgggcaacaaaagtgaaactctgtctcaaaaaaaaaaaaaaagtgaaaatttacatgcgtgtatatgtaagtaaatattaattgtgctatatacataaaatttgtgtactttagaaagtaatatctccaattttaaaaatgtgaatgagaccgggcatagcggctgacaattgtaatcccagcactttgggaggccaaggtgggcagattgcttgagcccgtaagttctaggccagcctgggcaacatagcaaaatcctggtctctactactaaaaatacgaaaaaaaaaaaaaaaatcgccaggcgcaatggctcatgcctgtaatcccatcactctgggaggccaaggtgggtggatcacctgaggtcaggagttcgagactagcctggccaatatggtaaaccccatctctactaaaaatacaaaaaaagtagctgggcgtggtggcaggcacctgtaatctcagctacttgggaggctgcagcaggagaatcgcttgaacccaggaggcagaggttgcagtgagccgagatcgtaccattgtactccagcctgggcaacaagagtgaaactccatctcaaaaaaaaaaaaaaaattagctgggcgtggtggtgtatgcctgtagtcccagctacttggaggctgagacaggaggatcacctgagcctgggaaggtcaaggctgcagtgagctgtgatccagccactgcacgctatcctgggtgacacagtgagaccctgtctcaaaaaaagaaaaagaaatgtgattgatcagctctttgcctaaaacttagctaactgtgtgctttgcagacattgtctgactcatagtcttgagaatgtttctctcatacaaacattgaaatgagatgcgtttattcacagcacatcaggaacagaaatgggactaagacctaggtttctagacccaaaagtctgaaaaacgggcgtggttttagtgtaacatcaatgctttgagaatcaaagtacatactcaaactttcctaagaaatttcaactggaagggactggattttctccaaattcaacaaaatgatggatgacaaaaccagtttcttattggctagggtctaggctagatcatctccaagattcttcccaactctaaaattttattctatgagatagtggtctcagatgagtttgtttctagaccgtcctatgggataaaggtttctctagatgttcttcaagggcttgggttgggggtgcttctcatgaactctttcatgtcattccctgtgtcataaccctcaggttgaggagccttcgagaccatcagcgtcctggcagaactctgtgtctgagcggccaccctactcttacatggccatgatacaattcgccatcaacagcactgagaggaagcgcatgactttgaaagacatctatacgtggattgaggaccactttccctactttaagcacattgccaagccaggctggaaggtaatgtgtcccacagcaaccaaaatcaaggtcagcccagcctgacagtctctccagtgctgtactgcaacttgtatctgggacagcagttaagtgcaaaggacactagaatgataaacaaatgtatcttttagattgtgactcaatcttattgaatccaggcaaaatcattaagaagagctccttaactacttcatgtgttactacctaaagtccatggagggtcttcaatgtagcactcaagcccacttttctgctacactcaacagccgtcctagatgccagcagctagagtggctaagtagttttatgaaaatgtcttgattaaaaaaaaaaatgctgtctgtgagcctcatgacccaagatgtcatctcctgtagcgtcacatagcatttctagtgggcaggggttttcctttcacttcattcatggaaagaccgagatgcctgtgagtcaacatagctcacgcagttggtcggtgtcagagccacaaatgaggtcttctgacgggtgctcaattccaagtcaagtgtgctttgttttcctcatggtagaactctttcttttttttttttttttttttgagacagagtctcgctctgtcacccaggctggagtgcaatggcagatctcaggtcactgcaacctcctccgcctccaaggttcaagcgattctcctgcctcagcctcccgagtagctgggactacaggcatgcgccaccacgcctggctaatttttttgtatttttagtagagacagtgtttcaccatgttggtcaggctggtctcgaactcctaacctcaaatgatccacccgtctcgacctcccaaagtgctgggattacaggcatgagccaccacacctggcccctcatggtagaactatgttttttttttttttgagatggagtctcgctctgtcacccaggctggagtgcagtggcgcgatctcggctcactgcaagctccgcctcctgggttcacgccattctcctgcctcagcttcccgagtagctgggactacaggcgcccgccactacgcctggctaattcatggtagaacttttaattttactcccttccatcagcttactttcctagttttttgtttgtttgttttttgagacagggtctcaccctgttgcctgggctggagtgcagcctcagccccctgggctcaagctcttccctcctcaacatcccaagtagctgggataacaggtgcaccaccacagtccgctaattttttttttgtagagacagttgcccaggctggttactatgttgcccaggctggtctgaactcctagtctcaagcactcctcctgccttagcctctcagtgcactgtgattacaggcgtgagccaccacacccagccttaatttcctagtttcttgtttgtttgtttgagacggggcctcactctgtcacccaggctggagtgcagtgacatgatcttggctaacttcaacctctgcctcccaggttcaagtgattcccctgcctcagcctcccgagtagctgggactaaaggcatgcgccaccatgcctggctaatttttatatttttgatagagacagggtttcaccatgtttgctaggctggtctcaaactcctggcctcaagtgatccactcaccttggcctcccacagtgctgggattataggcgtgagccaccacgccgggcctaattccctagtttcttaatttctctgagccacctttcttgctattgatcactacctcacagccttactctgcttttctagcccctgacagctatctaggtcttttctttatcacaatctaaggttggcatcagtctttattcccgtagaatagatgggtttatggctgaaggtgacggctctgcggtgtggagtgtcaggagagttgccaagagggctgcaaagacaccagacgaagcctgtgctgagcacagtgggaggggcctgaggctggtttccccatgtgtttgaagggtgatgtttctgaatctaaagtagctgataaccagttgtcttgctcttcttccagaactccatccgccacaacctttccctgcacgacatgtttgtccgggagacgtctgccaatggcaaggtctccttctggaccattcaccccagtgccaaccgctacttgacattggaccaggtgtttaaggtgaatgccctgctttcctctaaatagggcctaagttggaggttgtcatagccatctcaaaaggaaacaagttctgctagtgatgctttcatttgatcaggggagagttagaagccagccacccaattagtgacttgcacaaaacccagtgaattaagtacacttgacaaataccaaatgacacatttttgtgccagaccagagcaaggagaaggctgttctgacccaacagaaagggctccccagggcagtgttttcctaacttccctgtgaatgggaattgcctgggacattgttaaaacacagcttcccagacccctctcttggggctcttgatttagtgcttctgggatgggcccaggaatttgtatttttagcaagcatctcaggtgattcttacaagaaattctgggaatgcttgctctaaaaaaagcccttcctgctgggtgtggtggctcacgtctgtaatcccagcactttgggaggctgaggcaggtggatcacctaaggtcgggagttggagaccagcctgaccaacatggagaaactccgtctctactaaaaatacaaaaattagctgggtgtggtggcgcatgcctgtaatcccagctacttgggaggctgaggcaggagaatcccttgaacccaggaggcggtggttgtggagagctgaaatcgcaccattgcactccagcctgggcaataagagtgaaagtctgtctcaaaaaaaaaaaaaaaaaaaaaaaaaagcctgccttaggctggagaccagaagctgagctaccagaacgtcttttcagaaagaagttattttggtttttcagagtgcccataaggctgctggtagctgtaaccattctcctgggaggggcagttgtctggggtgtcttttgtcatcagtcaggaataagtgtttttcccaatccggtcaaattgaccacgttggtggtaacttcatctcatttctctcccacaatgcctggccgccaccagccactggacccagggtctccacaattgcccgagcacttggaatcagtaaggttctttccctctggctcggggcttggccttgttttcctttcactgctcagcatggctttagtggacagagacaagatgtgatgtggggaagggtccctatggccatgttttgtctaggtgccagccctagacacagaacaccctgagggtcaggcacacacccacttccctccccttccatgggcatcacaagggcacactgagcagagcagggcacagcaggggagcatgctgcagcagccacaagcgcatggcaccagcctcaggggcggcagttcgttcgctcacttttgtgcctagcttttctttgccacgcatatagctacctgctctggcatcccccaggggtgttgaggacacgtgggtgaagcggtagtgccactctgccatcatgtgtctgtaggccacccacctgcccactcatcacagttttggagactgctcgcctacgtccatcccctcaggttggcctcctctctctgggctgtcattaactcaagcacacaccaccagagcagctggtggggttttgccatcccctctttaccttattgtgttaacataggtttctttctctccccatctgccacaagcagcagcagaaacgaccgaatccagagctccgccggaacatgaccatcaaaaccgaactccccctgggcgcacgttagtatgggagagtgggccttgggcctggtccttgttctggggccatatctttagggaaccagactctgggattctgttcccacctcaaagggatctgagcccagagaaggagagcaaagctcctggggctgagaaggggtgtactccagtccccctgctcctgatctctcgtgtttcctcctagggcggaagatgaagccactgctaccacgggtcagctcatacctggtacctatccagttcccggtgaaccagtcactggtgttgcagccctcggtgaaggtgccattgcccctggcggcttccctcatgagctcagagcttgcccgccatagcaagcgagtccgcattgcccccaaggtgggtgtcctattttcctctgaagagagattctggccaattaagaatgttggaccttcagcttgcaaagcactctgataagtgttccttgagagcttataaatctagttgggtagaaaaggcataaaaacatagggaagtgtaatagcattagaagagctaaaaaggtatttggattacaatgtaagtggtgtcagaaggcccataaatacctgatgagcttgtaagaattcagacaaaagtgattgtgatagatgggctaggattattaaggaagatacacaagggaggcaggccttagaaagagatggatttggccgggcgctgtggcttacacctgtaatcccagcactttgggaggccaaggcaggtggatcatgaggtcaggagtttgagaccagcctggccaacgtggcgaaaccccgtctctactaaaaaatacaaaaattagctgggcttggtggcacatgcctgtaatcccagctacttgggaggctgaggctggagaatcacatgagcccaggaagggaagttgcagtgagccgagatcactgcactccagcctgggtgacagagcgagactctgtctcaaaaaaaaaaaaagaaaagaaagaagtggatttgaggctagacgctgtgggtctcacttgtaatcccgacactttgggaggccgaggcaggggtattgcttacagccaagagttcgagaccagcctgggcaacatagcaagaccccagtctctgctaaaaatgcaaaaaaaaaaattagccacggtggtagtacatgcctgtggtaccagctactcaggaggctgaggcagaaggatcacttgagtccaggaggttgaggctgcagtgagccctgtttgcaccactgcactccagcctgggcaacagtgaggccctgtctcaaaaaagaaaagaaaaaaagtagatttgggtaagcaaacaggtgtagagagagcatgctaatgggcagtgccatggaggcgggaaatgcagttcgtacctggcagtagtaaagtgactgggtcagactaactcagggtttctcaagtactattcacgttgacagctggagaattctttgttgggcgtgggagggactgtcctgtgcactgaagggtgtttagcagtatcccttgttttccccactagacgccagtagcacccaccacaggcgcggcaatccaaatgcctccagacattgccaaatgtcccctggcagggagggaatcacccctgcttgagtatcactggtctagcttgaggggaaggtgagaagggtaaattcagagccaacttggatcagccatcagatctgcacttaacactgttaaagggttctgtgagtacgggctgacatgtaaccaaagtgaaaagcttcccccatccccttcagagagatgaaaatagcatagagtctggagtttagagcgacttgggtttgctttttttttaatatataaaatcttttaggccatgcacagtggctcacacctataatcctagtattttgggaggccaaggcaggaggatcacttgaggccaggagttcaagaccagcctgggcagcaaagtaagaccctgtctgtaacaaaaaaaaaaaaatttttttttaattagccaggcattttcatgtatacctgttgtcccagccacttgggaggctgaggcagaaggattacttgagctccagagctggaggctgcaatgagctataatcgtgccactgcattctagcttaggcaacaaaatgagaccctgtctctaaaaaacattttctttaattataaataaaacatattacacacaaaattataccacacatacataatttagcgtaaattcattcatgtggccgtagcatgtgccctgtttgggttttcatgcagtgggttttctcccctttcctttttggctccctctccaccctaccatcacccacatcacccctactcccaagataactggttgataatttatgatgctttcttgcatattttatcaatgctcttagttatactatacatgtatagcgatagccattttatatgtacacatacaacacacagaacattgataatgtaatcatgttgtgcatacttctctacatgtctctttttttttttttttttcctgagacggagtctcactctgtcgcccaggctggagtgcaatggcatgatcttggctcactgcaacctccgcctcctgggttcaagcgattctcctgcctcggcctcctgagtagctgcgatcacaggcgcacgtcaccacgcccagctaatttttgtatttttagtagagatggggtttcaccatgttggtcaggctggtctcgagctcctgacctcatgatccgcctgccttggcctcccaaagtgttgagattacaggaatgacccaccacgcccagcctctacatgtctctaactcaacaatgcctcatggaatttcttccaagtcacttggcatagtcctaattcattattttttagtgtccatgtaatattccatgatgtggctacaccacagatttttcagccattccacttttatggacagattctgtttctcaaattttgcccaatgaacgacactgcaataaatatgtttgcaaggatctctcttactagtgctttcatttctctaggatagagtcccagatgtgagattgttgggtgagaaggtattttaaattctactaaatattgctagattgctttccaaaaaagctatgataagtcatgtttaaaccagcaatatatgataagatctatatctttgccagcaattggtattattagtctgtttaatatctgccaatctaatatgtataggttatatcttcttaattttttaaaatgttttatttatttatttttaaattttttatttccataggtttttggggaacaggtggtgtttggttacatgagtaagttctttagtggcgatctgcgagattttggtacacccatcaccagcttgtttaattttatctttctttgtttatcagtaagtctgagcaccttgtcattatgtttggtgacttggaattgtcctctatgaattggttatttatgaacattgcccatttttatataggttttgttatcaatttgtgagagctctttttttttttttttgagacggagtcttgctctgtcacccaggctggagtgcagtggcgtgatctcagctcactgcagactctgcctcctgggttcaagcgattctcctgcctcagcctcccaagtagctgggattacaggcgcccaccactgcgcccagctaatttttgtattttttagtagagacagggtttcaccatcttggccaggctggtcacgaactcctgacctcatgatccacccacctcggcctcccaaagtgctgggattacaggcataagccaccacgcccagcctgtgagagttttttttttttttgagatggagtcttgctatgtcacccaggctgaagtacagtggtgtgatcttggcaacctctgcctcccgggttcaagcaattctcgtgcctcagcctcccgagtagctgggattacaggtgcatgccaccacgcccggctaattttgtatttttagtagagacaaggtttcaccatgttggtcaggctggtctcgaacttctgacctcaggtgatctgcctgccttggcctcccaaagtgctggattacaggcgtgagccaccgcacccagccccctgtgagagctctttgttgttaaaataatcttctttcttttatgctgaagatatttttctacttctattgtttatctctttactttcctttcttttcttttctgagacaggatcttgctatgttgcctagtctggagtgcagtggtgtaatgaaggctcactacatccttgacctcccaggctcaagtgatcttcccacctcagcctcccacctgtagctggaactacaggtgcatgccaccacatccagctaattaaaaaaaatttttttgtagagatgggatctcactatgttgctcaggctggtctcaaactggcctcagtgtcttgcagtgctgggattacaggcattgtttgttgtttcttaactttgtttatggtatctcttgccacagtaaaattttaaagttttatgtagtcaaatgtctctcttctcttttacagtttctgggtttccagtcttggttaagaaggtcacccgcaccctcagattgtatatgtagtctcctagattctctttcaggatttgtatgattttaaggttttcattttttttttaaagccagtcaaatttagcagttgggggttgtgtaccaactttagtgacaataatgtcactacccgctaccatcagagcagcctaaggttcttattttcatgcattaaatctttgtatacagtgtaagacaagcatgcaattttatttcctctcggatgaatgctattataattatgccactacatactacatacccgcatcttttacccccagaattgaactaccaacttcaacatacatcgtattctcatatttaatagattttaagacttcaaaacgacacaaagaggatcagaacccgtatgtgatatttttgtgcgtcctgtctggtgaccgttggttcaccttatctctgtttccctttcaggtgctgctagctgaggaggggatagctcctctttcttctgcaggaccagggaaagaggagaaactcctgtttggagaagggttttctcctttgcttccagttcagactatcaaggaggaagaaatccagcctggggaggaaatgccacacttagcgagacccatcaaagtggagagccctcccttggaagagtggccctccccggccccatctttcaaagaggaatcatctcactcctgggaggattcgtcccaatctcccaccccaagacccaagaagtcctacagtgggcttaggtccccaacccggtgtgtctcggaaatgcttgtgattcaacacagggagaggagggagaggagccggtctcggagaaaacagcatctactgcctccctgtgtggatgagccggagctgctcttctcagaggggcccagtacttcccgctgggccgcagagctcccgttcccagcagactcctctgaccctgcctcccagctcagctactcccaggaagtgggaggaccttttaagacacccattaaggaaacgctgcccatctcctccaccccgagcaaatctgtcctccccagaacccctgaatcctggaggctcacgcccccagccaaagtagggggactggatttcagcccagtacaaacctcccagggtgcctctgaccccttgcctgaccccctggggctgatggatctcagcaccactcccttgcaaagtgctcccccccttgaatcaccgcaaaggctcctcagttcagaacccttagacctcatctccgtcccctttggcaactcttctccctcagatatagacgtccccaagccaggctccccggagccacaggtttctggccttgcagccaatcgttctctgacagaaggcctggtcctggacacaatgaatgacagcctcagcaagatcctgctggacatcagctttcctggcctggacgaggacccactgggccctgacaacatcaactggtcccagtttattcctgagctacagtagagccctgcccttgcccctgtgctcaagctgtccaccatcccgggcactccaaggctcagtgcaccccaagcctctgagtgaggacagcaggcagggactgttctgctcctcatagctccctgctgcctgattatgcaaaagtagcagtcacaccctagccactgctgggaccttgtgttccccaagagtatctgattcctctgctgtccctgccaggagctgaagggtgggaacaacaaaggcaatggtgaaaagagattaggaaccccccagcctgtttccattctctgcccagcagtctcttaccttccctgatctttgcagggtggtccgtgtaaatagtataaattctccaaattatcctctaattataaatgtaagcttatttccttagatcattatccagagactgccagaaggtgggtaggatgacctggggtttcaattgacttctgttccttgcttttagttttgatagaagggaagacctgcagtgcacggtttcttccaggctgaggtacctggatcttgggttcttcactgcagggacccagacaagtggatctgcttgccagagtcctttttgcccctccctgccacctccccgtgtttccaagtcagctttcctgcaagaagaaatcctggttaaaaaagtcttttgtattgggtcaggagttgaatttggggtgggaggatggatgcaactgaagcagagtgtgggtgcccagatgtgcgctattagatgtttctctgataatgtccccaatcataccagggagactggcattgacgagaactcaggtggaggcttgagaaggccgaaagggcccctgacctgcctggcttccttagcttgcccctcagctttgcaaagagccaccctaggccccagctgaccgcatgggtgtgagccagcttgagaacactaactactcaataaaagcgaaggtggacatg

SEQ ID NO: 463 - DNA, 15834 bp, Homo sapiens
cttcctgaaaggatctggagacaccagctccacaagtcctggtgtctttaaaaggatcagcttgaggaataaggctcgtctgagagctgtgacattcatctgactctagtgaaagtccaacagccactccctttttggcctccaactgggcaccatgagggcctgcatctccctggtattggccgtgctgtgtggcctggcctgggctggtaagtcactatctggcgggcatgggattgctggtggggcgggatcttgcctaaagaagcagagagttggagaacttggtagagggcagggccgtgggacaagggagggtgagctctgtcctaaagccgcagagcacttttgggttgtccttgtctgagggtgcaggcgttggtcccggaatggactggactatgtggagagagttgcagggctgatggtctgatttcatggaattcccttcttgacaccttggaggatcagccccaaatatcccttagtccagcctgacttttgatctccccaagattttgttgtctggggccactgtaaggaataaagctagggctggtgtccatggggtctgagtggcctggctgcccttggtcactccttccactgcctggtgacaggtgaggttgtttagggtgtgatgttactttgggtagagccttaggaggtgggcaggcttaggaggaaactgaaaggacctttgaccaggaggtgggcctcgtcctatctggggctgtacaggggtcagaggaatggatctctgttgcagtgttaggagaattgaagaatacagaagggacctggcccacagttatgagaggtccaggggatgggactggcagaggaacaggaccatgttcctgtttagtaactgtgcaaaatgctggtgctgatgggttaattggtagctagtgggtgggtgggaaggagtgccaagggaggggctgagctgaggagtgtggggagaatcctcctctgcccacaggagaaagaatccttccactgggttgctcctgtgtaggactgtggaaaggattaaatgaaataatgtatgagaagcacctggtgcaaagtgagatctcagtgaactggaaattcgctatgattatgactataaattttcttgggagaaacttccgcttggggtcatttccaactgggttgtggaaaggagacccttatgggatttctaagtggaaaacccctggaagaggaagttgtgcctcccaaccatggatgagatagtgcatcttaccagaaaccagctctgcctgggccctagtgggtggagaggcagtgggagagcatgagggtgggcctgggagccaccagcctcagccctgttggttgggaggaaggtggaacttgggggcttaatgtgtaggggtggccagcgggcttggcatattccagccttagggaaggagagcaactctggatatttggtccctggggggcagaggtagcagtggctttagaagtgcaggtggagctcttgctgctaggtcggagggcagtatctgctttggctgtgggatcgatggggaagtgaggtcaagtgtatgaggcttcctaaggtggcagggaagaggctctgcacttgttgatactatcccaacatctcagaactgagaggcaagaatatgaatcacatggggaatcactgacagcctcaggtcctcctttatgagctggatgtctgtggagaaccttggttgatttttttggttgtgaatggaggcaggaagctagtccaaggggtgaggcttcttggttgactaggtctccatggaaacagcatctggggccttctaacggtacagatgtgtaggatgtcccagtcatcagaggggctgagcaccagtgtacagggacactgtgtccacccaggcttgggaccaagcttccttgatggccagtatggatagggagtggctgttctggcatattgaagtcttagaaagtgcagagaaattgagcatttcttgggggaatggagggagaatctgaacccgagagaggaaaggctcagatgaagaaaggcagagagtcagagaggtgaggcagaggaacaagaggcacaggttactacagcagtgattcaggcacctggcttggggagcaaggcttactcagagtgttggtgttaatggtgcagtgtggggatgctggagtgagttgttagggtgactagttactcatcagagtgtccccagaatgtcacagcaaagtgcctatgaggaaaagttcctcccacccctgcactccactgtcaaatcccaaggtcaccttgaagcagactaagtgcacagagaaatgtgagaaagtgctggcatggggctcttgctggagacaaagttcttgagcagagatgaaaaagcccactcagcttgggccggcgggggtgctctcctgcacgtccagctgactgctcgcttgcaacccttctcaactggtgccagctgctggaatgaagtgaattctttccctggactctgctgatttggcccattaaaaacattgccctgatttgcctgaattctctccctttggattctgggtgtactgccaggctgactgagcagggagctgatgggctgaaaatttctccttaaggtctttgcattcaggctccaagggagcatcatttaacattcaagaggagttcctgccggcttgaaggaacaagtggccttgggcctggtctcttttagggactggaaacctgccttcctgcccaccttggaggcctgacaatgtgaagttgtctgaggacccgggttaaccttgacccaatgcctctctgatgtaaagaatacagacctgtagtgatgaagtcagccaggaaaccagcaacacagatgtgctgacaacccagcccaagggatggccctgttgaaaccctgggagagtgtcagctagattaagtgtgtcgacggggccacaacacagggaagactgctccagccagtctgaacacttgtcacttggaagatgggcatgaaatattgccaccgtttattcacctaacaaatacttctatggtactactatgtgtcacttgctgtcctaagtgctttacatatattaactcatttaattcttacaaatattctatgagataggctccattatcatcccacttttacagatacgaaaaccaacgcacagaagttcaaataacttgcccaagatcacatagctagaaagcagtagaaccagaattccagcctcaagcagtttggcgccagagtctaggttcttgacctctctgctatgctgtccctcattagacaaagtatcaaccttaatcccagaatccaatactagggactggtaaccaaacccaacctctaatatttaagctctaacccactccaggcttaaattaagatactacacctgtattgaatcataaccagaaccaagcccccaaacaaaacagggattattcatctttttctcatcctgacacattcctcaaccccgaatgtcatcttaagtctattcctattccttacccaaatatcaatacaaaattgttaatttatcaactaatttaactcaagcccaaatcctaactgtagttcttaacctaactaaccccaaccctggtccaaattaggtttcagtttcctcactgatacaaattctgatgctgatggtaactctgactctgatcttgacattctctgtaacccacagtatgacctctgaacccagcgttcgtgaaatccaaacctcaggaacctcaaatcgaacaaagactctgttatcacccttaaagcccagagtggatagtgggtttccactgttccttcaaaatgtcttgtcttatgtcccttgcgaccaaaagcttgcttctgcaaaccatttggctgcagtgggggatgtggtctgtggttacataatagaatgctatgccagagcccaattctcacccgcacccgcctcattccccaccctgagcataaattcatctgaatgtactccaaagacgggaaagaacagaaagatgtgacacagggggaaagagcgtgcagagaagaccagaaggggagacaagagcaaagaagcaaataacataacagggatggaataagagccagcggagggtcaggggcaggggacatccctggggcagcatgacatgacaggtgaagggggcctgtgggctacacccagttcacagacctctttctttggtgtgcttaaagtgttacaaggttggaaaatttcacataaaaatgaagatttatcttgaaaaaaaaagggaaggctctggcaacactgagcacacatcccaacatggccacaatcggctagagctgagcatcagctgcaaatttcagatggagcattgctctcaagtttgtcacggtctccatttcttcctactgcctcataccctgcttctttacttgcttatgttatgggcctaacccaaatagggatttgggtttgtgatcctggtctctttgatgagccttgaaatatttggtgggtgttgggtggtggggaggaggcttatgttgtgcatgggaggctgtggatgtacttctcctttgcagagagtaatgcccttccctgccaggtacactcctgccctggtctgtgaaccctcctgcaggaggcaccctggggagaacagggtctccatagagctgagttggtgacctttactgcccataggaaaaatagaatcctgtgcatctcgatgtaatgagaaatttaaccgggacgctgcctgccagtgtgaccgccggtgtctctggcatgggaactgctgtgaagactatgaacatctgtgtactggtgagcctccttgtgagacgaaggcatgtccagcctgtctaaggggccactggcctgggtgtccagcaggccagagcagcgttcaggactcacaggggctctaagggtctggacagaaagcactgagggacagaggcagggtcaggaatttggccaccacttttctcaggttttctaggatgcccccaacttaaaatacagtagatgtcatttacctagaatttctgtctgaaatatcagttttaacaatatcttgaaagtttaagtactaaattctaaaaaagggtaaaatgataaaaataatattttagtatgtatgacattattaattgttattcaacactttaaatcacaaaaatgtaaaaatggtagcaaactctcacaacttgtgtactgccaggaagactgcatggtgtcacagtgacggacacgattcataccactcttcctctagtgaagggaccacgtggtgcaacatctccataccatcatttccagcctaccaattagaacaggacatgcaccacctttaactgcatagttttaaatgaatacttgaaaaaaatcttgtatgaataatcaacttgtttaggtgcttccaatgttgtcaactcccagattaatgatcttctgctttgtgacacaaagccttgatgtcaagccatgcactctgactcccagttttgaaaacatggtcactgaagccacgttaggtaatggccatcaatttcactgcataatcattgcacaggttgtgcgttgtgcaagggaacctagttaagcagcaagctggaccaaaatccagtctgtatccttctcatcaggttttgtgcactggtgaagagttgtgtctgctgagagaaacaagtgtgttttctgaatttgcccaaaggtggtagccagtcaagcacccacagagctgcttccactcgtatggaagctttttttcaatttatacaaaaacaccatatgtattagtccattttcatactgctatgaagaaatacccgagactgggtaatttgtaaagaaaaagaggtttaatagactcaccgttccacatggctggggaggccgcacaatcatggtggaaggcaaaggaggcgcaaagacacatcttacatggtggcaggcaaagtgcgggggaactgcactttataaaaccataagatatcgtgagacttattcactatcacgagaaccagcacaggaaaaacccgtccccatgattcagttacctctcaccaggtccctcccgtgacacatgggaattatgtgagctaccattcaagatgagatttgaggggggacacagccaaaccatatcaccatataagcatatgtattatacattagcaccacatatatattagcacacacacatacacctccttccccaggcagggagacccaggccgagatcagccggaatcagagcctatgccttttctgctgtccttgtgtccccactttttcttaccattcagaaaacacaggaaggcttgttcaccttggaccatcaggctggcattcaagataaaggcaatacccagcgtagtagccatttcatcttcaagtttctgatttgcaactcagaacccctttcctatagaaaaacatattggaaatgatggttaggattccagctcagcacacaaaattctgtttagcataaaatgtggctgaattcagaactccatggattgccagcacttagaacacaacctgacacatagtaagtgatcagaagatgtttgttgactgaagaataacctaactggtagttctgatggtaataactttccagcaaactcactagtagattctgaatcactttgtaacagtactgtttgttgggtgtgtggagggggtgctggtggggggattattccactgtgtgatgagagaggaactcagagtccccaggaacatttctcccccctgcatcacccccaacctcaaatccacccttctccacccagagctgagctacagtcactcagcttgcaggtgaagggaaaggggcagcaataggaatgtgcttttctgaacatgccttttccctagacacagtctttgtggccatttccaagtggggcaaagaaagaagggaagttggaatctcaggaaacagctcttattccttgaggccctgagagtttaccctgagctctgacgagaagtttttctaggtacaggatgttcctaagtgagggctttgtcattaggacagcatcaagcctctatccatctgtcaacttttgttaaatcagagttttcatcaccgaagtcagagttttcaatccagatgtgtcacctggggaaattattttccttttttataagttttctataatgtgtcttccattggaaacatcttccattttctgttttcatcatcattatttggtgcctgtccattggaccccagcccctgttcagaatttgcttccagtgcccttgcttgtcccctgaggctggggaaacagagaaccagaaaccaagcagcaggggaattctcaggttgttggtgactttatttttctatctacctgcagaggaccacaaagagtcagagccattgccacagctggaggaagagacagaagaggccctcgccagcagtgagcctgcctccccaaaggggggccctcaagataaagcaggagggacatgagggtgacaagcaggggcggccatggcagtggcaccaggcccaggcctcagccagatgagagaggcttgttggattctgggaacctgggcaggaagaagcctgggggggctcagccagcctggggggccatgggaggagggtagctaggaaagagagcctgaggcctggagagggaagtggaagagattttatttttagaatgagaagattagaaaaacagcaggccagaaagtaaagttcggcatcagaaaggacttcctgactgtgaagggtgtgcacgaattaggtttgtttgttttccttccctggagatctttactgggcagagtgaagacagccaggctagggagcgacagcctgtggggcgttcagagcgacctctagaggtcagcccgggacacaccacccctctcttctcagacttgtactcggcacccacctcctgccagggccgctgctacgaagcctttgacaagcaccaccaatgtcactgcaatgcccgctgccaagagtttgggaactgctgcaaggattttgagagcctgtgtagtgaccacggttagtcttctgctcccttagctaagctgcagagacagaaggactttagagcaggttctcaacatgtggtccctggaccagcagcttcagcaatgtctgagaacttgttagaaacacaaactctggggcttcactccgggcctacttaattagaaactctagggatgggactcactgtcctgtactaccagggcctccaggtggttctgatgcatgctcaagcgtgagaccccttctagggggaaggggcgggggacattctgtgggcaatgccgtgtggtgattttacacgtcctttaggctctgggcccctgtccaccactagggtgtccaactgtggcccccctccctccttgctggcttcttgaaggtgcccaggaggggaggtacacagataatttcctgcccgcccccctttccctctggctctgaggccacccctcttccaattcctcccagaggtctcccacagcagtgatgccataacaaaagaggagattcagagcatctctgagaagatctacagggcagacaccaacaaagcccagaaggaagacatcgttctcaatagccaaaactgcatctccccgtcagagaccagaaaccaagtggatcgctgcccaaagccgtgagttcccacaattcctctttctaccccctaaatcttgcccctatccttgcttctttcgatgtctcgactttttatcctcaagtcaggcacgatcaaagggagagcagaaaaaaaatagttctccagagacaaagccatcttgagggactgtggatatccagttgggagggtttctgtgattggccaggctgaggatagaacagctcttccaaaacatgaggtggaagaaaagtgacctgatgtgtgactttcaagagtacccgaagtgccccctcggctcctgaacccagccctcgcctgtctgcccctggcctgtctagaagtctctggaggggtcgctgccctgtgtttggggctctcagtggggctcccctctgcctcccccagactcttcacttatgtcaatgagaagctgttctccaagcccacctatgcagccttcatcaacctcctcaacaactaccagcgggcaacaggccatggggagcacttcagtgcccaggagctggccgagcaggacgccttcctcagagagatcatgaagacagcagtcatgaaggagctctacagcttcctccatcaccagagtgagtgagcacccccaggccccagagcgcatgagtctgtctgagcgaagccaggtgggcgggggaggggaaggttaggagggcaggtgaggaggcggtggggactctgtggaggtcagtgtacatctgggagggatgagggatgaggccagggggaagccaaggagaggttaggaacccaaccaggagctggcacatcctctggctggctggcttggatatcaccccacctttgacttcatgttaactgcctcatgcacgcccaccctctgctacagtctcagggttctctgccaggtgtgagcctcccctcacatcccacccccacccagagcacgtctcagccacctccgcgatcctggagtcagcaccatgtttcagacaggtagagtcgctgactctactccctcctcccgcaataaagtccaggaatcgggttggctgagtccaccttttggctggggaaacaacatcagagaatcaacaaaggttcagagcgggaagtcctatcgggaagagttgtggttggaaagcctccaggtagagacacatttgagtcagaccaaaaaagattttggccgcaggacttcttggcatggagttgtgtttgttactgtcctgcagattcctttcccaactccaggcagctgggctttgtctcaggggtggctctgtccgggtcttccctcgttgtccctgagagtgccttggctcagagctgctgcctcccttaagagttggtgacactgtttttaggtaaagtgacagcgacacaagagtgactctatgaagaagttgcaatcctgtgctgccccctggcgttctcttcgtagtaaatacacaagagaatcttggaggtctagactgagcaagggcttttcaaatgagagaaacggaggccagacaggctagacttatctgaggccacaaatgagttggaagcggagctggggctggaactcagggttccgatgccaaggccaggctgtcccgttactaactctctcctcacctctctccttgtccaaatcccacttatccttaaagttctatgataattcatatcccaccgcatttgtgaaggctgcacctgccccagctcactctggctttcggcacctctgcagagtttggagtgtggtccacaatagccttgggccagagagacttggtttaaatcttggctctgccacttgctagtgacttgaccctgggcaatttatttgacctctctgggacttccctttgaaatggggtttttgaggatgactgcttataaagcacccagtagaaagcctggcactcagtccttgctcagtaaggggaactattcagtgtgtgaaaccattctctgttattttatgtagtcttgttttccaaatgtgttttaagtcctggaaaggaaggaatatgtctggtatctcttttgtattcaccatataaaattgtgggcagtaaacagtcaatctttgatggttccctcattgaaatctccagccctgaactttcccaagggccttctcaacatcttccacttagctatctaactgatattcacacagaacctagtgtagaaataatttttggttcccatcaaaaatacctgctcctctctgggtcttccccatttcataaatggcgggcataacccatccggttgctcaggccaaaagcctagtagttagatgtaattgttctctttacctcaaagttccctactcccatctcctccatcagtaatgtaatgtccatcactcccacttcaaaatatgtcctgggcctactgcttctctctcctcctccggagttaacaccaccatctaagccccatcaacttcttacgtagacaaagcatgagcctcaagactggtctctctgcttccactcataccaccccattgcctttttaacatacacagccagggtgatcttttaaaaggtcctatcatacaattcccctgcttaaaatccttcagtggctctgcactaccaagaagctatagagttgttaaagagattggtctctggagctagactgagtggactcaagtgctgtctctacctttcattaactgtgatcttgcatgagttttatactttgtccgtctcagtttcttcatttctaagttggggataattagtaccaagcttatatgaagattcaacgtgaggattcagtgttacattgaaagcacttaaaatggcaggcactaggtggacagaaagcaattagtaaatctaaaacattttttgttttatttctatttgcctgagacctgaccttcttgccatggcttgaaggatctgacccttggctgcttctcaaacctcctctcctaccactctcccctcctgctccagcctcactgacttcttttagttctttgagtagcaaactcaagtctgcctggagcctttgctcttgcagttccctctacatggaggaatcttccccacagatctttgtgtagcaagttccttatccttcagctctctgatcagtgctaccttttcacagaggcctttctgatgttcctttctagaagaccccccccccccgccaacttatgtgccagccctttcccgtcattacgggctactttgcttcatagcactgatctgaaatcatatttcttattgtttacttattatttgactcctccagtggaatgtaatatagatagagaccgtgtccttgctattcccagctgaatcctcagcctttagatctggatttggcacaaaataggcatcccatagataatcattgaattaacagccgaacacatttgttgattgaacccacatgtttcttgacgtgtgggagcaagtagctcttcaggtctctgtttagcgctcccaggacctggccctgcctcccctctccaaaaccctttgtgttcctctgcagatcgctatggctcagagcaagagtttgtcgatgacttgaagaacatgtggtttgggctctattcaagaggcaatgaagagggggactcgagtggctttgaacatgtcttctcaggtgggagcacttttcttggaaagaaagagttggagggatgaagaggaatggctttgctcaggagcagggcagccctgggtgtggattaatcagcagtccagccagctagtagggagggacccacgcactctcccctgcccatatggcaggggggcgggggggtgtctgaggagccattctgagaaacagtcttttctggagtacctaagggggaaagaagaccagatgctggggctcccaagggggtacatctaggacaagacatgtgtctgggagcaagtttgcctacctctgaacagtcctttgcttccagggcctggccagctgcttcccaagagggccatggtctgttcccccctattctaccccataaaactcccaccaagcctggcttgctgctggagtaatggctgagagaggtcatcaggatcaccagaaggaaggattctcccaagggcttgagccagaaggggggccttcctgaggtgagagataggactgtgagagactctggggactcacagcaaggggtcaagcagctagaagtcagagactggagaagggggaagccttggcatggggtggagaaaggggattggaggggagggtggggaaggagcccagattatccatcttggactctttattataggtgaggtaaaaaaaggcaaggttactggcttccataactggatccgcttctacctggaggagaaggagggtctggttgactattacagtcacatctacgatgggcctgtgagtacacggactagaaaagccttgtcagagcccagatatcctgctctcactctgtgttccaaactgtcgacttgcctctcagcctgactctcagggggcagccccaggtgattgtgactatcacgtcctcacctgctagacagccactttagccagccaggacactggaattcccttccaaacagtgaaggctctagaactgcaggggacaggaggcaggaggcaccatatcggggtgggagcctggggcctggggaggattctcagagggaagaacaaagatatgtaattactccctgcctcagtttccttagaacgtggctgaaagtttcagcctggctagtttgagctaaacttcatacactttataagacagaaacctttgctgcccggtaccaggaaataatttgggggcagtaaacgatccttctcttccatgtgtgagggccactgggaacagtgatatccttgatatccagaggtggatcctatggatagtgattttggcctttctggtagatgtgcactggcagctccaggcagagggtccgggtgggctcagacaccttagcaaggcagactgcctcttctatttaaagaatccagtctccctggaaggttcacacaggcccctaatggaccctcaacaaatactgtctgactgttgccattgggcacccgttctactccactctgtggcactcaccagacccccttttctgcccttccctccacagtgggattcttaccccgatgtgctggcaatgcagttcaactgggacggctactataaggaagtgggctctgctttcatcggcagcagccctgagtttgagtttgcactctactccctgtgcttcatcgccaggccaggcaaagtgtaagaatggggccagccaggcctgggggcagactggggctgcaggctgtcctcagccatcacagagtcaagagacctggactctgccacaaagaggctgagagggcttggacaaatctgtgctttgggcctcagttctcttgcttgaacaattaagtttttggattggtttggtggctgccaaacttcatcttagcagcaaaattatctcccctcattcccccaaagtgaaatcttacgcaggaccttaatatatgaaatagaaatggagttgtcctagagctctcagcctctttatttgtcccctgaggctacttaggggaacctagagctccagaaagtaccattaggaaccactgggcttcaagttctctaacattcggacacgttgagttcttccacttctgaaaccctaagcaaatgtttaatttctaaggatttcacctccagaatctgggattttggaatattgctctgggaaagatgaggaacagcattctttaagaagacaagaaataaggcaaagattttgaaatggctccttgcacatggggagctggaggcagctgctgaagaaagcagtgccagctctgtctttaaggctgtttaagcagaatggagcccttctgcttcagttgggcttgatccttccagcccagggagaggcagcgtgaagtggggagctcctctgatttcaggctctttccccacaggtgccagttaagcctgggaggatatcccttagctgtccggacatatacctgggacaagtccacctatgggaatggcaagaagtacatcgccacagcctacatagtgtcttccacctaatagaacttcgagccagaaaggggcatgagggctcttgcgagactgaagtgctatcttctctggactagagagaagagggagaggactggaagggatcaccaaatctcaaagcaatgagaagcattcctaaatcccaaagtgcccacatgggaaagagataaaatgtacaaattagaaaaatgtggataaacagtcaaacctttatcctctagaattttggcaatgttgactaagaaacagagtccaagcagagaaggtaggaaccctccatagctctctgccctgatgtgtgggggaactaggaagaagtcctttgacctcaccaggcctcatgcttccctttaatgtaaagggaaggggtttgcccactttcctctttttggggttggtgagagggcaaaccctgatatttttactgtgaaggtgttttcagttgttcttaggaagaacagctgatagaaattcaagattactataatggctgttattatacacagctctgtaaactaccactcagccctgtgttggggtcctcaaagaagtaaggccacagtaatcaagcaagggcctttggttttttccagagttagatcctctcagaacagagtctgggagaactccaatgctgaatggagaagggtaataggttggtgcagtgaatgggctgggggtggggtggccttctccaggcctgagtgtttttgtgtccagctcagtatctgcaacaagaagtttcccacttgtggatgtttagtgcagccacagacttgtattttgatccccaatttttttttgaaagagttctcctcataggaggatgattcagcatcagaagaagaaggaacccatagcttggtgtcattaacataattattttaagccttatccagcagccataatttgaataactctacgagaccagagagactgtagttccctattttaacctcaattatgcatttgtcccccaaccccactgagaactaaatgctgtaccacagagccgggtgtgaactatggtttagaaggttcaagtttccaattaaagtcattgaagaaaacttgaaa

SEQ ID NO: 464 - DNA, 19543 bp, Homo sapiens
agctcaaggaggtggcagcatcatgcttctaatgcaaaggtccttagaaggatggttcttaccatgaatggctcgtaccatgatggtaaggatggccttaaccatcaataagggcagattatggcatagttccactagccaatcctttgggttttgtttcagaggacaaatttgaaaccagaacagtttgggtggagagtgttaggagggaagggaagagtagggtggcgatgtattggatgctgcacatttgttctttcatttaatccttacaacaatctttgagtaaatattattggataaggagagaagaaacctgcccaaggctaagtggaaaaagtggcatcccaccccaagggtacctaatgcttggcaaggagcaaaaccactgaagggagaacaaatcatgaacaaagagagaaggatccagagtccacgtggccatcttcaaaagtttgcctttgccttgcaacttaaattgcctttctcatgagaagcaaaaacattcaaatgcaccattttcctggcatgtaggaatgctttggtctacatgttcactgcactgattctaataattctttagcctttataattcttttcattctcctggaacacttgaggatttggggacttgcttaggtttctctccataggctgtgtaaagatttttagagttgaactgattcgaggcaggtcttctgacacccaaagcaatgctttcttgatgacttctcctttagtttcaaaagccactgtattagtccattttcatactgctataaagaaatacccaagactgggtaatttataaaggaaagagatttaattgactcacagttctacatggctgggaaggcctcaggaaacttacaatcatggtggaaggcgaaggggaaacaggcaccttcttcacaaggcggcaggagagagaagaaagagtgaagtaggaagagctctttatcaaaccatcagatcttgtaagaactcactgactatcacaagaactgcatgggggaaaccgctcccatgatccactcacctctcttcctggacacctggggattacaattcaagatgagatttgagtggagaaacagagccaaaccatatcagccaccctttaggattttaccccagtgtgaagcctgcgtctcaacaattagatcgttggtgaggagggtatagcaccatttatttctttagtaatctttcataattttgcttagttattgtatcagttgttttctaaaattgtatcagctgttttcctttatttttatacccatcacttgtattttatgccttttaaaaaacagaagtgggctgggtgtagtggctcatgccaataatcccagcactttaagaggcccaaggcaggcagatcacttgagccggggagttagagagtgtagtgagccgtgattgtgccactgcactccagcctgggtgacatagtgagaccttctctcaaaaacgaaacagaacaaaaccccaggagtgttcaaagaccccagaatttggcaatacatgacaaatatttaatgtgtttctataactttaattcagaggcatctatatctcacctcagcatgtgtcagcaaattaattgtaaacatgtgctgatttttagccttagtatttaagaaaaacttgttaatcatttatgattcccttcctggagataaaaatgaataaaaccagttttatcttaaaagaaagaaagaaaagtttaaaaatggcatgctaatgatctaagcccccagtgttaaagtttcctgggagcaagcagagtaggggcactgtcacatcacaagccctagctgatccccttcttcggggtccccaggcaggggctagggtgaagccataactgccatcacatacttgccactgtccctctgctgtgttcctgaagcaggtgacagtgatgtaatcctatgcaaagagtattgctacctcctaatcagaacactgctgaccccaggccagcctcaaaaatcctccaggatttttgtcttcctcatcatgttaaaagaaaaaaaaaaagaaaagacttcaatatggatgctttgcatgctcattgctggaaaatacagaccaggccaggcgcagtggctcacgcctgtaatcccagcactttgggaggctgaggcgggtggatcacttgaggtcaggaattcgagaccagcctatccaacatggcaaaatcccatctctactaaaaatacaaaaattagccaggcgtggtggcgcgcgcctgtaatcccagcttctccggaggttgaggcagagaatcgcttgaacccgggaggcagaggttgcagtgagccgagatagcgccactgcactccagcctgggtgacagagcaagacaccaaaaaaaagaaaagaaaatacagaccaacaaaaaagaagaaaataaaagtgatctagaattctcctcgcctcaggaaaaaaacctaaaatgttgatatcgattctcctcagtatctcagatcacaaggaccttgtcctctgtgttcatgaactagaccttccagcgacacagattaacccaactggaagtttctgtttgtttttctctggagtcgttttctggaggttggttccctaaactttttgggcgaggggcacggattccggagataggtaggttgcagttgtgtttgtttggggttgttttcatttccaaatattcacctcccagcttgggggccgagaggtatctcaagccttctttcgcaaaggcatctatattcaagacccagccgttttactcggtgttgttttttttcttagatttttttttttttttttgagccccggcagcttttgttcctttgaatttaagtgtttgaagcttggcgatggcaggaattggctttggccttgagatcttaatatgtaatgatgactggggctgcagggggccctgcctctcccgctgccctgctctggaagcgcctgggtatctgagagttcagagcaggctggaggggcggagcttggagggacgctggcggcccgcgcctccggtaacctagcaaccgacgccctagcaacgcgagggggcgggaccgagggaggaagtcggaaactggtggccgcgtctcgcgagagttgcttttgcgcgcgaactgtaagtgccagggtctcagggtcaggtcgcggctggtcactgtgcaggcgcttgggtgacgcgacgatctcagcggatctggtcaccttcgtctccccgccatggagacctcagcactcaagcagcaggagcagcccgcggcgaccaagatcaggaacctgccctggtaggaggaggccgagcggcggcggtgggcagagggggccaggcggccgcgcggggaggaggtggctggggtggcaggtgaccggaccccaacccgacctcttcccgtcgtctccaggcctgcagccgggaccgacctgcagaggtttcccccgacaccccccagctacccagactcgtccgttctgtttagggcttttgccagttctcaccctttcacccccagctccatttgccgaagaagaaggcggctttcgcacctggtgacagcacaggggttcgatcccgcgtctcctgacgcctgcaatggcctccatgccaaaatgccctcttcccactcttcaaaacctgcgatgcgactattggtcacattttaaactagtaataacgctccctggtcaacttttattgaatggcatattattagattagcagacgccctgttagatgttcgatccttacaaagaccgtaggaggtaggcaccgcttcaaattttacacaggaggaaactgcattttagaaagatgtaatgacttccctatggtccaagggagaaaattggcttggaggtgaatctaggaagtctgaattcagatcttgtactcttaaccatcctacttaaacagctatgttctcgcaatgcttccaagactttgaagcaatttggcttggcttcgaaaagctgcaagttgtcattgtctagtaactagttcaatttgtctttattgtggttaaaaaaaacccagaagattgacagttgtaactattttatgtatttacgtattttttttttttagagacagggtctcgctctgtcgcccatgctggagcgcagtggtgtgatcacagctcagtgtaacctcaaacattggggttcaagccattctcctgcctcagcctccgaagaactgggacttttagaggcgagctaccaagcccatcctgtaaccattttaaaatgtacaattcagtggcattaagtacattcagaatgcagtgtactgttgtggagtcttcccgctatctagttccaaaatttcatcaccccaaatggaaatcctttacccattgacagttactccccattctccccttcctctagcccctggcaaccactaatctgctttctatctatggatttgcctattctggacatttcatgtaagtggaatcctacactatgtggccttttgtgtctggtttctttcactcaggatcatgttttcaaggttcatgcatgttgctgcttgtatcagtagttaatttcttgttatggctgaatcatattccattgtatggacagaagagattttacctatccattcttctgttgaagtctatttgggtaggagttcagtttcaaatgcactttgcaatagtaggtgcccatcaggttgagattataggcaaacagctggaaagatgaagttagaacagagttttcaacctcagcactattgacattttgggccagatactctgggtgggtttaggggagctgtcctgtgcactgtagcatgtttaacagcattcctggagactacacactgagtgccataggaccctctgcccacctgtgacaactaagtatgtttctagatatcactagatgttcctaggaagacaaaatcacctgtggttgggaaccactggtctgttcaaacttaaagtgctttcttattcttcctttttaaattaggatatgaaaggattctgtttttttttttaagacaaggtctcactctgtcgcccaggctggagtgctggagtgcagtggtgcaatctcggttcactgcaacctccgcctcccgggttccagcaattctcccaccccagccttcggggtagctggggctacaggggtatgccaccatgcccagctaatttttgtattttttggtattttttattgaatggcatattatcgggttagcagacaccctgttagttgttctatccttacaaagaccctaggaggtacccatagagacagggttttgccatgttggccgggctggttggtcttgaactcctgaccccaaatgatccacccaccttggcctcccaaagtgctgggattacaggcatgagccactgtgcctgacctgcaaggattcttttgcacataaaatattcttgcatttatatatgtcataatacatactaaattgtatttcagggttgaaaaataccggccacagaccctgaatgatctcatttctcatcaggacattctgagtaccagtaagtattcatgtgtcagttgctcttgtcctgcttgagcgacttgtataaattgcttggtgatgttgtctctcctaagtaataacttcaaagaatctgattgcgctttgtagaatgtggctttaagatcattcattcattttcttcaggttgctacagtccagtgggtaagtcacaaacatgagcataaaattgcaacacagtggagtaaaaatagcattacggagaatcatttaagttcacagatgttgccagcacccagaaaggtgcctgtaacacagtaggcactcaataaatacttgttgactggctgcgctattgagtgaattccagttgttccacgaaagtagatatgaggcccctacatcaagttgtatctgcctctgatttggacattgaattgggttgaagagctttcagcccaactcaggagcccagggtgaatgaggcagctcccaaagactgatggtgcccttcttccttcctgatcctcagttcagaagtttatcaatgaagaccgactgccacacttgcttctctacggtcccccagggacaggcaagacatctaccatcctagcctgtgcgaaacagctatataaagacaaagaatttggctccatggtcttggaggtaaataagattgttcttactctacaaataacttaagagactccagtctcttaatttcagttctgctggttttattttactttaaaagtaagttgccccacggacagttaggaaagaagtaaatttgaatattttaattccctttttcctataatggtcattttggtctggattagcgttggtcagctagagggcagttgtagggtttggcacctttttctttgctcttgccaacttctccccaaaccttactttatggtgacttggttgctgcctgtctgccatggcccctctagatcaattctccacgtttctccaccatattcctgcctggaaggctgagccctactgactataagctcacttaccctctggctcctggttgggtttggccaataggggccttggcaggggtgggggaaggaagtgagtgatgcctgggccttccctgggggctgacacaggctggcagcatggcccacctgtagggtacatctcacaggtggtacctttcctgcagccctctccaggtgcctacagccactcccttcactaagcccttcaggctcaagggtgacaggtattgcatagccccatggttttcctatatcacacctttaaaaagatcttgtttaattctcttcaaattgctgcatttgagtatgccatctgtatattgctgggaccttgactaatatacttagattcaaaaatctgagtattgtctattgcaagaaaagtttaacttactttttagacgcaggtctcagaactttgctgctactaatgtccttatttcagtttattaagaacttggtaacttaggattgtggtagctgaaatttgtatcattctgctcataccagaggtgctgttcagtgtaaccataccaattaattatttctccaatttatgtcagtcattgtcctcaaagggtgggggtaatatagccatctttattaatttagtgaattttgtgtaaaactgattttttattttatgatgatctcttagccatcattagacatagagagctagcctgctgagctggactgatgaggaaatacactaacaccaagaactcacagatagcacagcaacatggtttttgttttgtcttctgtcttccacatttagctgaatgcttcagatgaccgaggaatagacatcattcgaggaccgatcctgagctttgctagcacaaggacaatatttaagtaagaattatttgtgtaatttcgctcccttgattttgattagtaagatgatatgggttaattttttaatcctctccttagccagtttatatgggttgaaaaaaaaagtgactttgtccaaagcaaccatggaaaagagataaacgagagggatggtagtaagaagcgttataatgcaactgttaaaataaaatgttatctacgcttgtattagcaagtttgttttttttttcttttttttttggagacagggtcgccctgtatcgtacaggctggagtgcagtagcatgatctcggctcactgcaacctccacctcctgggttcaagcgatcttccagcctcagcctcctaagtagctgggactacagtcgtgagccatcacgcccaactaatttttgtattttttagtagacatggggttttgccatgttgcctaggctggtctcgaactcctgagctcaagcaatctgcccgccgcagcctcccaaactgctgggattacatacgtgagcccagcctgcattaccaagttctttagggagcattaacttcatttttagttcctgagaactggctagattaccctaagactggatgagctagtttgaatttaaaaataaattgagatcaggaaggacaactaggatggtggctaaaaaaaaaaaaagaaagaaagaaaaagggtgagggccgggcgcagtggctcacacctgtaatcctaggactttgggaggcctaggcaggtggatcacctgagatcaagggttcaagaccagcatggccaacatagtgaaacctcgtctctactaaaaatacaaaaattatctgggcatggtggtgggcgcctgtaatcccagccactcaggaggctgaggcaggagaatcgcttgaacccaggaggcagaggttgcagcgagccaagatcgcggcactgcactccagcctgggcaacagagcaaaaacttagtctcaaaaaaagcaaaagggtgagggactcaggcatgagtgagggagacgggaaaagcagtagcatggtagggtgccatgtggaggaaagtgaagatgccagaggacacagcgcacagaagtagagaagtctcctccattcccaccaagggttgaaggagtgatgcggcatttcctctctgagtgaccaaagatgtctgccttggccaaagttctagaagaaattgtctttctgagacagggcccgatggcacaatgggaagatataggtttgagcccagatgttgagatgagattgaagaaatctttagacagcaccatttgtttttctaggaaaggctttaagctagtgatcttggatgaagcagacgccatgactcaggacgcccagaatgccttgagaagaggtaagcagaggcactgtggagcgtttgggctggtgtgcacactggaaggagaattaggaactttgtgtttgttgctgttgtcattgtttttttaggcgggggggagtttttttttctttttttgagtcagagtcttgctctgtcacccaggttggagtgcagtggcgcaatcttggctcactgcagcctctgcctcctgggttcaagcgattctctgacctcagcctcttgagtagctgggattacaggcatgcaccaccacacccggctgatttttatatttttagtagagatggggtttcaccatgttggccaggctggtctcgacctcctgaccttgggtgatccgcccgcctcggcttcccaaagtgctgggattacaggagaattaggaactttaagcttcccaaagtgctgggattacaggagaattaggatgtgagatatggcttggcttgttttcagttttcatcttctggcccagagaaatctctatgcctttctctgtgtctcccatctaatgacacaggctagatacctctgtagcgggacttccccttcagcagcctagggactaagccctgcggggacttttaagtctggccagtcactggtgttcaacctcctttgacactgggttcaatttcagagttgggaattcatatctttccgtgggatggggtgtggaaaatctttcatccttaagctatcagatagtccttctgctaatagtaccctctcctttctactaatggtaccctttgaaccacaatggctaggaaaagcatatctgaagttgaggtgctcagagagctgatattacttcactgcttgccaagtgaatgatttggcagcgggagggacagcaccctgcgatttgtctgtcttcaggggcctagcgcagttcttttctcttaaaggacacttgtcatctctcattaagattccaagtgaatcagctttgagagaagaacgatctttaggagtttgtggcgagggagtagatggcagcacatgttaagagaaggatgggggaagggggaggaggaggaggggggaggaggggaggaagaggagggggtgaggaggaggagggggaggagaaggcggaggaggagggtagggggaggtggaggaggagaggtgggggaggaggaggaggaggaggacagcgagaatatcttctggtcctagaagcttggcagcctttcttcggcatcttgttctgccgagtgactgtcattctgggcagatccccatgtgagaacattgggtacctacagaatggaaccggtgtcataagcaactctttgttcgggttattgctcccttgagtgctctaaggcctccagacagtctccatggaaaagtctgcaaaaagccgccctccctgcccatagaaggtgaagtgtcatcaacctgccaaatataattttatgtaaaaggacaagaagtctcatagtcttaatgggattacatggcaaaagtgccagaatcatggcaaatggtaaaaaggaagcattttgtaaaatcccacggaggcatgtttaccagtttgtgaaagaggggtggctaggcagggcgcagtggctcacacctgtaatcccagtactttgggaggctgaggcaggcatatcacctgaggtcaggagttcgagaccagcctggctaaccgatgaaaccccatctctactaaaaatacaaaaattggcctggcacagtggctcatgcctgtaatcccaaaggccaaggcgggcgaatcatgaggtcaggagatcgagaccatcctggctaacatggtgaaaccccgtctctactaaaaatataaaaaattagccgggcgtggtggcacgtgtctgtagtcccagctactcaggaggctgaggcaggagaatcgctttaatccgggaggcagaggttgcagggagccaagatcgtgccattgcactccagcctgggcaacagagcgagactctgtttcaaaaaagaaaaaagaggagtggctaatctctgatctgaacaggccagcactgccctgtcttgtcataggctgcagcctcacttgtttacattctttcttttttgagacagagtctcactctgttgcccacgctggagtgcagtggaatgattttgggtcactgcaacctccacctcccggattcaagcaattctcctgcctcagcctcccaagtagctgggattacaggcatgtgccaccacacctggctaaattttgtattttcagtagaggttttgccatgttggccaaacctcctgacctcaagtgatcctcccgcctcagcctcccaaagtgctgggattacagacgtgagccactaagccactacgcccggccaacatcctcacttgtttgcagtattgaatcttttcctatacccttgtgaccacagaaaaattcaagttttctgggctctctgaaaaatcagaatggactttgacatgaggtggttttattttctcttactagtaattgagaaattcacagaaaataccagattctgcctcatctgtaactatctgtcaaagatcatccctgccttgcagtcccgctgcacgaggtttcggttcggtcccctgactcctgaactcatggttccccgcctggaacatgtcgtggaagaagagaagtgagtattttgcgggcctttggggatggagtgtagtagaaacaggcttgtgggatcactggctggttcgtatgtagaggagaggaatgttggaaaacgactttgcagagtgcctagcacaggggaggcactggggaccgtccactgctatcattttctctgctgtctcaaggccattcctcataaaagtcatttggtacttcatttttcttgattccatcctcctcccctggaagctgtcccaatttcctcctactcttctttgtcattggaaactgcaggctgctgagtcccttctgcaaagatgcttccagcctttttagactagaagggaaggttctaagacatcacattctgtgtagtcagatgccaagcaagtagccgacctgagcagctgcttgttgtgaaggaggagtttcggctgtgtgatcatggcttgtgccaggcctctgtcctccccagagagcagaattcaagacgactggctccatgggagaatgcttgttcctaaattcaggctgttctcgattttggttggctgtgactactaatgtgaagcccaggtccctaaaaaccagagtgaattctagatcatatagatcaggagattattaactctgttcctctccttccttcatccctttaaagccttaatcattccaggccatcttgttcctttggtgaatgctggtgctctcagggggcctcataaatcccttttgcttatttctttcagagttgatataagtgaagatggaatgaaagcactagtcactctttccagtggagacatgcgtagggctctgaacattttgcaggtatggtctcaagcaaatccttttttttttttttttttgagacagagtcttgctctgtcgctcaggctggagtgcagcaacacaatctcagctcactgcaacctccgcctcctgggttcaagcgaatctcctgcctcctgagcagctgggattacaggtgcccgccaccacgccctactaatttttgtatttttagtagagatggggtttcgccatgttggttaggctggtctcgaactcctgacctcaaatgatccatctgcctcagcttcctaaagtgctgggattacaggcatgagccaccatgcccagcctggtcccagcaaatcctgagtcattgttttgtaatagtttttgaagaaagacctaagcaaaggcatgatcaatctgtaaattttgaaatctacagctggtaagaccttggtctcataacctgcaggattccccctcctcactttgtattttgattaattgaaaaaatcacttgttgcaggccaggtatggtggctcacgcctgtaatcccagcacttagggatgccgagggaggtggattgcctgagcccacgagctggagaccagcctgggcaacatagtgagactctgtctccactaaaaaatcatgagccaggtgtggcggtgcacacctgtagtcccatctactcaggaggctgaggcaggagggtgacttgagcctaggaggtcgaggctacagtgagccatgatcatgccactgcacttcagcctgagcaacagagcaagaccctgtctcaaaaaacaaagagagagcaaaagaaaatgttttaaaaacaaaaggaatcatttgttgcaaagaaggcaaagggagggaaggatttggcactggaatagccaacaggctgtggcatcctctgatgaggtgactcttccggtattgaatatgtgggttcccactgccttgtgcccatagaactttgctgctcacctgcattgctgccttggcaatttcttcttggctccctgcagcttggtggcagctgtgacagccactgtgatctcccctttccccctctgtctacacagagcaccaatatggcctttgggaaggtgacagaggagactgtctacacctgcaccgggcacccgctcaagtcagacattgccaacatcctggactggatgttgaatcaagatttcaccacagcctacagaagtatcctttctcatgacctcctggccaccgagacctgaaggtggccccaggagttcaggttgcagccagcacccacaccttgctggcaaaggatgactggctgcaggcgactctggtcagcttgttgtgggagtgagatgtctgtaggtggagtgggtacttgtctttagcactccagagttcttcttggagggctctgaccttcaagtcagggtaaggcttgaagcagcttcactcacagatgggagaaaagcttaggccttggcattgaagatgcaggaattttcaagtggtcatgatagtgatagctcttgtgctgtgaaatgaaaggctaggaatggtgacacaaagcctttttggaaatgcatttggggctgggtgtggtggctcatgcctataatcccagcacttttggaggctgaggcggtagatcacttgaggtcaggagttcaagaccagcctggccaacatggcgaaaccccgtctctactaaaaatacaaaaattagccgggcgtggtggtgggtgcctgtagttccagctactcgggaggctgaggcatgagaattgcttgaacccgggaggcagaggttgcagtgagccgaggtcatgccactgtactctagcctgggtgacagagggagattccatcttaaaaaaaaaaaaaaagaaagaaagaaaaagaaaacgcagttggctttattctctactagaaggagttacaactctatctttcagaaagcccttactgaagatgaaacaaagaaaaataaagaattggagtccaacacgtgcagcttcaagttgaaagagaaacagttgtgttgggattaaaagccttactttaaaaagtctcttgcccgggtttggattcaaaattctctgcagtatgtttgttctggaacttgttccctttgccttaactgctcctctagatattacagagttgaaaactctgaaggggttggcactgcatgatatcctgacagagatacacttgtttgtgcatagaggtaacttacattatcccccagctgagaagctgtggagaaggtagcctgctttggggttaaggatggttaggacaggaggcttcattcttgaagcaaagaaactaatgaattgtaaatcagacccttcttgttagcagttctgtcttgccactgtttaaaattttgttccagagctgggtacggtggctcaagcctgtaatcctagcactttgggaggccaaagcaggcagatcacctgaggtcaggagttgaagaccagcctgggcaacatggtgaaaccccgtctctactaaaaatacaaaaaattagcctggcatggtggcgcacgcctgtaatcccagctacgtgggaggctgaggtgggagaatcatttgaacctgggaggtggaggttgcagtgagccaagatttgccactgcactccagcctgggcgacagagctagagtttgtctcaaaaaaaaaaacaaaacaaaacacaaaaaacgtgttccataaaccctcttttaatatctagaactgctggggaaagtgaaaactcctggaggctaactttatttcctctaggggtttatattttatagcagtaagtagtatatattaattcacatttctaaaaaaaaaaaaaaagtctgtctatctatctgtctatctagatatatattcccagaaaagaaagagaagatatgtaaaccatgtaaaccaaagcaggcttaaggaaaacatcttaagttccacacttgcctgtaccttctacacagagaattggttctcaaccttggcagcagataggggcactccagacaaattaagtcagcttctcggaggacaaccaggcatccgtattctctaagctccccaggtgacttgtgtaggctttcggagaagctcttccttccacagtggccaactgcaagatggagacttaaccgggtcaatgaatgttggttctgcccaggccttcacaggcctcttcctggctggcccatgccatgccttctgcccaaggtatggttggctcaggcccagctctgcaccttgattgtggaagctgagcataaaccaactttaaaaaatcagttgtttgtgcttggtttttaaatggggacaggatcggtatagtggctgacgcctgtaatcccaacactttgggaagtcaaaatgggtggatcacttgagcccaggagtttgagaccagcctgggcaacacggtgaaaccgcatctctacaaaaagtacaaaacagccaggcaaggtggcgcacacctgtagccccagttactcaagggtcttgaggtggaagatccctcaagcccaagaggtcaaggctgcagtgagtcatgatcacgccatgccatggcactccagcctgggcaagacagtgagaccccgtctcaaaataaagtaaaatataaaataaaaacagcaagtgggaactcagcattcaagttaacttgtagagctacccagctgctaagagcagtgtgatctttggtgctcttaggatcactttggtatctgctcattttcctttttgtctaccctataaagcacaaaatcgagtgggtaaaaagtatgaaaccagcactgtttctactttcttagaggtctggtatctagtgagcaggctgaggcctcaggactagttcagtgttaaggatttcatgttgaaactcatttgtcctctgtgggttttttgacagtagagagtgacctaactcatttgattttgtttttccctcagttgactttccatcttcagttcgaatacatttattgaccaaaatggcagacattgagtgagtacttcttgccccagttttaattcttttcttccttttttcccctgttgtgagttatttgtttcaactttcttggtttcaggtttttttcctaaatcgttcacatacggtacaatctagtctggtgatattgaatggaatgtggggaagggtgtgagctgcttaaagaacatggggataaattcacaggtcaagtacagatcagttacatatctgagatgaaggcctctccttggacctcacaggctcggcccacattgattctgaaaatgcccttgttatttgggaggcctgctttgcttcaaccacccagctgttattaaggcattttggcatactaaagcatattggggggaaaagtaaacacaaactcaattttctgctttgcctggttccgtaaacactgttattagcccccagtgaagctggcagctatcatttaagtagacagagcattgggttcaacatagacgtcagcataggccaactctaatttgtggcattggctttcacaggcacaaattaggtcacctctcctcattgcattgtgaatatgatgattttgctatcagtggctgggcatttaaaaggtggcgagatgaactccagtgtcctgctttactgactagaccacagacccaccaatgtatcagccaaacttcccgatgaaatggcttaagaggaaggaaatctctgttttgtttccctcttaacgtattttgccgacgaaataatccttcattacataaattttgtatatctgtatagttaggacaaagttaagttcagaacaccgctgttgacacctaataatttatttctttttttgagacagagtcccactctgtcgcccaggctggagtgcagtgatgcagtctcggctcactgcaacctctgcctcccaggttcaagcgattcacctgcctcagcctcctgaggagctgggattacaggcatgcactaccatgcccagctaatttttgttttttgtttgtttgttttgtagagacgggggtttcaccatgttggccaggctggcctccagtgattggcccgcctcccaaagtgctgggattacaggtgtgaaccaccacgcccggcctgatacctaataatttttaaaattgaatcggtccttacaagtttgaaacatcacatttataaatcaatgtgtagggcagagaagaaaatgttagggggacacatacaagattgccatccagggcacatttgttctatcaattcccatccccactccttcaacagattttcagccctagatctcttggtcccttaagaaaaggcagctgtgtttggtgtcttttttcttaccctgtgtttggtttctgttaggtacaggctttctgttggcaccaacgagaagatccagctgagctccctcattgctgcatttcaagtcaccagagacctgattgttgcagaggcctagatgctctgagggccattcacaattctcagggctcagcagtgatgggagaacagaggacagttccaggataaactgctgcctggggctgtgggatgaatcagtcaccccgaatcttggaaaaacccccttccaggagaggatgggcaggcatttaaaaagtaccatttttgtggttgtttggagcagggatgtacaaaataattttaatgtattaactcatactgcctgtcttttataggggaaaaaaataaccttttttattttaaagttataaggtttttaccttttagttgcttggatgacagggaattagcctaccccattttggtctggaacagaagactttcaaatttaatatggtccaagtgtcttcctactcaaggtaaacattatctccaaaattacatttatgattctaatatttggcattgtgtctgtatctaatttaaacagatgttaatggacgtctggccgaaactattatacttttataagatgagctgaatcctcttactttaaaaactggtctttttatttaccctctgtggtagaagagtcaccagcaggttccaaattgatgtgtatgataggaaaaaaaccttaattttaaatataatatagagccttaaactatgccactgggtggcagaggctgtataaaacgcacttgttttcatgcaggagcggggcaagtaaggttgagcctgactgtaaacctagaactgcggaaggactgggacttttgtacaaatttcacatttattttacagcaatcatgctgcatttgtgttagtgttctttataataaaaaacaaagcagcctcctggctggctgtgttacaagtgactcttccttagacagctagaaagatgctgactttgtcaaacttgcatttatatgaaaaccttctgtctctaatatcacagaataaactttctttagatgctgttctttataaaatgtcaaattcttaaactgtcaaatggaaaaagtcactattccctttgttcatggaggactcacccccttaaggacagcggcaaagtatgaagctaaatatctgatggccaaccaggcctcaaaccacccagaggctcagcatctgctgtacctggaacttcaagataaccatgaaatgtaaacgttggccaatccattcccagctcttctgctgtactacttgttttatgtgtttattttttgaggcaagatcatgctctgtcagtcacccaggctggaataccgtgacacgatcgtggctcgctacagcctccatgtcccaggctcgagcagttctcccacctcagcctcctgagtagccggaaccacagaaccacaggtaaatgccaccacatcctcagccccctgagtagctggggctaccatgcacaccagcaccacactaagtttttttggctatttatttatttattttttaaataaagattgggtcttatctcactctgttgcccaggctgatcttgaactcctgggctcaagcagtcctcccacctcagcctcccaaagtgctgggattacaggcatgtgccgtcacacccagccctgcttgttttaaaaggggacttttttttttcttaatggaaaaaaatgaaacagagagccaaaagcttttaactgttgtttttttcttttcttcaatgaaagcctctcattttgaaaagacatgtttttcttcaagcaacaaaggtggtagaggaaattcctcaactttctcaacgagtcatgtaacgttacactggcctccataaagcaccgattaagaaagctaaagaataagatgttgtatttcttttaaaataatttaaaatatattaaattttcctaaggcag

SEQ ID NO: 465 - DNA, 32285 bp, Homo sapiens
gaccggtccagctgagcctggtggcggaaaggctgcggccccgcgccagagggccggtggctcctccgggcttctgaggacccgcagggagcgggtgagtgagtgtgtggcgagagggcgctaagcggacacggggatcctttcgaagctatgggggcattctcgggaaacgctgagtcccttttcccgccacccggtttagagccagggggcggggctcgtgctgcaggcgcgcacgcgcaattctgtactctgctccttagtctcccgcgccgcgttcccgggtctcaccggacgcgggcttagccctacgctgctccgcacagcttgggtctcccgcgggatggggttgtgatggaaaggggcttggaattcctgaattagaacagaaagtgcctgagggagttccacttcggagcttagcatctagttgagacctcctgaaaaaaaccggtgtgtggcctggcggtcagcagtggtcggaattcacaggccgctttacttatatcgtgggttttatggaacggatttctcactccctcccttcgttgccttgttcgggtttgtcacctggacctcagccgctaatgaagcttttttccttgagcctctcaattctttgccattcgtgcttcgactagtactttcaattttttatttattttattttattttgagacggagtctcgttctgtcgcccaggatggagtgcagtggcgccatctcggctcactgcaacctccgcctcccgggttcaagcgattctcttgcctcagcttcctgagtagctgggattacaggcgcgcgccaccatgcccggctaatttttgtattttttttagtagagatgggggtttcaccttattggtcaggatgatctcaaactcctgacttcgtgatccgcccgcctcggcctcccaaagtgctgggattataggcgtgagccaccgcgcctggcctgtttgttttttttggttgttttgttttgttttgtttttgagatggagtctggctctgtcgcccaggctggagtgcagtggtccgatctcggctcactgcaacctccgcctccccagttcaagcgattctcctgcctcagcctccccaggagctgggattacagctgcccgccaccacgcccggctaatttttgtatttttagtagagatggggtttcaccatgttggccaggccggtctcgaactcctgacctcaaatgatccgcccgcgtcggcctcccacagtgctgggattacgggtgtgagccaccacacccggccctactagtactttgtacaaagtaaaggtagatcatctgatgttaaatttaaaactcctctttgaccacccacagttagccttaaatccgtaggtgggtgtctgtggcctctcagtctggccctgaccctctcaatctcattttgtaaatctcttacgcacctgactcctggccacgtggaaagattgtggctgccctctttcatatctcagtacttagttcctgctgttccttctgcttggaagatcttgacactgctctgccaagcgaacttctctttgaagactgagcttaattgtccctctgaaaatcaatgtatccagcttcctatgccaagttagtcacttcttcctgtgtgtccctgaagttttttacccccctctattaccaggggcactgatacagctcaataaaagatcaataaaaggttactgagctcctaacatgtaccatgcactgtgcttagcgccaggcttacagagatgagtaggatggagagttcccgacccttaaggaactcaagtcctaaggaaaacacatgtaattgagtcttctgtggttacagtgaaagggtcatcaagaagtccttcctggcttccttcctcctctcactgcactcacaccatcttacatcctgatgcctccaaatctttagctccaaactcttctccctcatcttccagacttctctgtttcagttcaatttagtaaagcatttattgagcacttacattgtgctgcgtaatgatgattcctgatgtgaaagagtttacgttttcgtgcagttaacataggatagttagaatcacctgaggaacattgtcaaaacacttgcctaagccccatcgctggaaattctgatcctgtagcaaggctctgaaagttcaagggtgaataagaattcctatctctactaaaaaaaaaaaaaaaaaaaaaaaaaaacaaaaattagctgggtatggtggcattttcctgtaatcccagctacttgggaggctgaggcaggagaatcacttgaacccgggaggcggaggttgcagtgagccgagattgcaccattgcattccagcctgagtgacagagtgagactcgtctccaaaaaaaaaaaaaataaaaagaattcctgtcctcagggaatctaaggctaatggagggagatagactttgattttaactattatatacaacatgaattgtaagtaccatgttggaagtctgaatatggtacacagtagacattaaggaaaaggaggtcacttctgtatggagaagtcaggaggaagtcccttttgggcagtctttttttttttttttgagatggagttttgctcttattgtccaggctggagtgcagtggcgtggtctcccaggttcaagcgattctcctggctcagcctcccaagtagctggaattacaggcacccaccaccacacctggctaattttttttatttttagtagagacagggtttcaccatgttggccaggctggtcttgaagtcctgacctcaggcgatccatccgcctcagccacccaaagtgctgggattacaggcatgagccactgcgcctggcctgcacagagtcttcagagctaagctgatatttggatgggaggccattctagatagagtagtggcttgagagagaagcgtgagaggtaaacaggagagagattcatgaaagactttgtattgtaggcactggaggtcactgaaactttagttttgtatagtaatgcatgctaatagtaaagaattcaaatagtaccaaagggaaagacaaatatttctcctatcctagatcccctagttctcagagacgatcactatgaagtttcttatgtatccattgaagtgttctaagcaggattgttatatgcctaaatcaggtaaccatattgaggctagattgaacaagactggaggcagctgcattcatgcctgtaatcccagcactttgggagcccaggtgggtgggtcgcttgagcccaggagttaaagaccagcccgggcaacatgacaaaaccttgtctctagaaaaaatacaaaaattagcagggtgtggtgatgtaccctatagtcccagctatttgggaggctgaggtgggaaagtcacttgagcctgggaggttgaggctgccgggagctgtgattgcaccactgcactccagtctgggtgacaaagtgagaccctctttcaaaaaagaaaaaaagtctggaggcagagaaagaggataggaagaggttgagtaacctaagcaagagctactcaggaactgaactaaggcagtagcaattgggatagaaggatagacagcaactgatagaagaacttaaggaagttaagtgagatggagctaaggtgactcctaggtttcttttttttttttttgagacagagtttcgctcttgttgcccaggctggagtgcagtggtgcgatctcagctcactgcaacctccgcctcaagcgattctcctgcctcagcctcctgagtagctgggattacaggcatgcaccactacacccagctaattttgtatttttagtagagacagggtttctccatgttggtcaggctagtcttgaactcccgacctcaggtgatccacccgcctcggcctcccaaagtgctgggattacaggcatgagccaccacatccagcctcttttttttttttttttttttttttttttttttgacgtggagtttcgctcttgtttcccaggctggagtgcaatggtgcgatctcggctcaccgcaacctccacctcctgggttcaaacaattctgcctcagcctcccaagtagctgggattacaggcatgcaccaccacacccagctaattttgtatttttagtagagatggggtttctccatgttggtcaggctggtctcaaactcccaacctcaggtgatccacccacctcagcctcccaaagtgctgggattacaggcatgagccactgcgcctggccctaggtttcttttaataaggtgaaactcttagccttcttcactgaggagatagtgtcagtccttgagagagccaaagtggagacagacttgggaagatgagttcagctttagacctattgagtgtaaggtatctttgagacataaaggtagagaatgctattcagttagtcagtttaacatacgagattgtcaactcaatagctcagaggggccagaaatacagatttgctggcttctggcttgggtggtagttgaagtgcatgggagagggtgagtttgcccaatcaggccgcgtacagtgagaagggaagaaggctaaagatgcaggcctaaggaaaatcagcacttaagtaggaggaggaacagccaataagagatcaaaggggaaagttttattttatgttggatttttccccccttaagatgagctaggacaggtgtgggggcacatgcctgtaatcccagcactttgggaggctgcggtcggaggatagcttgagcctgggggcttgaggctgcagtgagccgagatcgcaccactgcacatcactacacttttgagatactgcctcaaaagaaaaaaacagatggaatagccttgagcaactcataatatatggggatggggctagtataaagggaaggttggaaataaggaataaccaactaagggacaggaagtgattaatgaggatcacagagtacttagattagaagcaaagaactaagggtgggtgtttgaaatatgtatgtttttaggcttgggtggagagagttgagagagttcatgtctgataacctcaattgttcctaacaggaaggaagcagataaaccaggtgggaggcaaggaagcagtagagtgaaggggcttgaggataatgatgaaagttaggaatagtggttctttgggaagagacaatgaaggggaccaagaatacagaaatgaggctgggcacggtggctcatgcctgtaatcccagcattttgggaggccgaggcaggtggatcacgaggtcaggtgttccagaccagcctggccaacatggtgaaaccatgtctctactaaaaatacaaaaattagccaagcgtggtggcgggcacctgtaatcccagctacttgggaagctgaggcaagataatcgcttgaacccaggaggcggagatgcagtgagccgaaatcacgccactgcactccagcctgtatgacagagcaagactctgtctcaaaaaaaaaaaaaaaaaagaataccgaaatgatttgctggaccaggctgaaggccctgctcaggttgcaggctatacatgttatcgggggaaccagcccccaatatttcaatgtaggttcttttctattttccctaagtgtcagctggtctcataaataaagagaaagactacaaagagaagaattttacagctgggcctctgtgggtgccatcacgtattggtaggaccatgatggcgacttgagccgcaaaaccagcaagtttttattagggattttagaaggggaggggggtacgaatagggagtggatcacagagatcacatgcttcaaagggcaataaaagatcacaaggcaaaagggcagagcaggatcacaaggcaagggcaaaattagaattactgatgagggtccatgtcccactgggcacacattgtcttgataaacatcttaacaggaaacagggtttgagagcagaaaaccagtctgactagaattcaccaggctggaatttcccaatcctagtaagcctgagggcactgcaggagaccagggcatatttcatcccttatctcaaccgcataagacagataatcccagagcagtcgtctataggcctacccctgggaatgcattccttccccagggttatcaattattaatattccttgctgggaaaagaattcagtgatatttctcctactcacatgtcgtttataggctccctgcaagaagaaaactatggctctattctgcctgaccccccaggcagtcagaccttatggtatctttccttgttccctgaaaatcgctgttgttctgttctttctcagggtgccctgatttcatattgttcaaacacacgttttacaaacaatttgtacagttaatgcagtgatcacagggtcctgagatgacatacattgtcagtttatgaagatgacgggattaagagattaaagacaggcataggaaattataagagtattgattggggaagtgataaatgtccatgaaatcttcataatttatgttcacagattgcagtaaagacaggcgtaataaattatgaaagtattaatttggggaactaataaatgtccatgaaatcttcacaatttatgttcttctgctgtggcttcagccggtctctccattcggggtccctgacttcccgcaacatcatctatcttatatcactatagagggtcgtttggttttctccagcacatctgggcctagatttgaattgaagtctaggaagcagatggttgcattgatctgaggttatgtatggtcttttgcagggtgagtgcactgaaaggaaaagagatagaggccacacgggaaaatggccaaactgatgtatatagtgatacagtagtaggatatgtgtgaccctggtttgatcattttgttttctagctcagaaatcttcagtggctccctggcttaggttctaaatctttgaactgatggacaaagatgaggtttttcccataaagctggttccagctgcttttccattgctttcctgttggactcatctattcataatggctccctctttggttttgcactggcagttctctgcttaaatgcccatcctattcccagctgccttaatcctatgcagctttcaaaggcccagttctaatcatgcttcctcagacaaaacctccttgaccactttaacctgaaaagagtactagttttttagtttttttcagtatcacgtatttagagcttgtactgccttatcttttacattgtttgttctatatttgtggattttatttctgcaactacatttctttttttttttttttttttgagacggagtctcactctgtcgcccaggctggagtgcagtggcacgatctcaactcactgtaacctccacctccctggttcaagtgattctcctgcctcagcctcccgaggagctgggattacaggcacccgccaccacacctgactaattttttgttagttttagtagagacggggtttcatcatgttggccagactagtcatgaactcctgactttgtgatccacccgccttggcttcccaaagtgctgggattacaggcgtgagccaccgcgcctggcctctgcatctacatttcttaaatttctttagcgctaccattgcacctgcacgctatcttttgccaggaaggttctccctaagcatttagtaactgactatagagtctgacagatggagaggaaattaatatttggggcgggggaggggttctgtttgttttgtttatttgtcttttgagacagggtctcactctgttacccaggctggagtgcagtggcacaatttcagctcgttgcaacttcaacctcctgggctcaagtgatcctcctgccttagcctcctgggtagctgggactaaaggtgtacatcagcatgcccggctgatttttgtgttttattttttgtggagactgggcttcgctatgttgcccaggctggtctcaaactcctggactcaagtgatcctcccacctcaacctcccaaagtattagtattacaggcgtgagccaccatgtccagccagggattcttactttgtgctcagcactgggtagagtgcttaatatcactgcttctcaaactgtcttggtaaaggaccaggtagatttttccctcaagctgttgcagatcagtagtgttctaaaagcacttctgtaaaataaaattactagaaaaataacatttaaaaagacatagagaatacaggctttttattattatcatcattagattcaacaaacattggctgggtgcagtggctcatgcccgtaatcccagcactttgggaggccgaggtgggtggatcacttgaggccaggagttcagcagcctaggcaacatggcgaaaccccatctcaactacaaaacacaaaaaaattagcctggcatggtggcacaggcctgtaatcccagctacttgggaggctgaggcacgataatagtttgaacccgggaggcagaggttacagtgagccaagatcacgccactgcattccagcctgggtgacagagggagaccctgtctcaaaacaaaactgtaaactgcctgtcaaattgccctaagatgttctaagtgctaatgctttctttctgtacttaccttgatgcagactgctaatagtttgtggattggcagtggtctgaagaccaaggtttgagtagcattgctttacatgatctcatttacacttccctaatatcttgtgagggtgggtattattattatttcctcagtatactgataaggaaagagatttagttaagccacctgctcaagttcaccagtttagtaccagacagaattggaattcaagtgctagatgccattttgttcatactactgggtctcaaagaggatccttggagcagagttggtttggggcaggtagagtgttttgtttcgtcttcaaaaagtaagtttatttggtcgggcgcagtggctcatgcctggtatcccagcactttgggaggcccaggtgggcagatcatgaggtcaggagtttgagaccagcctggccaatatggtgaaaccccatctctactaaaaatacaaaaattagctgggcatggtggcgcgtgcctgtagtcccagctacttgggaagctgaggcagaagagttgcttgaatccaggaggtggcggttgcagtgagctgagatcgtgccactgcactccagcctgggcgacagagcaagactctgtctcaaaaaaaaaaaaaaaaaaaaaaaggttaatttgaattgcaaatacatttaatattttatctgttgttttcttttggttcttgcattttaatgcctccaagtattgatttcagatgcatattgcttcatctgaactgcttgatacttagttgagtaggaaaagtaactaacatcccttttaaatgtccagttccattggctctgtggtgtttgacaaagttctcacctggtctatgatgaaatgtgaaaataaagtcaatgtaatgaattttttcatgaagtcatatttattaaatttgaaggacagtattttatcctgagatttttgtctgtagtttttttggtgttaaaatggtagaaacagaatgcgtatagtaattgtgtggagtgttgtttataacggctgtttgagatataattcatatactgtaaaattcacccttttaaagtgtacaattcaggctaggtgtggtggttcacacctgtaatctcagcactttgggaggccaaggcaggaggattgcttgaggccagtcaggagtttgagaccagtgtgggcaacatagggaggtaccagctctacacaaatttaaaaattagccagatgtggtattgaatgcctgtggtcccagctgcttgggaggctgaggtgggaggattgcttgggccaaggagttgaggctatagcgagtcatgattgatctgtactccaacctgggctggtcaacagagtgagaccctgtctcaaaagaaaaaaaaaaaaaaagaaaacccctgtacaattctgtgatttttagtatattcagagagttgtacaaccatttctgcccacctcagcctcctaaagtgctgggattacaggcgtgagccactgtgcccatatcagcctattgcatttgcctattctggacatttcatataaattccatcatacaatatatgaccttttgtgtttggcttctttttttttttttttttttttttttttttgagaaggagttttcactcttggtgcccaagctggagtgcagtggcacgatttgggctcactgctacctccacctccagggctcaagcgattctcctgcctcagcctcccgagtagctgggattacaggcgcccgccaccatgcccagctaatttttttgtatttttagtagagacagggtttcaccatgttggccaggctggtctcaactcctgacctcagggtgatctgcccaccttggcctccaaaagtgctgggattacaggtgtgagccactgcacccggctgtgtttggcttctttcactgaacatgttttcaagtttcatctacttcatggcatgtatcagtcagtattccattccttttttttttttttttttttttttttttgagacagagctttgctctgtcatctaggctggagtgcggtggcgcaatatcagcccattgcagcctccacctcccaggctcaagtaattctcccacctcagcttctctagtagctaggaccacaagcacacaccaccacactcggataatttcattttttaaattttttgtagagacgaggtctcactatattgcccaaactggtcttaaactcctgggctcaagtgatcctcccgccttggcctcccaaagtactgggatttcaggcgtgagccactgaacctggctgtgccctttttaaatatagactttcaaatttgagttagcataattaggaggcaggaggatcacttgaagtcaggagttccagagcagcctgggcaacatggtgaaaccctgtctctaccagaaataccaaaaaattagctgggcaagccaggcacggtggctcacgcctgtaatccctgcactttgtgaggccaagacgggcagatcaccagaggtcgggagtttgtgaccagcctgaccaacatggagaaacctcgtttctactaaaaatacaaaattagctgggtgttgtggtgcatgcctgtaatcccagctacttgggacgctgaggcaggagaatcgcttgaacccgggagggaggcagaggttgcagtgagccaagatcgtgccactgcaccccaggctgggtgacagagcgaaactccatctcagaaaaaaaaaaaaatgtttatcaagcccagtattaacactctcggagcgagagagcagactgacctctgcaaaatgagatcagcattagtttggtgtagtttgggtctttttatgtgtttttttggctgcctaatctctagtcagtgtctgcctttttgattgatgggtgtgttgcttagtgcttgcctgctgcctccatcccataattttaagtacatgcatgatatgcagtccatgtgcatgagcgttgatgagttgattatcatacggggtcatcataaggacactttttctctttgatgcatatgacttgccctgaagagctgccccttgctggtttggtcttgatcctgcgggccatggggtccttgcttgcttctcttagcttactttttgttttggcctgcttaacttctgccttttatcttgcttcttgctcacctaccccttcaccttgcttctgctctcatgttcttactcattctgccctttatccaactttaaattccctttactattatcctgcctcattttctgtattctgcttcctcagttacagtgagccgtgattgtaccactgcactcctgggtgccagcctgggtgcctgagtgagaccctgtctcaaaaaaaaaaaagctataaaatcattttgcaaacttgagtgtactaggaaaaggtattactatttttggttttgtacaaatgatttcctttcttttatgaattattttcttcagttatattttctgaaatcagtttactgtttcaaagggtatgacccaggataatctgttgattcaaaattcggcaaatatttattgcatgcttggctgggcgcagtggctcaagcatgtaatcccagcactttgggaggccgaggtgtgtggatcacctgaggtcaggagttcaagacacatctggccaatatggtaaaaccccgtctctactaaaaatacaaagttagcctggtatggtggcgtgcgcctgtaattcaagctacttgggaggctgaggcaaagaatcacttaaacctgggaggcacaggttgcagtgagccgagatcacgccactacactccagcctgggcaacagagcgtgagactctgtctcaaaaaaaaaaaaaaaattgcatgctcgctatatgccaagctctattctaggcactggagaatgcagcaatgagcaaaacaaaatgaagccctacagcatggagctttccttttgttggactggtttatgatttttactatataaatcaatgatttctaaatgctagaagaacactaatatatgatgacatttccatccgtctgaagtgaaatgagaaaaataaggataatgtattcttactgaattctgaccactgttcggtgttctaaattcctttctgaggagcctggagagagccatgtctgcagcccatccatcttgctaaacaggtcacttggacccagtatgttatggcttgctctcataacttgactctggcatagcatcaatcacacgatggttagcagacttccttaactaacttacgctaatattaaacattcctttctactgactccaactttttatttttatttatttctatttattttttgagatggagtcttgctctgtggcccaggctggagtgtggtggcgtgatctcggcctactgcaacctctgcctcccgggttaaagcgattctcctgcctcagcctcccaagtagctgggactacaggtacacaccaccacacccagctaatttttgtatttttagtagagacagtgtttcaccatgttggtcaggctggtcttgaactcctgacctaaggtgatccacacacctcggcctcccaaagtgctgagataacaggcatgagttactacgcccagccaagacttcttaaattagtgttttcttggactgcagttactcattggctaagaataagtctctttaaatatttgtcagagtttggtttttccatagacagtatggagtttttcatagtgattatggattttaaaggacatagctgagattatatcatatactgtatactttttcggagtgttaaacaagctgtttcttttttttttttttttttaagacggagtctcgctctgtcgcccaggctggagtgcagtggtacaatctctgctcactgcaagctccacctctcgggttcactccattctcctgcctcagcctcctgagtagctgggattacaggcgcccgccatcgcgcctggctaattttttgtatttttggtagagagggggtttcaccgtgttagccaggatggtgtcaatctcctgacctcatgatccgcccgcctcagcctcccaaagtgctgggattacaggcatgagccaccgtgcccggccaacgcccagctaatgtttgtatttttagtagaagatggggtttcaccatgttggcaaagttggtctcgaactcctgaccttaggtgatctgcctgccttggccttccaaagtgctgggatgccaccgcacctggcctacaaaaattttttaaaaggccaggcatgatggcacatgcccagagtcatagctactcaggaggctgaggcaggaggactgcttgagcccaggaatttgaggttacaatgagctgtgatcatgccactgtactccagcctgggcaacagagtgaaaccctgtttctcttttttttttttttttaaaagaagatgattctttgggagatagtgatagggaatgtaccagtttctattcactccatttcctcacctgttctgttagatgctgatttctactgaaattaccaaggtttaagagtaactttggagaggagagtgaaggacctttctctacacattcgcagtgtctcagaagcctcagggctcctgagatgtattagatccttggtggaatcactgtatggccagagctcggtttttttaattcctgtggtacatcagagctgtgtctgcctggaagagccacagaaagtggagggtgacagggttgagcaatttattttttccagagactctgtagaccaggctggagtgtagtggtgcaatcacagctcactgcaacctcaaacacctaggcgcaagtagtcctctcatctcagccggcctcccgagtaggtaggagtgcaggtgtgtgccacaacggttggctttttgtacagatggggtctcacaatgttgcccaggctaatcttgaacactggggcaaatgatcatcatgtcttggcctcctaaaatgctgagattataggcatgagccactgtgcccagccagggtctaacaattttatttatttatttattttgagacagagtctcgctctgttgcccaggccagagtgtggcggcatgatcttggctcaccacaacctctgcctcctgggttcaagccactctcctgcctcagccttccgagtagctgggattataggcatgcgccaccacgcccggctaattttgtatttttagtagggacagggtttctccatgttggtcaggctggtctcgaactcccaacctcaggtgatctgcctgccttggcctcccaaagtgctgggattacagacgtgagccaccgcgcctggccagggtaggtgcttaattcataggctggagcctctttggttttgatcaggtagaagccattatttaaaactttctctggggctgagagcagaacttttggttgtgacaaaagtcaaacatttgaggatcttgttcagaatattctgagcattagggcctcgtcctgttcctatcttcttttcatggagaggaacttacattttttatctttctctatttctccaggcctcatcatttctgtctcctgtttctccacttccttctctgttggttggtccactgatgtatggacttgcacatgatgaactgtgaacttctagccacatgtagtgcccttgggtacttggagggagacacttaccataaggaaccagattgcttaggtgagtacctttttgatgaaacaggaaaaaaattggcttgaattaaggaggtctgttgaattcctcaaaccatgggtgtgaaaagatgtgggtctggatggagcttcttccaaggttccacatgcatgttttgttctgtctctgaagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcaggttgcctccctagcttttaaacttttgccacctgccaggctttggtgtttgagctgataggtttggcgtttgagctggtaaagaaacttaacaacttctccctccttcattgtctcccagactgatggtgaacttgacacaaccagccttgctctgttttggcaatctgcctaaggagcccagctttcggcaccattttttgcaggtgctaacttatttgcaggcctacaaagaggtgaggatttcctttggagtccctggggtggaatatggggcagtggtgaagaagtggatgactgctacttaagatcaggttccctatttcacaggcctttgccagtgagaaggcttttggagtcctcagtgaaaccttgtatgagctgctgcagctggtgagtgagtcttcaccttacaggataccatgggacagcattttgcaccttctccgggcagaggaggagatgctgagatatggtcccagtccttggggatgtggtagtccgatccatagtctctggctgcctcagtactgtttgaactctttctttttaatcctgcttctcttctatgcctgggtcttccagccagagtacatactgcctgccttccacagggagtctcttcctcttactctcttctggttagggctgggaggaacggcaggaggaagacaacttgctgattgaacggatcctactgctggtcagaaatattctccatgtcccagctgaccttgatcaggagaaggtgagggtcttgggtgttctgtgttcttgtgcatggttaggttgagctgcctttttttttttttttttttttgagacggagtctctctctgtcgccaggctggagtgcagtggtgcgatctcagctcactgcaagctctgtctcctgggttcacgccattctcctgcctcagcctctgcctcctgagtagctgggactacaggtgcccgccaccatgcctggctaatttttttttttgtatttttagtagagacagggtttcaccatgttagctaagatggcctcgatctcctgaccttgtgatccacccactttggcctcccaaagtgctgggattacaggcgtgagccaccgcgcccggccaagctgccctttttgggctattctgtcctctgacaagtctgggagaggaggcttggtcaaagaatgagttggagagcttcaaggcagggcagtgggattgaatgagcttcctttctaccctcaccactcactgctcagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccaggtgagaccctggcctattgcccgagtcccctccgcccatgtacttttctgctgtacagccagaattgctcttgtgataatggctgcattatctggggaaggcaggcgacagcaggagtagccatgtcttgagttcagtagtacccccttattcatggttttctttccttgatttcagttactcacagtcaaccatggtctgaaaatattaagtggaaaatttcagaaataaacattttagaagttttaaacttgtacattgttctgagtagtgtgatgaaatcttttgtccctgtttgtcctaaacaagatgtgaatcatccctctgcccagcatatccacagtgtatacccgcctgttagtcatgtactagccatcttagttatcaaattgaaaaaacataatagaatatgtgtatgtgcgtatatatatatgtatacatgttctgttttctgataactatatatatagcacatatatacattctataaaacatagaacgtacatgttctatgtatatgtgtatacacatacaaatatatatatgtatatatgaatatatacatatatatatttcagtactgtctgcagtttcaggcatccagtgggtgtcttagaacatttccccctcagataagggagaacgacagcacaatgccccattaatggggttctattttgttcactctttgcatccccagtaggcgtgaactcaggataaggaatgactgtcctcctgattcttccctctttgttccaatctagaaccccgagcagctggcgggagtagggcagggacgcttagctcaggagcggagtgcagattttgcagaactggaggtgttgcgccagcgagagatggcagaaaagaagactcgagccctccagcgaggcaacaggtgagtgacagagaggcaggttctttttcctacatcatggaatgctgagggcatagaaggcaaattctaaggtggggtgattgaacaacattttagtgttttttttttttttttttgagacagaattttgctcttgtcgcccaggctggagtgcactggcacgatctctgctcactgcaacctctgtctcctgggttcaagcgattctcctgcctcagcctccccagtagctgggactacaggcgcatgccaccatgccaggctaatttttgtatttttagtagagacagggtttcaccatgttggccaggctggtctcaaactcccgacctcaggtgatccgcctgcctcagcctcccaaagtgctgggattataggcgtgagccaccgtgcccgaccaacattttgtagttttaacttgctccaatgtgccgatgatagagaatggagataaagtttccagagaactgaaaaatcaccttggacctttttgtttctgcaggcattctcgatttgggggctcctatattgtccaggggttgaaatccattggggagagggacctcatctttcacaaaggccttcacaacgtgagtattcttacatctggagtgggaacatagtggagttgcatagcttaagcagggtaatcatcttaagagttcttggctgtgcctggtggctcacacttgtggtcccagcactttgggaggctgaggcaggaggattgcttgagcccagaagttcaagatcagactgggcaacatggcaagaccctgtctctaaaaaaaaaattaaattaaaggttgggtacaatggctcatgcctgtaatcttaacactttgagaagctaaggaaggagaattgcttgagcccaggagttcgagaccagcctgggcaacatggcaaaaccctgtccctacaacaagtgaaaaatactaactgagcatggtggcacccgcctgtggtcctgactactcgggaggctgaggtgggaggattccttgagcccaggagttcaaggctccagtgtgctatgattgcatcattacactccagcctgggtgacagagcaagttcttgtctcaaaagaaaaacaaaaattagtttcttctgagaaaattgacgagagctgcaaggggaaagtggtatttaggagtaattctaatcccccaaccgacacacccagctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggtgagaacctgtgaaggatatggagataatcaggaatggaatagacaggtgatgatgcagctgttggtgggtaagaagtggggaggagctcggggaggctgcccctggaatgtggactcgtaggtgggaaggatatacagttaggatgtccctgagagatagtgaaaatgccaggaacgagtgggctcctggcatgacaaaagaggctctggaaaaattgcctcagagggagaggaaagggagaacaggagagagttggaaattgtggatcctagagtattatagcggtgtcccggcgtggtggctcacacctgtaatcccagcgctttgagaggctgaggcagtggatcacttgaggtcaggagttcaagaccaacctggccaatatggtgaaaccgtatctctactaaaaaaaaaaatacaaaaaaaaaaaaaaattagccggcatggtggtgtgcatttgtagtcccagttactcaggagcctgaggcaggataatcacttgaacctgggaggcagaggttgcagtgagccgagatcagaccagtgcactccagcctcatcatgacagtgcaagactgtcaaaaaaaaaaaaaaaaaaaaaaaagaccaggcgcagtggctcacgcctgtaataccagcactttgggagtccaaggcaggtggatcacctgaggtcaggagtttgagaccagcctgcaacatggtgaaaccccatctctactgaaaatacaaaaaattaactgggcgtggtggcgggcacctataatcccagctacccaggaggctgaggcaggagaatcgcttgaacccaggaggtggaagttgcggtgagccgagatcatgccattgcactccagcctgggcaatagagtgagactccgcctcaaaaaaaaaaaaattatgacggtgtccagcatccattccatcatcataggacaggaaggaagaagttggaagccctggagtcatggtgatctttttttttcttttttaaatgtcaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggtgagtgggatggttactggagatacagtgagctagggatctgaatgcttgaattctggctggtgcttttttcctgattcagggttcaggtgatcagtctggggagcaaggactggctgggaaatttagtttgggtggcacatttttttttttcgctgtgggaagttgctgtttccatgggccattgccctaagctgtcctccatttcaccgtttcccgtcaactctcaggatgcacttggctctgaaggcctatcaggagctgctggcaacagtgaatgagatggacatatctccagatgaggctgtgagggagagcagccgcatcatcaagagtgaggccctggcctggtccccgatcccagcctgtcccatctcgtgatgagaatctcattcttcccagtcccagcttcatccatctctccttttcaagctttccagaatagcccttccatccctttctcttccccattcctagacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcaggtactgggcagccccacaatgtagaaagagctgtaagggagagtcaaggaaggggggctctttcttctcacagtttgtacagcttaagttcatctgttaaacgtgctctgaactacgacagcaagaggtttgtgggtgttggccagtgtgagtctactacagtttccttctcccattagaataatctctgatctgccataaatattttagttcagtcaggaaacatttattgaacacctaccacatgccaagtacaaaaaccctggggattcataattttagagtctaataattatgctatagcattttctggttataccttgaaagcattgtggtgaggtggaaagagccttaaattgcggccaggcatggtggcgcacacctgtaatccccgcgcttgaggaggccaaggtgggcagattacttgaggtcaggggttcaagaccagcctggccaacatggtgaaaccccgtctctactaaaaatacaaaaattagccaggcgtgttgatgcacacctgtaatcccagctactcagaaggctgagacagaatcgcttgaatccaggaggtggagattgcagtgagccaagatcatgtcactgcactccagactgggtgacacagtgagactctgtctcaacagcaacacaaagagagccttaaattgaactttagaaagtctggaatctagtcctgtattggttattattggaataagctcaagctggtcgtgtcggtctccagatccataaagttgggattgtgacagttgtccatgaacccaaagtggaatcagtgaaaagcctaggacaggctgggcacagtggctcatgcctgtaatcccagcactttgggaggccacagtgggtggatcatttgaggccaggagtttgagaccagcctgggcaacatgacaaaactccttctctactaaaaatacaaaaattagctgggtgtgatggcacgcacctgtagtcccagctatttgggaagctgaggcacgagaattgcttgaacccatgaggcagaggttgcagtaggccaagatcatgccactgcactccagtctgggccacagagcaagactctgtctcaacaaaaaacaaaaacaattcaccagcatggtggcacatacctgtagtcccagctgctcaggaggctgaagcacgaggatcactggaacttaggagtttgaggatgcagtgagctgtgattgagacattgcactccagtctgggtgagaccaagaccctatctctgaaaaataaaattattggttcacattaaaataaaaaaaaccctgggacaaaatgcaaactccaaggaatttgtatcctggaaacacagagactttgctttgtataaacagattttgggccaggcgcggtggctcatgcctgtaatcccagcactttgggaggctgaggcgggcagatcacttgaggtcaggagttcacgaccagcctggccaacatggtgaaaccctgtctctactaaaaatacaaaaattagccaggcatggtcatgcgcacctgtaatcccagcttcttgggaggctgaagtgggagaatcacttgaacccgggaggcggaggttgcagtgagccaagatcatgccattgcactccagcctgggcaacagagcaagactccgtctcaaaaaacaaacaaacaaacaaaaattagcctggcgtggtggcacacacctgtaatcccaggtacttgggaggctgaggcaggagaatcgcttgaacccaggtggcagaggttgcagtgagccgagatcacgccattgcactccagcctgggcaacaagagtgaaattctgtcttaaaaaaaaaaaaaaaaaagattttgtaccagaaccttcctataactctagttgctacagcttaaaattctgtcataactggacttgaaagatgcagtagtaccaacgagactttgctaaagggtatttttgcactcagagctctgtggtattatctgtaatactaggtactatcatttattgagcatttactgtgtgtcagacactgtgctgacgttttcatgtaatcctcacagtagcgcatgtgcccaaagtggttaagcaacttgtccaaagtcttgttagtaatactaattcaatactcaaatccagatctgctggactccatgctcctaagttttggtgtgtttgattgtaagttctttaatggagcatgaccttcaggggcctctcagttcatcctgtttgacttttcagtacccacaccaaagactggttcacagccctgacttgggagaagcaggatttgggtattgactcactctcctgcttttcttttttttaattatttatttatttatttatttttttaagcagggtctcgctctgttacctaagctggagtgcagtggctgaatctcagctcactgcaacctctccttcccgtgcccaagcgattcttctgcctcggcctcccaagtagctgggactacaggtacacaccaccatgcctggctaatttttgtattttttgtagacacagggtctcgctgtgttgcccaggctggtcttgaactcctgacctcaagcgatccacctgcctaggcttcccaaagtgttgggactacaggtgtgagccactgcgcctggctgtcctacttttcaggagaaaaaattagaggctttatttacatagtgctttgcattttatgaagcttttccatgtgtcttatttgatcctcatagcatctgcttattctgtagacctcttgagatagcactgcttttggcaaacctctgaactcaggaaatgggtcaggagttttgccatgacatcttatgctcactcacattatagcttttatccacactctagtgtaattacctttctacttcctgtctccaccactagagtaaaagctcctcaaagggaaggaaatatgctgttcactattgctttctattaccgatggatagcagataatgggcactctgtgaatgtccagttaattagttttgtaatagaaaagacactgatggggaaagccctctttagctctcttgacatcctaatacaattctttccccacagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccaggtaggtggttacagaaaccctgtcttttttgagaatagtgctcagggtatacaatctgggttttccactccctccgctcccatagctttatccatctctagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcggtaagaaccctgcctgctcatcctcttgggctttgggggaaggaggaggccatcactgcggtacagtgttctcagtcttcaaaagagagttgtctcatcaaggctctgggactgtataccaactgactcctggggcgttttgattggtttgttgggtttttttgtttctgaaaaacattaaaaaagcatagttaattgagaaaaaaataaagaaagcaaatcctcacttgacatcatcaataagtccttggtaattgcagctttgagtaaaatgacctacggcatgtttcttataacgttaagagaaaaaaaactggttttgttatacattgtttcacttaaagtggcagtatccaagaacctattgaagacattaagggcggacttaactttaattctagtagccaaagatatgcatcattaacattttgatgagtaaccatccagaggtttttttgctccgttacatgtaaaaatatcgtatataccttgttttacaaaaatgaaatactgtacatgctgatttatagtaatttttcacttctcagtatattatgagcatgatttctcatcagatatatttctgtaattgttaatggctttaaaacaccattgtgtgaatatgtacatttgttcaaccaggtgtcaaacatttagattgtttgcattttgttcttagctggtttttattgaattgtggcttatgaggaaaattttccctggagtctttgtttcatttgaggtaacagtttgcattctgtttctggccaacaaaagaaataagtctaaattccttcttctacttcgaattataaatttaaagccagatttcccctgggtaaagccttttttctatctgtgctccagggaggtgtggcctgaaggagatgtgtttggctctcaagacatttctccagaggaagagatccagttgctgaaacaaatcctctctgctccacttccccgtgagtctccacccttcacatctgtctccttccagctcttttctagcaccaacataacagagactcagtaatcctccctctgtctatagggcagcagggcccagaggaacgtggggcagaggaagaagaagaggaggaggaggaggaagaggaggagttgcaagtggtccaggtgtcggagaaagaatttaattttctggactacctgaaacggtgcgggctgagaggcctgagttggtcctagagtggcgattgtgcggctgtgaggatgagctatgtcttccttatgctgacatcctctccctccttgttttggtgcagctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagtgaggggataacaaggaatggggttctggaagggtatgggaaccctcaggtaaataaataatcttcaggagatagaaggtgctgagaggtgtcaagggctgggagatgggaaaacaatgagaaagtagacaggcaggttgagggagctgcatggagaaggacagaagagagtgagtgaggagggggcagctgggaacagctatagagaaaatacctagagggccaggttcgggtctgcattggaccagagaggcctcatagtaacctccttctcctacaggagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtgagcttgaagttggcaaagggtgggtgggggtaggggaagtttgatgcagagtcacagaatgtcaaagctgttaagagcttgcatgtcatttagcccactgtttctttccctattatgggtgagagaacaggctcaggaggtgaaatgctttacctaaagttatccaagagaggagcagggactggagcctaagtctagtgtgtatctagtttccttctccatcaccagcctccatagaggtagtcactgttgggagctgggtggttgcccagagggagtctgtgtgcgacctctcccaaaatgtgctgggaaaccatgaggatttgtagaaatgtttgtcctctttcccttagtatctcagcccctctcctttcacacttagtctctttttcccataatattctcagtccctagagtcagaatggtcagggttccattggcccaacctggaaaatctcttagtttgacttttaggttcttacgtggaaggaaagtgaggggaaggaggcacactgtaggcctctgctggctggcctctttcagttacctgccttgtccttcctgttcttttcagaactgatcagagaaggcctttggtctcctctttttgggccaagaacctatatgctccctttctcctttcaccattcaggtcttccagtcgcagagcacctacatggagccccgaagaagaggctcatcttcgggagctgtacctcgccaataaggacgtggaaggtgagaggccttgggatctggagagtttatgaggagggcagcttgagctgtgggaccttctttactgccttagtccttccccacgccagggcaggatgtggtggaagccatcttggcccacctgaatactgttcctcgaacacgcaagcagatcatccaccatctggtacagatgggactggctgacagtgtcaaggacttccaaaggtagagaggcacatgctctggaggctattgggatggggactcgtgatcacttcctgggcttcctcttccactgacaccttcctaatcaggaaaggaacccatattgtactgtggacgggggatcaggagttggagctgcagcggctttttgaggaattccgggactcagatggtgagtaagctggaaactcaggggacctttgagatgaaagccaagctatccatttattttggggctgccttttattcccaaggaaagattctcccatcccttctgttcacttactatatttgtaagtgtcatttttggatgaattgaggtaccctctttccagagacctctgatttattttactcatctctttccctgttacccttgggtattcacatgcttgctttttatagatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttggtaacaatctgaccctagctctgctggcatgggctcacttcccttgaagtggtccttaggagcagtccacctggattcttcctgcctgaggctgttctgaccaggtccttccgagagagcaggcgcgggggggtgcggtggtcaggaacgaggagactccactaagttccttgtgttgccttcattttcattcccccaacccccaatgaattttagccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggtgaggactttggctgggagagatgtctcaggtggagggcttgggagtagggtcaaatgtaagtttccctcatttccttaggcttttctatcccgctcctatggctccagaactgcctgatccgagcagctgatgatcgggaagaggatggtgagtggacaggtgacacttttaggagaagagccctggaggctattggagacctacctggtcatgggatggagaaccagttcttcccttatatcttcaccatatgactattgaccctgtcttaggctgctcccaggccgttccattggtgccactcacagaggaaaatgaggaagccatggaaaacgaacagtttcagcagctgttgcgcaagctaggggttcggccccctgcctctgggcaggtaaatatgtcagttacagtgtcaaccaaggcgtgttagtcctatttccaaatacatctcctcctcctcctcactgtcatggtggtcctccttatccttatcgtcatcttggtccttctcattgtcttgtcatctctgaccaagattcctgcagcagccattctgctagtcttcttttcctctctctaatctccccttcccctagatccatcttccagactgcctccagatttatctttttaaaatatagtcttgattacagttgtcccttagtgtctgagaggggattggttccaggacccccctgcccacagataccaaaatctatagatgctgaagtccctttttgtagtatttgtaaataacctaggtacaacctgtatacttcgtcatttctagattacatataatacctatacaatgtaaatgttaggtaaataattgttatactgtattgtaaatatatatatatacattttatttatatatatatatatacacacacacacacacacacacatatatatatatatatatattttttttttttttttttttttttgagacagagtctcactccatcacccaggctggagtgcagtggctcagtctcagctcactgtcgcctcaacctcccagactcaggtgatcctcccacctcagcctcctgagtagctgggactacaggcctatattaccactcccagctaattttttgtattttttgtagagatggggttatgccatgttgcccaggctgtgtattattgtttaatgttgtattgttatttttttttaatattgtcgatctacagtggtttgaatccacagactcagaacttgtggatatggagggtcaagtcctctgtccagagccattgatggttccttactgcttgcaggacagaatccacaaactccaaatggcatccccatccttggccaacctttgcagcctcacagccacaccactcacacaccgactttacatcatagtcaccctggtaggctttttcatgcctccaaatggttaatcatgccagtccctctattggaaggctgcaaccgtgcacacagggtgacacacacacacacacacacacacacactccatctgtcttactgatggacctctacccagtcttcaagagtctgctcaattgtcaccttgtcagagaagcagtccttgtcattctttcaacccctgaagtaaaaataatcacttttgcagctgtgatttgttcatgcccctgatgcagccttaatcctgtggaatctgctgggtatggtggctcacgcctgtaaccccagcactttgggaggctgaggcaggcggatcacctgaggtcaggagttcaagaccagcctggccaacatggcaaaaccctgtctctactaaaaatacaaaaattagcccggtgtggtggtaggcacctgtagtcccacctacttgggaggctgaggcaggagaattgcttgaacccaggagggtgagcctttattgctttgccacggcactctagcctgggcaacagagtgagactctgcctcaaaaagaaaaaaaaaaaaatcctgtgatactacagtacatttgttctttttcccattggattgtgagttatttgatagcaaggatcatacctgattcacctttacatccccaggatttatttatttatttatttattcaattgacaactatagccaggtgtagtggctcatgcctgtaatcccagcactttgggaggctgaggtgggaggatcgtttgagactggcctgggcaacacagcaagaccctgtctctacaaaaaattttaagtagttgggcatcatggtggcatgcacccctgtggtcctggctacttgagaggctgaggcaggaggatagcttgatcccaagagatcgagactacagtggaccatgattgtgccactgcacttcagcctgagtgacagaggcagaccccttctcatttaaaaaaaaaaaaaaaaaaagaacaaccaaaaaaacctataactgggaacctcctaatgtagcaggcactgtgctaggcactgggtatatattagatagtaagtattataataaatagagttcacaacccttgtggatcttcaccaatattgggtcatatatattcaatgaatatcatactctgggaaacaaaaagctggtcctttcccttttcaactttttggcccctgtaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagagggtaatagtgcgacagccatcttctgagtattaacgtgtcagccatgttggtctagagggcaggaaaggtgttctgagaatatgaggaccgagttcctaattttgtgtcatttatggtcattgcagaggaagacgctgttggtaaagagccgctgaaggcagcacccaagaaacgacaattgctggacagcgacgaggaacaggaagaagatgagggcaggaacagaggtagggaatttgatgggaccttctttttcttctctaatcctgaagacaaactctaccacgtccttaccccttaacatatttagatattctctctctctctcacccccatcgttcccacagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctc

SEQ ID NO: 466 - DNA, 40467 bp, Homo sapiens
ccggaattgggggtgaagcgatagcgttttgcccgcattcggggcgcgcggagctggggggtccctgtggggctcccggagttaagatggcgtcctcagcggagggggacgaggggactgtggtggcgctggcgggggttctgcagtcgggtttccaggagctgagccttaacaagttggcgacgtccctgggcgcgtcagaacaggcgctgcggctgatcatctccatcttcctgggtaaggaccctcctgcctccctccgcccctcgcggagtccccggggagtaggggaggaatggggacaggacctccctctcttcccggagccacccgggagggctgtgccgggtgcgggtgtgaatcctgaagcacaccaacagctactgagggaagacagaagtcctgtctcgagtctggggcgctgtgccctctgaacctcttcatctttctcttcaacccctgccatgccctctggcctctcagtcgggcccccgccctcttgtgccaggctctacccttgctcccacgacctgtctttatttgtcgctctgttgagttccactgtctggccatgtgtcctgctctgtcattaataaccaccccgcacacgcgcgcatctcatcggtaggcatagggcccctaactttagccctttcggccttttcagccccatattccatatttcatattctgagcgcctgttttgcttattgccagcttatattatactttcgtctcttttctgtcccagtcctactattttctttttataccatgttgctttttttattttccaagccacctacctgtcatttaccctggaatatcattttaatgctggacttgggaaacaggactaacaacctccttaaaatcgatccatactattccaagcgtttattacacgtgtggttcaaaggatgtggtgtatctgaatttatgccacaacaagctgtattacaactggtttataggcttttttaccgcatcctcactccatggtttaatacatggaggtagcatagtacaatggaaaaaagtatgggttttgaaggcaaacaaatcagatccagccttgttgctgctcacaaactgaaggaccctacgcaggccgcaaaaccctctgggcctaatttccttatctatgaaatgaggacaacagtgcctaccacataggattgccataaagtcctgtagaagggccaagattgggaagtacctgtacatatatatacataaaatttaagcagttggaacgttttatgaaggttatagaactttaggagcgggtgagtgggaaggattaagcaaaagctgtaagtggtgataaggaaacaggactggggctagagcagagggttagaggtctgaaccatgagaagtttgagataaagttgggcaggtgtggaaagccttaaatgccagagagaagtttggcgtttatccagtattcagtagaaacactgatatataatatcaccagagggtgttaacccaatctagataatgggataggcattaattcatatttaaacaaccttgcctaatagcattgttactttcctattacatatcaaaccaagatcttcctttcttccaaataaagatcacctttttcttcctctgtggaatcgtaagattttaaagatggaatggaactggggttgtgcagtttgctcagtgtcacccagacatcatccaaatttatcagcaccctagtctaggcttatttgcactacaccagctttgaacttcctactctttcatccttgtttctgacccagttatttttgacattgtaattagcaattagtgtttacatttgacaggacgcagcggcttatgcttataatcgtaacactttgggaggccaaggtgggaggaacgcttgaggccagcctgggcaacattttatttgtctctacaaaaaattaggccaggcgcaggggcacatgcctgtaatcctggcattttgggaggccaaggtgggcagatcgcttgaggtcaggagtttgagaccagcctggccaacatggtgaaaccccatctctcctaaaagtataaaaattagctgggcatggtggtgggcacctgtaatcccagctacttgggaggctgaggcaggagaatcacttgaaccctggaggtgaaggttgtagtgagccaagttagctctactgcactccagcctgggtgacagagcaagactctgtctccaaaaaaaaaaaaaaaattaataaaaaaatgagctgggcgtggtggctcatgccatgcctgtggtcccagctactcccgagattgaggtgggaggatcacttgggcctggaagtttgaggctacagtgagccgtggcaccactgcactccagcctgaaggatagagcaagaccctgtctcaaaaaaaaaaaaaaattgtattacattcattagttaggaaactgttggtttctcaacaataaattcagaatgtaacacaagtagcaaccagttataaggggcaatctgttaaatggagttagggctggaattaggacttggaattcaacttttgtttgttgacataaagaattcaacttttgtttgttgacataatcacatattgcctgtgcactcctgctgggctattgctgtgtactgtcacggggcatacagatgactaggaaattgttttctccatatcccactcctcttctctcatcttctctcattaccaccaatcatcaaagtaataaacacttggtgtaatgcatctaccacactcccgagcccccttgctcattctaccatttcccacaccctgccttcctatctcacataccctgttgccttcagtaattcatagtatttctcatttttagatcaacttggggcttcaacttgcctcctatcaggtatagctcatcatgtggacgggtaggattgtattcctagtaggcacagtttaaatacatacatataaatataaattgattaagcttgatgtgtgcgtggtaggagtgcattttggttgtaaatatgtttcccttacaaaggttattaccatttctgtgtattgtaacctagaaaccagtagcctttcagcagtggagttcctggttcttgaacccagctctctcagggaactgggatactggaggaaatccttgctggaggtaccaagaaagcctgtagtccaaaatgatttctggttcactttccactgattagattaattcaggttaaaaacacctccctaaatgcaaataccccaagggaagagttaggtatatcattcacattttcaagtgtacgttttaatcagatagtctaattactattttcttaacatcttactttttttacttcagttctgtgtgctgatcttggggtggaatgcagagcattaaagcactggcttttaaacctttttgactaagatccatcgtaagaaatatgttttacattgtgacccagaacacacagacttgtatgtgtatacacgtatttgaaacaagtttcaggaaagaatacttgcccttaataataactcactaagttgatttcatgacttgttaatgagttacaacagtttgaaaaatcttgagttagaggctgcaattttttttttttttttttttttgagacggagtctcgctctgtcacccacactggagtgcagtggctcgatgtcggctcattgcaacctccgcctcccaggttcaagcagttctcctcctcagcctcctgagtagctaggactatggtgcacgccatcatacccggctaatttttgtgtttttagtagagacggggtttcaccatgttggctaggatggtctcaatctactgacgtcgtgatccacctgcctcggcctcccaaagtgctggaattacaggcgtgaaattacaggcatgagccaccgcgcccagccgaggctgcaatttttaatattcaatacttcaaagaaaaagtaagcttatgtggactgctgcactggagtattttgagcagtcagaagactgtaaaaggagtgtgtttatgtttgtgtggtgtatgcttgcaaggagtttgatggaaggatgctgaagaggaattttgccatgagccctggtgctggcaaatactaccagaaaacatctccccttcaacagcttggatctcatcactccttaatgtaactaataccatgaattgctcatataaattcagtaacatgcacctactacaggtaaagcagtattcttaaccctgcaagggcaggagcagtgggtgtagtatgagtcaggagccctgcactcaaaggtattatggtctgttagggtataggaaatgggcctgagataagtatactaataaccccaataaattttaagcaccataagagaggtacagagctttgtgagatttaaagatgggacatttcatttaaagatgagtaaggtttcagcatgctgagatggtaagacttaaggaatagcatgagcagaggcactgaggtgtgaatgtggcaacacagccaaggaacagtcagtagtctagtgtgactaaaacaggactttaaagaagtgatggaaaatcaggctggaactgtaggttaaagagcctttaaagccaaggtaaagagttagtactcacgtaggtgatagggaacattggagatttttgagtggggaataatatggctggagctgtatttaaaaagataatacagcctggggtgatttgaagtcagcatagacaagtagtagggaaactaaggagaaagaagtgatctagagaggaagttataatgacttggaggcagggtggctgtgctgagaggagaaagtgggcatctcctgtgagatggtctaggaataccggaaccttttgaaaggtagattctgtagacacagtcatctacacagctgctcatgcctgaaacccaagaatcagctttgttgcctttcttcactcactccccacatcccagtcacccaatcctatcaatacaacctctggattgtgtctcagatccatctactattctccatcaccacagccactaaccatctgtcaccagcaccacccaagtagcctcctgactagtctctaattctgttcttgccccctcagtccactctccaaaagcagccagagtgatccgatcctgtgcctctcctgctcagaacccttcaggggcttccatacctggctggtaagcccctgcctgctgccccagcctcgtcccaagcaagctgacaaccttttagccacatggcctttgttcagttcctcaggaaaggcatgaaggcttccctacctcagagcctttgcacacgcttacctgctgcctggagtgcccttcagtcacctgacaaactccttttcatcttcctctgagttctttcctgactctcatgttcaattatgtcccctgttacactttctcatactgaccggaatttccttccaagtatatattacactttgtaattatatatttgtagatgaggacagaaaccatggaagttttgtttaccacagtgtacccagagtttaacacattacttggcttgtagaaaaggctcgataaatacttgaataggtgaatgtatgaatgaatgacttggcaacttattagctggaggataaagtcgtaattttaaaaagactccatcctcctgcctgagtagctggaaagataagggtatctttgaccaatgccagagatcaagtggaggatcagatactcttaagtgccaggaaatgatctggtttggggttcactttaggttccaagggcacttccaggtatcttgggagttgtgaagcctggtcttgagctcaggaaagaagctgggctaaagacagagttttaggagacagtattggtatcataactgactcagggagggaatgaaatgccatggaaaaggttatacagagaagaggatcttattcacgttgattgggtatgttaatgttgctaccccttgataatagtaatagctggcatttattaaggattttctgtgtaccagacattgtcctaaatggtcaacaggcagttccccacctaaacctgccagttacccgtgaggtaattatagtgctgttaagatctcctggtacagataggaaagtcagccctacaaagattgagtaagtcacactgagttctgcctgactccagagttcctgctctttaccgctgagattgggaggagcatgtggggctggaaaagataaatgcccttggtgtccttttctcttttcactctcagtggttaaaccaagatgcaatcagtatatgagccacctctcagtgtccaaagctagagctggccaaatggagcagatggccaccctgcttactgtgagtgttccctagtcttggccatgatggtggcttggctgttagactgatcaaaaattgcagctgggggtaacaattcatccctcagaggttcagaattagcatcactaaagttagcgacctttaaaatcaaaggaggtcctgcagtttagttccctttggaccaaagtcaggtctggcccttcagaaaaaaatccattattcagtgcagaaagctttcttcaggtagcactggaatcacaatataaagagaccaaaggtaagctagatgaaaattaagcagcattaatgaaacaaagagacttctgaccataatacaaagcagggtccaaaaattctactgctataaaatagggagactgtcctaaatgactttcaaggacccttccaattttaaaagtctaggtatattacttctacatgtttagactttattctagttcatagccacaaatttcatcataatctaaaccttcccgtttgggaatttctttttctttctttctttttttttttttttttttttgagacatggtgttactctgtcattcaggctggagtgcagtggtgcaatctcagctcactgcaacgtctgcttcccagatcaagcaattctctagcctcagcctcctgagtagctggaactacaggcgtgagccaccatgcctggctaattttttctgtattttttgtagaaacagggttttaccgtgttgcccagggtggtctcaaactcctgagctcaagcaatccaccagcctcagcctcccaaagtgctgagattacaggcataagccattgcccctggccaagaatttcttttaaatacaattttccaggtcaggcacggtgcttacgcctgtaaccccagcactttgggaggccaaagcaagaggatcacttgagtccgggagttcaagaccagcctgggcaacatagtgatacctcatctctacaaaaagtgaacaaaattaactgggctgggtggcatatgtctgtagtccctgctgcttgggaggctgaggtggaaggatcactggagcccggggtcctccgctcaactcaggacgttgaggctgcattgagccaagatcatacctctacactccagcatgggcaaaagagcaagattctgtctcaaaaataaataaataaattttgtttttaattagccaggcatgatggcatgcacctgtagtcccagctattcaggagaccaaggtgggaggatcatttgagcccaggaatttgagactgcagtgaactatgatgatgccactgcattccaacctagatgacagaaggagacctcatctctaaaaataaatatatatattttttccaaccactttttatctataccccaatgtcttacattccataaaacatcatgttttgaattccagtataactttatcgttaaacatgtttctttgcagaagcatgtataagttagggtccacaagattatttgcataagctaatttacaaaaaaaattatataatcactgacatgaaagcatgtctgggcagccatgggagctcatatgaggcgtccagttcagtcgccttttaaaaatgatatttgcattagctgggcatggtagcatgtgtctgtagtcccagctactcaggggactgaagtgagaggatgcaccagagccccagaagtcaaggctgcagtgagccatgatcacatcactgcaccagcctgggcaacaggagtgaggccttgtctcagtcagtcaatcaatcaatcaataatggtatttggtcttctgaaagaaagtgacattttagctgggccttaaaggggatggtaagattctagtaaagtagagatgaaagcggaggagctttccagctacaaagagtaatctggagatcaggaagagtaagaccctgtctgtccctgaatctaaggaaaaagaaaaaaaaattttgagaaaaatctgaggaacagcaagtagtcctctttaaccagaacaatagaagatcgtaaaagagcagtagagaaaaacatgataggccttttatgtaggtggaggtcaatgacagagtaaggtagtaacatgtgcattgtctttagagatcttctggcctaggttcaaatgctggatcaaataaatatgtactagctgtttcaccataagctcattaccagagttcaaccacccatttctttatattcccacaggccaattttactaaagaattgcaatgaagagttaagcaatttatctgataaatatttttagatttatatttcattcataactagcagcagtattttgaaacagaatacaaaatttatatgaatttttaaagtaatacagtcatcaaagaaattttctatttctagaagactgcttaggcatactcttttgtgatgtgttcattctcctttggcctggaaaagtttgagaactgttgctcattgggatgttgtaaggactaaataagataaactatgtaaacacttaaccatgcttgacccaagatcatcttaaataattgttcttcccttccctgtcaataaatatttattttctccctttccaaggagacacaaagtatggtcttgtgaccaacagcatctgtatcttatgggagcctgttagaaatgcagattctttggtctactccaaaactactgattgagaaactctgaggatagtgcccagtaatctgttctagcaagccaggttatacttattactctagagtttgaggattactaatttagcatatttcttccggtgcctattttgtagtacttgatgtcctgatagtacctttttggaatgtcattggccaggcgcggtggctcacgcctgtaatcccagcactttgggaggccgaggcaggcagatcacctgaggtcaggagttggagactagcctggccaacatggtgaaacccatttctattaaaaagataaaaattagctgggcatggtggcacatgcctgtagtcccagctacttgggaagctgagacaggataatcgctggaacccaggaggcagaggttgtagtgagccgagattgcaccatggcactccagcctgggtgacagaaaaaaaaagaaaggtcattgtatcctgtactctttggaataaacaaaactcttagattccttatggtttagtttttcccatttgtaggcctgacagataggaaagttgggcctacaaaaattgagtaacttgcttaaagtcacattcagttctgcctgactccagagttcctgctctggatgttatctgaggaataaagagatgttgttgttattatgttcacattgttattatgttcacattgttattatgttcattatcatgatcatcacatacaccatctgtttcacacttttgataagaaggttagatacagaggagttgtgttttttgttttttttttgagatggagtctcactttgttgcccaggctggagtgcagaggtacaatctcagctcactgcaacctccacctccgaggttccagcaattctcctgcctcagcctccggagtagctgggattacaggcgtgagccaccacacccagaggaggaatttttttaataaggttattggactaatggctccatcttttttgtgttgcatcaaccaccttaagcaatatagcattctcctgattgatctccttacgtttcttaatataagtaataaattgtgacttgtagctttaacaaaaattaggttccctagttgcagctgccagggaaagctagtctaatatcaaagcaaaccatccttcttctcaagcacagagtttttaagataggagtgtgtgtgtattgacattttcctagcagtggctgaagtcaaggaccaggagatttagggcccacttggagttcttatggtgaaacagtagtagcttcctagagacctttaaagcttatctgtaatttgtatagttcagaagatactgtatacatcattatttctccctgctttcaaaacaggaagggggtgtggagagtaacacactaaaaaaaggataagtaattaatttctgggtaagaatttccttttggcttaaaatggactgatggtgtaagttcctccctttgcaagcagaagctttgaagatagtgagctagatgaagctctggacatcttgaatgaagtattctgtataagaaccaagtgtataataactgttagtaatagaggctgctcatagaaatgtcattgcattataattgtagggacagtttgtcagagagtaggtagaagattatcagacccaggttttgttcttggctcacatgaagtcatcaagtaggctatttaaatgcttcactttaaccataggctaagattaaattaaaaataaaaagcttttgtcatggccgggcacagtggctcatgcctgtaatcccagcactttgggaggctgaggtgggtggatcacctgaggtcaggaatttgagactggtctgaccaacatggtgaaaccctgtctctactaaaaatacaaaaattagccgggcacggtggtgcacgcctgtaatcccagctactcgggaggctgaggcaggagaatcgcttgaacctgggagggggaggttgcagtgagccgagatcgtaccattgcactccagcctgggggacagagtgagactccgtctcaaaaaaaaaaaaaaaaaaagcttttgtcaattaaagatgcttgtcagtactgagtattcatgttgctatggcacttttataagaaaactgtacacggtcatatctgcttccgaaaataatacatagtgagatagtaattttacaggcaattaagaatttgctggccaggcgcggtggcttacacctgtaatcccagcactttggaaagccaaggtgggtggatcacctgaggtcaggagtttgagaccagcctggccaacatggcgaaaccctgtctctactaaaaaaaaaaatccaaaaaattagccgggcatggtggcaggcgcttgtaatcccagcaacttgggaggctgaggcaggagaatcacttgaacccgggaggcagaggttgcagtgagccgagatcgcgccattgcactccacctgggcaacaagagcaaaaactccgtctcaaaaaaaaaagaatttgctataatagaagatccatgtgtacattctgtatgcaaatcttaggaagatattagatcccagaaggttaaagttccgatctctatatatttgtatatgctttaaggagaagtggcatccatgtagatgtggtaaatggcttataactctcgaggtttccaatttctgctgtggtagcaattctaaactcagatggacttggacactactctggattactgtccctaaatatcaactactgtttataagccagcagaggccaactgaaatagtacacataaagttcctacagcatatccctcagtcagaagtggaaaagattgattaaagttggagtataaacatatggggccctgaccaaaaatattgaaccgtactactagaaatccccattctttagctaaaggataatctgacttcacttttaattcttcattgactattggtgctctgaaagaataggaaataatagcaaaacatgggaactcctagatagcatacatttatttttaaaatgtataccatcggccaggcaccatggctcacgcctgtaatcccagcactttgggaggccaaggtgggcggatcatttgaggtcaggagttggagaccaccctgggcaacatggtgaaaccccatctctactaaaaatacaaaaactaactgggtgtggtagcacacacctgtaatcccagctactcaggaggctgaggcagtagaactgcttgaacctggaagacagaggttgcagggagccaagatcacgccactgtactatagcctgggagaaaacaaacaaaaaacatatggtcaacttcccaagtaaactgaccaatgtcagtttaggttcagtcttactgtaggagtgcctgccgtaggccagcgcctctcaacctttccactaagtacattaagatcctaacagtaatcattgggaccccaggtcatcgtctcaacagaagctccagatttcttcaagtcttggccctcttgttttatatcaaaattttatgtatattatttttatattttcaaaaattctccccagatcatcaagtaatattgagatgctgacatagaaaaaagtagatttccagctggtatgatcagtgataaattggacttcatcaaaattaaaagcttttgtgcaccaaaggatactatcaagaaagtaaaaagctatcccacagaataggagaaaatatttgtaaatcataagtctagtattcagatgtctaaagaactcttagaattcaacaataaaaagataacccagtttacaaaatggatatgaatagacagttctctaaaagagacatatacatggccaataagctcgtgaaaagctgtttaatatctttagtcattagggaaatgcaaatcaaaaccacaatgatatatcatttcacacctactaggatggcaataatcaaaaacacacaaacagatgttggtgaagatacggagaaattggaaccctcaagcattgctggtgggaatgtaaaatggtgcagccacttgtggaaaatagtttgtcagttcctcaaaaagttcacagttaccatatgacccagcaattccattcctagggttacacccaagggaactgaaagcatagattcacacaaaaacttgtacacaaatgttcatagctttattataatagccaaaagtggaaacaacccagttgtccaccaattgggacaaattgaatgaatacacaaaatgttatatccacacaatggaatgttattcagccataagaaaacaatgaaatcctgatcacatgctgcgacacagatgaaccttgaaaaattgtgacatgaaacaagccagacacaaatggccacatattgtatgattccatttatatgaaatacccagaataagctaattcgtaaagacagaaaatagattggtggttgctaggggataagaggaagggtgaattgggaatggccactatgcggtacagggtttctaatgttctggcattagatagcagagatgaaaatgttctggcattagatagtggagatggttgcataacactgaatatactaaaatccactgaattgtacacttaaaaaaatgaagaaagaaggactatgcatgatcaaagaaaaaaatgctttgtgctcaagtagggatagaataaacagtaagactggaaagactgtgaagggccttgaatggcaagctaaggaagttagctttcatcttatagatcgtaggaagccaccagagtattttgagcaggggtggcatgtttaaggtagtgttataggaagtttaatttgtgaaatgagaaagagatactatcagccaggagaggtagaaggttctataaagtcaaattgaacacccgaagtttcagatttcatgaatgaccctgggtatgtgtgtatacacatatgtatgggatttgtagtcatctggggaaggctgaggtgctaatatgaatactgaaaactagagagggtaatatagcagagtagttaaaaatgaaaacactctgaacccacatgctgtctgggttcaaattccagctgggctaccttccagcactgtgaccttaggtaagtcactaaccctgtctgtgcttcagcttcctcttccgtaagataaggatacctactcatcaaggttgttttgaggattaagtgggttaatacatacaaagtgtttacaatgtcaagcttaaagaaaggtccccaaaaatgtcagctgctagtctgaaactccagagcaggtttgagagtaacccgctgttgttctctgccccggataaactatgaagtaacagtcctaaagtgttaaaagacaaaacaaatttttctttgtgaaaaatgaccctttaaaaaaactccatctactaataatgaagcttagtagtagtaaaatgatgatttttagccataaaacgggttttctatatcttcacaaatatagtgtagagtttcacaatattctttgatatgaaccagtctctcatactttctgtatagcactgattcgctaagtaagatgccaaggcatgacctcccttcaggaattgggaatctgcatttttaataagcatcctaggtaattcttttttttttttttttttttttgagacggagtctcgctctgtcgcccaggccggactgcggactgcagtggtgcaatctcggctcactgcaagctccgcttcccgggttcacgccattctcctgcctcagcctcccaagtagctgggactacaggcgcccgccaccgcgcccggctaattttttgtatttttaatagagacggggtttcaccttgttagccaggatggtctcgatctcctgacctcatgatccacccgcctcggcctcccaaagtgctgggattacaggcgtgagccaccgcgcccggccgcatcctaggtaattcttatgcatgatacaggttgagaccagtgccatgtacagaagtgggaaaaatggcttatgaaactcagttgtatttagcacactgtgttagacataaaatttgaaaacccaacctggacaacacagtgagacccagtctctactaaaataaaataaataagtgaacattgaaaaccaatggatagtagaatgtattcagttcagtgagacatgaaacaatatttttgcttaattgaatcaaacatatgttaaaaaaaaaaaaaaaactcaccctactcccaaagcactcaataaattcttcagagaaaaggaagagctttttgtactacattgcctctaaaatcttctgtaggataagacattttaagatcacttaaaatcttgttttaagtttttaagtctcattttaataaccaaataaaatggtttttatttgagccagtttcaagttcttaaagtgacacataggacttaacaaaatccattagttgtcatttgtgctttgcccatttttactgatttcttcatactctgaaggaaaaaaaatgctacaaatgtatgttggtatataagagagtgcattccataaatattagaaattttttttttctttttttgagatggagtttcactctttcgcccaggctggagtgcagtggtgccatctcagctcactgcaacctctgccttccagtttcaagtgattctcctgcctcagcctcctgagcagctgggattacaggcgcccgccaccacgcccagctaacttttgtatttttagtagagatggggtttcaccatgttggccaggctggtcttgaactcctgaccttgtgatccacccacctcagcctcccaaagtgctgggattacaggcgttagccactgcgcccggccagaaaaatattttatagaattcaaacttgtattttcttttgaagggatataaaaagggtgagagaacccaacaaccacacttattcaaatttataaggataattaggagtattctcatggttatctttagaatcttagcagggtaaaaaagagtttattgtttcatttgctgaaactcctgagaagaagtctcaccacatttgtatttacagagattagatttggcaactctaaagacaagagaaattactcatgataagtgtttggaggggttggagagaaaacagctaattaggcacttggcagtgtggcagggcaacctttgggcaacccagtccagattaggttagaagaggagcacggaccttttgtccactgcaaaccagtgccacaaatgaagtgggaagagacaggttaccacatactggttggacttgagagagaaccagaaagtgtacaatcccataagcataaaaaatggggataaaacttcaagtgtatataagggtaagaacaggaggaagcagtaacagagagggcaggagagaaagatcagaaggaatcggacgcctgagaagaggaactgggggctgagtcctgtcctggcctggccgctccccattcctccctctgcctctgagggcttcagttttcccaagtgagaaacagctgtgctagattgcttctacagtcctttccactcctggaccgaaacagttgcccctgcatctaaaatacgtagctctagcatataaaatgcaggttacctcaactcccccccgactcccacatctcactcccttcctttccctgcctgccctaattctggctgcgttctgttcttgcctcatatggactctttttctcctccccttcttttccaatgtcatgcagtctcttaacactgggtttcaaccactatacagaaaaatgttagtgaaaaaggaagaggggttccatgctgcttgattctccctaaccaggcacactaaactaggggtgacagtgtatcacaaagtccagactcacagtcttgctgccccttctcctcttcaaagtttgtttccgaagtaccaccccttgcacctcacatcccagccaactctgcctacctgtcagccccagccctcctcaggcctgcctcagcctcacagccaggatcctaccaacaccaacaccgcgccaaataacccctcccaaaagcctcaccggaactaatctggggactctgcctattattaggaacaccttggatgaagcccctacccgcagaattctggcagtagcagcagaattttcaggcatgtgcctaattttgttggggtggtggttgattattttttttaaatctaggatttctgggatctgaagcttatacaatcttggatatcttctttaagaaaaagaatacaaaaatatcttctataagttttacaaaaatatatgaccatgtgagcacgttgctagctcccgcccccaccccaccccccagagccttggaaggggagtgaaactgaagcttttttagcttcatggcaaatatgcttcttcctgagagtactgggtacattcacagacctttattttttactttctatagatttaatttagttaagtcagttcgaagcgggcaaaggccaaaatttctcacccctaggtggctcaaatttctgagcctgagattttatatcttaaaatccattaaaagaatactcaattttcggccgggcgcagtggctcacacctataatcccagcactttgggaggctgaggcgggcagatcacgaggtcaggagatcgagactatcctggctaacacggtgaaaccccgtctccactaaaaatacaaaaaaattagccaggcgtggtggcgggcacctgtagtcccagctacccaggaggctgaggcaggagaattgcttgaacctgagaggcagaggtttcagtgagccaagactgcactactgcactccagcctgaggaacagagcgagactctgtctcaaaaaaaaaaaaaaaaaaaaagaatgtaagtaatttgcccaagctgcagagctaaattttaaactagataattctgattccaaagcccagataatctggctagaagttgcaccaggggattcactgatttacaaagaattagaatgtgataaaattccctgagtacaggcaagtgtgatttttatctttgctagtaaagccatttagatgtcttaaagtgcctcaatctgttgcacctgttctactaaaacaaagaaatgagtcaacggcctcttttagctttaacattctctctgtctatacatttttatagaataatttttagttattgcagcaggtttcaccagtcagccaacgggtgtgtataacattaatcactagcactacacctcagaagtcttgcttattaagagcactcagcttaagtgaagaaattaaagaattttggtaggcctttgggacagttcaagtttaggttgtttggctgggttgagagagtaaaaaactaacatttcttaacctaaccctttttctttctttctcacaggtaacaactatccaatagcttacctttaaaatgtcccctctattgttcctccctcagacatttttgatcacttgtcccagtttccatgagtcctgtatcacagctgtcacaatgcttgagctatttaggtggaggtaactttcagaaatgaactgctgaagggtgcagagtgctcaagaattagattaacaaagaaagtacacctaaatttagcattaaaatgaacttttaaaatatttttcaataggaggataagcaaacataaaaatgggtgtgcttatgtctataaacaggtgctggagcatagattgttatctggacatcaaagaataatagagctgtagctttaaaagagcacacagctggttattagtgattcactcccaggtcactgccaagtgccaaggcatgtggcaagaatagtagaatggaaatcaggtgatgtggattctaatttgagctctgctctgttaaccttgggcatgccagttatcccctttggaccttagtctcttatctacctaatgaagggtttggagcaggtaattcttcagttctaagtaagaatctgtattcatgaataactgttcagcatatgactcagcccaaggtgtacaggattgctggagtgtggaaggtatgttggctcctgcctgtactagcaacaaggcttaatctagtgaacagaaaggatcaaaggtggctatatccccacctaaatgtccatgatctacaagtgctcttctagctggcagagtgggtcagtaatgagattttgtatctcattatatgaagttctaagcactgaacctaatcagttacccatcacttaagtagacagtgtcaggcagagcttaactctccttcctattttcctttgtcttccttttctctgtaagttctctaacataaggaacttccattttggtgaaagaatagaaaagttgagggacaggccaggtgtgttgtaagtaagactgatccagctgattggtttgccatttagattgcatggcagacatctgccataagcacttaaaacacaccttcaataggcattagaaagcacacacacggccaaacatagtagctcacacctgtaatgccaatactttgtgaggctgaggcaggaggattgcttgagcccagcagttcaagaccagcctgggcaatatagcaagatgccatctctacaaaaaattttaaaattatctgaatgtggtagtacattcctgtggtctcagctactcaggggtctgaggtcggaagatcacttgagcccaggagatcaaggctgcagtgagccatgactgtgccattgcactccagcctttgcgacagagcaagaccctgcctcaaaacacacacactgactagggatggtggcttatgcccagcactttaggaggctgaggcaggcagatcacttgaggtcaggagtttaagaccagcctggccaacatggtgaaaccctactctactaaaaatacaaaaatcagccatgcggccaggtgcagtggctctcgcctgtaatcccagcactttgggaagctaaggcaggaggatcacctgaggtcaggagttcgagaccagcctgaccaacatggtgaaatcctgtctctactaaaaatacaaaattagccccgtgtggtggcgcctgcctgtaatcccagctacttgggaggctgaggcaggagaatcacttgaacccaggaggcagaggttacggtgagccgagatcacgccattgcactccagcctgggcaacaagagcgaaactccatctcaaaaaaaaaaaaagaaaagaaaatcagccatgcatggtgacacacagttgtaatcccatctacctgggaggctgaggcaggagaatcgcttgaacctgggaggcagaggttgcagtaagccaagattgcaccactgcactccagcctgggcaacagagtgagactgtgtcttgaaacacacacacacacacacacacacacacacacacacacacacacacacataatttgctgttgttttgggggcatggcggcacatacctatagtcctagctacttgggaggctcaggcaggaggatcacttgaacccaggaagttgaaactgcagtgagctgtgattgtgccgctgcactccagcctgggcaacagagtgaagtactgtctcaagaaaataaaaaaataaagaaataaaaacataaggtttagatggcaactttaaaatgtgaaaggaggatatacagtttttcaaaattcttctaggagctatgccagcaaaaaggtttgaagacctgaagaccattatatcagtggcataaacatctttaatttgtccttttccttctcctacacctagtcaattgattttttttttcccatttatcaatttcagactctgcctggtttttcactttcccatccattttgttacaatatttttcctcccttgaaattagcccagtctcttggagtgaatgccccatgctccttcctaccgctgtgtctttactacattatcctcccttggaatgccgtcatctcttctctgttcaagaactacttctcccgaccactgtggtcgagattgatttctctttaacctctacaacattggctattccatacagttagcccttagcatagaacatcattgtttgattttgctccttaagaatagaaagcacctcttaaaattctaccatattcccccaatgcctaatgcaatgctaaccacatagtgagtgcttaataaatattgtattgactgcctagagtacagagcacttgttcactcattgttcggccattcagctaatactttttgagaaattttgtgtaccaggaactgtactatgcactggggtacggtagggactaaagtagatgataatccctgctttgaaagactgaaaagtaagatatatggtatgtcaaaaggtaataagtactgagaagaaaaatagaaaaagcaggaaagaagaacaagaagtgtgtgatgggggagggttacagggtggggaggggtagtgttgtatacacttctagataagatagggaagtcctcactgatacttatggtgacattttacaaaggacctgaggtgtaggaaggatttgagcttatctgtgcaaagagccttccaggcaaggaacttaccatgtgaaggcaccaaggctggacctgcttaacattccaggaagggaaagctttggggctggagcagaagggtagaggccagattgagagatgagtcagaggacagtggggcccgggcagagggacagaacctgcgggtgctggcaatcagccttttgatctgagtgagaatagaggccttgagagggctttgagcagaggagtgacctgctgacttaagttgaatagaaccctctagatgcttcattaaggctagactgaagggaggcaaaggcagggtgagatcagtcaggaggcaagtatataatgataatacattgaatataataatgatatattaataataataatccagagatagtggcaactcagaccaggggaagcagtagaggcggagagaagtggtcagattttggatttattttgaaggtagaacagacaggattgctgactctgttgagtagtcagctgggagctattgatggtttctgagcaggagctgaaggaagattaccccggtataggactgctgggaagacgtggtgcaggcagagatcaggtaggaggccattgcaaggatttaagggtgagatccataagggttttaactgcaaatcagcagaggaaaaagggagtggtgatggtcatggtgacagtgatggtgagagagactggaaaggaggaatcaacaggatttcatgactagataacagagaaccaatatgaagaaggaaaacactttttttttttttttgaaacggattctggctctgttgcccaggctggagtacagtgagacgatctcagctcactgcaacctccgcctcctgggttcaagcgattctcctgcctcagcctcctgagtagctgggattacaggcatgcaccaccacgcccggctaatttttgtatttttagtagagatggggtttcaccatgttggtcaggctggtcttgaactcttgacctggtgatccgcctgccttggcctcccaaagtgctgggattacagacgtggagccaccatgccctggcaggaaaacacacttttgaatgttgtgtgacctggagaatggtaacactgttaatttaaaaaaaaaaaaaaagcccagagaaggctgatttagggagaaatttatgccttagttatacagagtttgagatggtaatgaaatatcaaattaaaactgtccagcaaggaagtaggaaatgtggaactgaaaaagaagttagaactaaagatgtggatctgtctttggcataaagattatattaagttacttgagagtagatgagtttccaaagaagcagtgtagcaagaatagtggagggccaagactggatcctgggggtcagcaacatctaggagccagaaaaaatgccttcggtgaaagaaacggaaagatgggtctattcaaattgtagtcagccaacccatgccagaagtaagcacagaaagtaagagtgaacattggccaagcacagtggctgatgcctgtaatcccaacactttgggaggccaaggcgggcagattgcttgagctcaggagttcgagaccagcctgagcaacatggtgaaactccaactctacaagaaattagccggtcctgtgcacacctgtagtcccagctgctagggaggctcaggtgggaggatcacttgaacctagaaagttgaggctgcagtgagctgtgagcatgccactgcactccagcgtgggcaacagcccggtggctcacgcctgtaatcccagcactttgggacgccaaggcaggtcgatcacttgaggtcaggagttcgagactagcctggccaacatggagaaaccccatctctactgaaaatacaaaaattagctgggcatggtggtgcacacctgtaatcccagctactcgggaggctgagacaggagaatcacttgaacctgggaagcggaggttgccgtgagccaagatcatgccactgcacttcagcctggacaacacagagagactctgtcccaaagggaaaaaaaagaaaaagatccaggagatccattcctaggtatatacccaagagaattgaaaacataaaaacatatgttcacacaaaaacttgtacatgggctcatacctgtaattgcagcactctgggaggccaaagcaggaggatcatttgaggccaggagttcaagaccggcctaggcaacatagtgagaccctgtctctacaaaatgcatgaatgtttgtagcagcattcttcataatgttcctaaagtggaaacaacccagttgtttgtcagctgatgaatgggtagattatatgcagagtatccaggctgggcgtagtggctcatgcctgcaatcctagcactttgggaagctgaggtggacagatcatttgagctcaggaattcaagaccagcctgagcaacatagtgagaccttgtctataaaaaatttttaaatgttaaaaaaaagaatgcagagtatccatacaacgggatattattcagccataaacaggaatgaagtactgatacatgctacaacatggatgaaccttgaaaacatgctaagtgaaataagccagacacaaaggtctacacattgcctgacgccatttatatgaaacacctagaataggccaatctatagagacataaagtagatgaatggttgccaggctctgggagttaagagagaatgggaaatgactgccaacatgtatggggtttctacttgaggtgatgaagatattctgaaattagatagatagtggggatggctgcacaaccttttttttttttctttttgagatggagtctcgctctgttgccaggctggagtgcagtggcgcaatctcagctcactgcaatctctgcctcctgggttcaagcaattctcctccctcagcctcctgagtagctgggactacaggcaggcaccaccacgcccagctaattttttgttagtagagacagggtttcaccatgttggccaggatggtcttgatctcctgacctcgtgatctgccctcctccggctcccaaagtgctgggattacaggcataagccaccatgcccggcgacaaccttttgaatatactaaaaaacattacattttacactttgaagggtgaattttatggtaaattatatctcagtagaaaaaaatccaggaaactgtgtatagtcagccctccatatttgtgggttccacattcatggattctaagctaaataataatacaataataaaaatataaataaaaaacaatatgctatatagcagctatttgcattgcatttacattatattaggtattatgagtaatccagagatgatttaaagtgtatgtgaagatgtgcataggttacatgcaatactacaccatattatataagggacttgagcatctgtggtgtctgctgcgagtactagaaccaatccttcatggacaccaagagataactgtattcaaaaccaatgaaaccagtgaaagagaagtttcaaaaagattgaaaacacagcagggcagtcaaggaaaccagggagaaaggaaagactagtggatttgggtattagaagatgaaagattaaaacaaatcattccatatcagcatgcagtccatagactactcctaaaagttcctgagacttctttaaggaatctctttggggtaaaaattattttcatgatactactaagatgtatttgtcttttccctatgttgacacttgcactgatgttgcaaaatggtggtaaaactgctggcgccttagcacaaatcaggacggtgacaccaaactgtaccagtggtcactgcattctttactgccatgcactcacaatcaaaacagagccagtttcacttaagaatcgttgatgaagtggtaaattttttttgttttttttttttgaggcagggtcttacccaggctagagtgcggtgggggcatcacagctcactgccgcctcaacttcctgggctcaggtgatgctacctcagcctcctgagtagctgaggctacaggtgtgcaccaccacacctggctaatttttgtttttgttttgttttgttttgtttttagagatggggtttcactctgtcgcccaggctaaatattgttaattgtatcaaatgtcagtccttgaataaatcttttttttttaactggtatgcaccaccacacccagctaatttttgtatttttagtagagacggggtttcgccatgttggccaggctggtctggaactcctgacctaaagtgatctacccgtcttggcctcccagagtgctgggaggtgtgggccaccatgcctgatcctgagtacatctttttaaacttgtttgaagaaatgggaaatatgcataaaccgcctctgctgcacactggtagagtacggtggttgtcacaaggaaaagcatttgggcgattattcaagttgcatattgatttagcagcttcttttttcaccgaccaccatttttacttgaaagaatgatagacaaactatggttttagacttaggcatctggcagacagtctcttgaaactgtatgaagtgagcctgtcacttcaaggtaaacaaatgacaatatttgtagccagtgataaaatttacactttcaagtaaaaattagaattttggaaaacttgtatccactcccatgagcttgaccacttttcaatatatacagacttttctgctgaaatcaatggtgaaatttaaggaatatgattttttgatatgtattctaatgaaatatgtcagtatttagaagatctgcctaacaacagggaaccagtattttgcagtgatctatgtgtgatgttacaaagtcatgcatggtaaaatatccattcaaagtgcaagagaagccaatgggttttattataacaaaagttcctaactgttaagaaactactacttgtcaagttttgatgtagcgctaaagaatatccaaaattatctgaaaatgcagatactttctctgtctgtgtaaagccagattttctttgtatattttaaccaaactaacatattacaacagattaaatgcagaagcagatttgagaatccagtcatcttctattaagtcagacagaggccataaatttatgaaaatgtaaaacagtggcattcttctcattagatggctttatttctttgattgttttgggaaatatagtggtttacatttaaagtatgttatttatattaatataatgtgtagtagttttactgttaatatttttactgaattaatcatatcttttactttttttttagttttattttcttccttttttttttttttttgatttggagtctcgctctgttgcctagtctggagcacagtggcgtgatctcagctcactacaacccccacctcctgggttcaagcgattctcctgcctcagcctcccaagtagctgggatcacaggcgcctgccaccatgtctggctggtttttgtatttttagtagggtttcaccatgttggccaggatggtctcaaactcctgacctcaagtgatccacccacctcggcctcccaaagcattgggattacaggagtgagccaccacacccagtttttagtcttattttctaacacagtagacattgatatatagttcccacattaacaaaagttgtttggggtgctcaatttatttatttatttatttatttatttatttatttattttattttaattttctttttgaggcggagtctcactgtgtcgcccaggctggagtgcagtggcacaatctcggctcactgcaagctctgcctcccaggttcacaccattctcctgcctcagcctcccgagtagctggggctacaggtgcccgccaccacacccggctaattttttgtatttttagtagagacagggtttcaccatgttaaccaggatggtctcgatctcctgacctcgtgatccgcccgcctcagcctcccgaagtgctgggattacaggcatgagccaccgtgccccgcttatattttttttatttttatttatttatttatttatttttgagacagggtctcaaaaaaaacaactttgttgcccaggctggagtgcagtggcatcatcgtagctcattgtagcttctgtctccccagactcaggtgatcctcctgcctcagcctctcaagtagctgggactacaggcacgcaccacccaccccacccaactattttttttattttttgtagagacagagtcttgctatgttgcccaggctggtctcaaactcctgggttccagtgattctcccgtctcagcctcccaaagcactgggattacaggtgtgagccaccactcccagccaaatttaccagacttaatggaaacagtccatttctgtttcttcagatgaaacctcacaactttaggattaataagtaatctcacaactattgtacaggaaataagaaaacgttcccgctaacaatgcacgttgtgatagatctggtccctgacacaaacagcacttggaactgagtgaagtccagagactgaataatacagttctatccactccctgtgcttgactacaacccctgaagagggcttgtacaaattaaatgtatcccagcagctgcttgaaagaccacagcattggccgggcacggtgactcacgcttgtaatcccagcactttgggaggccgaggcgggcggatcacgaggtcaggagatcgagaccacggtgaaaccctgtctctactaaaaatacaaaaaattagctgggcgtgatggcgggcgcctgtagtcccagctactcggagaggctgaggcaggagaatggcgtgaacccgggaggcggagcttgcagtgagccgagattgcaccactgcactccagcctgggcgacagagactctgtctcaaaaaaaaaaaaaaaaaacacgcattttgaatgtccctagcattagggattataaaggtcccattctagtagaagatcctcaggtttggagtgtactaaaggtcatcatccttcgcctgctaataaatttctgaagtccctgctttaaacaaacaatcaaaaagaaggaacagttacagtgctgccaaacaagttctttttttttttttgagatggagtttcgctcttgttgccaggctggagtgcaatggcgtgatctcggctcaccacaacctccacctcccaggttcaagcaattctgcctcagcctcccgagtagctgggattacaggcatgcactaccacgcccagctaattttgtattttttttagtagagacagggtttctccatgttgaggctagtctcaaactcctgacctcaggtgatccgcctgcctcggcctcccaaagtgctgggattacaggcgtgagccacggcgcccggccaacaagttcttacaaacctctgggttgttacaaacccatctggtgctaataaaggtaaggcatcaaccccaatctccaagctgagaattttatcctcaggactgagcactgcggcctgcattcggatgttagtggggctgtcagaaccgtgtctcatgctgttaaaagtggaagtccttcccactcagacccacggaagccaactctgatgagtgggagggtgagcagaaggggcttcggtcattttttatagattcttcaggtaactctagccaccatattaagcattggctcccacaaaaaagcattaaggctcagaaacatcttgtagggtcacaccctccctaaaaacagcacatccctgaagtggtggctgggcagccaggctccaaagcccgctgagctgagcggcagccaagaacaaggtttggtgtttacatactcaaaatcagcctgggttgtcacagcaactcacctcagcacagttcttccttctccacggcggcttgcttccaggctttgctgttctccgtcaccgtcttaacgttcctgctaacctggcctgctgcattctttttatttttctcccaattcctccgccttcttctcatgtgtttgctagtgtgcaatacctcacctgtttggaactcaacaacgtcccctcctgcaaaacgcacctgaaaacaagaaatagcacacaaggcctctaagtggccagaacagatgttaccaggcctaagtccataaggaaagcacccaagccccttgcttttgtcttaaatctttttttttttacacctttaaaataaggttatggtttctaaggcctgccgtaaattaggagtagggagaggaactattgccaagcaccccaaaagttcaagaggtgactgttgatcccagagtagcaaggaaagggacagacaggctataagaagtggacacaagaactcagaactcaggacagtgtaggccttgttagagtcaggcagacaatttcacatacctcagaacgtcataaagccatcatgactttactctggaatagatacgatccagacacctagaaaatgttaaattagattcaacttaaagaggcagagtaatatgtgtggtgttttttaatttcgagcattccaaatggttaagggttttcatgcttaaagagagaaacttagctacctagaacttatttatgagtgctctagataattatctactgttttatatttttttatttataccccgttactaaaacaaaagtaaaaataaagcaaaagattgaaggcattgacatttagtctatatactttctagttcctggctctagttcttagcaatatttgctgctaacctggtgttctgtctctgccaaatttctgcccatgtgaaatatatgagacttgatcctatttccttgctcattgatctacctgaaagggtcatagatgtctccacctccctagagctagtgatcctatatcccatcatctcagccagctagaaaacgaaccatcacatgccacctcctacccaattacgtgcttcataaacagaatacctggcatatagcaggcatttactaaacacttggtgaatgaatacatgagccagtaatccataagatatctgtagaattaattacagttgagccttgaacagcgcaggtcctatgggatcccaccccttgtacagtcaaaaatcctcataaaacttttttttcttttttttttgagacagaatcttgctcgttgcccaagctggagtgcaatggcgtgatctcagctcactgccacctccgcctcctgggttcaagcaattctcctgcctcagcttcccaagtaggtgggattacaggtgcctgcaccacgcctaactaatttttgtatttttagtagagatggggtttcaccatgttggccaggctcgtctcaaactcctgatctcaggcgacccacccgcctaagcctcccaaagtaggggattacaggtgtgagctgccgcacccggccgacaggtgtaactttttttttttttttttttttttttgagacagagtctcactctgtcaccaggctggagtgcagtggctctctctgctcactgcaatctctgctcactgcaacctctgcctcccaggttcaagtgattctcctgcctcagcctcctgagtagctgggattacaggcacccgccaccacacccagctaattttttatatttttggtagagatggggtttcaccatgttggccagtatggtctcaaactccggatctcaagtgatccacccacctcagcctcccaaagtgccttggtttacaggcgtgagccactgcaccagccagtacagttttttgttttgttttattttggttttttgagacggaatctcgctctgtcgcccaggctggagtgcagtggtgccatctcagctcactgcaagctccgcctcccgtgttcatgccattctcctgcctcagcctccctagtagctgggactataggcgcccgccaccacacccggctaatttttttttttgtatttttagtagagacggggttcaccgtgttagccaggatagtctcgatctcctgtcctcatgatccgcccgtctcagcctcccatagtgctgggattacaggcatgagccaccgcgcccagccttttttttttttttttttttaatgtatgggggaaaaatgactagaaggacagaaaccaacatataacatgattgtgtgcatttacttatttaacaaataattgagcaatttatttctgtatgatactattctaagcgttttagagttaagcaaactcacagtaaactgtattgcccatgataaaaactgcagttacataatttaaaagcaagaatcgcagcaattcatcaggcacagtgactcacgcctgtaatcccaacactttgggaggccaaggcaggaagattccttgagcccaggaggtcaaggccagcctgggcaacatagtgagaactcatgtccacaaaaattacaaaatagccaggcatggtggcaagcacctgtggtcccagctactcaagaggctgaagttggaggatcacttgagcccaggaggtcaaggctgcagtgagcgatgatcgtgccactgcactccagcctgggtgacagagcaagagaccctgtctcaaaataaataaaaataaaagcaagaattgcagaaagtataaaccatgaccaactcaagagaataatcaatgaaagaataggcagaatgtctttccaaaaagcagttgagagatccccatcctccacatatgcactagtgcagtggggatgttgccaggcatggccgccagacctctagatagaacactgaaggtgagtctgcagtaaagccatggaatgtgctaattttagtttaggaataccaaattttattgaccgtttttaattcaataagcaacccttggccatgtataatcagttcatgacccatcagaagatcctctgtggttcactcatggcctttggactatactctgaatcatggctttagaagacatttttttagtatacttaaatggattttataacttggttgatgcccagattacagactgtgaggagtatctccacataacttgtaactgctatatatgcagtcagcaattccagtatttagcctgatattaatttatatttttcctcataatctgataatacagtgctagcaagatagatcacaaagtgtaaatgagtgtttctggagcatagatgggtacgctcaaatctttgtatcttgttttttaatagagacggggtttcgctatgttgctcaggctggtgtcgaactcctcggctcaagcaatccccttgcctcagcctcccagagtgctgggattatacatgggagccaccatgcctagcttccttgtatcattttttaaaattcaagtaagagaaaatgtctggcaatagttcataagctataaatgaaacctagtcttaggacccagctttatattgcctcaatcaaatattaatatctttagttcaaaatttgtatttacaaaaaacttttggttcttggggataccgttattgccttctctgttgccatccatataatgtatgttgttttttttttctctctccctctgggctgcgtttcatgccagataaacttccaaaccaaactgggatggcaccaggcacaaataacactcttcttatcttttcccccatctaggttacccctttgctttgttttatcggcattaccttttctacaaggagacctacctcatccacctcttccatacctttacaggcctctcaattgcttattttaactttggtgagtaaactaaattagcagtgacaccgcaattagtgggaacctggaaggaacagacttgaacaaaatttccttgagagaatctaataggtagggaagttataatgctcccacttgcaaagagggttgtatgaagaggaacacagcttaacttttcctttttttcttttatgtacattcttctgtcagataaaaacattttgagggtggttacccttgccatacctcatcaacaaagaatcctcagtttctctgtgctgtggatgtaactgaatgaccgagccaagcagtccccacttagattcattcttcacttcagacattcaaaaatacagtaacaagctgggtgtggtagcccggaattcaaggctgcagtgagctatgattgagctactgcactcaagtctggacaacagagcaagtcgcatctctaaaaaaacaaacaaaaaaagaaaagaaataaaataacaccctaataatcttttttattttaataaataatttccatcctctcctccaaaacatgaggttattctgaaaaaaaagatcctgatgccaacattttttctttatatattacgttgtgattggaagtctcaggacggtgggagtgtaaaaaccaggctaaattctctcttcttgcatccaggaaaccagctctaccactccctgctgtgtattgtgcttcagttcctcatccttcgactaatgggccgcaccatcactgccgtcctcactaccttttgcttccagatggtaaacgtctttcccttagcagctcaggctacagctgacagcggttcaggggacaggggtaggcaggggactgtggtatagaaattagcagacctaatttctaacccctctcccagcacttagcagtatgacttcaggtaggtggcttatcacaggcccaagtgttccatccacagattgtaatggtaactctttgcctgcctcaaggaagggccaccagctaaccctttgcatactgtgccattaggctctttggtttaacccactatccaggagcagagtcacttcaaggcaagacagaaaagcaacttagaatgagttaaagaacctaagcctaggccaggcaaagtggctcacacctgtaatcccagcaccttgggaggccaaggcagtcagattgcttgagcccaggagtttgagactaacccgggcaacatggtgaaaccccatctctacaaaaaaaatacaaaaattagccctccagcctgggcaacatggtgaaacaaaaaaaattaaaaattagccgggtggggtggcatgcacctgtggtcccagcatctaaattctcatctcagtttagccctcattttgccaagaagccttgagcaacgctcttcccattacaggttttcagcacctccatttgtaggaatttattaaggcttttaatgatgggatgaggagaaaggaaaaaggaaagagaacattgaatttcagagcaaggagaagaaatagtagtgatgctagaataaatacttctgcctctcctaggcctaccttctggctggatactattacactgccaccggcaactacgatatcaagtggacaatgccacattgtgttctgactttgaagctgattggtgagtgatggtcactgcctgccttccttacatgtaggtccctcccccatctcactaaaaacttcctcggcaccccccctccgccccccgccatacacttctggctgcactcagtctacaggccacatcctcagtgtcctctcccaccaccctacccatccgttctctctctgctcaggtttggctgttgactactttgacggagggaaagatcaggtaagtacccattcatcggcagagaggttcaagacttaatgaaagggaagaaaaaagttgttaacaaaagactgaacccaaattccagagcggagctctccctcattccccagcctgtgcaatctccctttcagatagcactgagcaaggatcaacaaatctaatttgcccaggatccagctcttgcacaaagtccagagatcaatgccagcaaggcatttgctaaagcagcaacagccagctatgcacacacatacgcatttccacaagaagcaactatttgtcatcccccaaagagaaggctatttgaagaaccccagtcagtggggcacacaggtggggaacactcaaagtggctcttgtggggagattcaaggctatcctgaaccatgcattctcttcttggcatagaattccttgtcctctgagcaacagaaatatgccatacgtggtgttccttccctgctggaagttgctggtttctcctacttctatggggccttcttggtagggccccagttctcaatgaatcactacatgaagctggtgcagggagagctgattgacataccaggaaagataccaaacaggtaattgcccctcttggtccagatgtttgtgtaggtatttcactcactctgaagtgactcttctgaaagctgcattctccagcatgaccctggcatagagacctgagtcatgcaggccctggactgttgtaacaggcactctgtgccaggagtgggccctttttagtttagggttcttccagttatccattctaacactagtacaaacataaaaatccacatttatgccacaggattttgcctgaaccagtcacatttctgcctttaaagcctattttcatgtatatatgaaatatatttatgattgataggtaggtaggcaggttgataggtaggtaggtagatagaggctgggcacagtggtttcacctctataatcccagcactttgggaggccgaggtgggaggatcacttgagcccgtgagttctagaccagcctggcaacatagagagactctgtctctacaaaaaaatacaaaaattatcagacatagtggcatgcatctgtagtccaagctacataggaggctgaagtgggagaattgcttgagtccaggggaggtgggtcaaggctgcagtgagctttgatcacaccactgcactccattctgggcaacatagcaaaatcctgtctcaaaaatatttatcagtaggaaatgcaggagggcacagtggctcatgcctgtaatgccaacgctctgggaggccaaggcaggaggatcactggaggccaggagttcaagaccagcctgggcaacatagtgagaccccatctctacaaaaaaaaattatccaggcaaggtggtacatgcctatagtcccagctactcaggtggccaaggcaaggggatcgcttgagcccaggagttcaaggccacagcgagcaatgactatgcctctgtactctagccggagtggcagagcaaggccctgactctagaaaataaaaattaaaatggtaaaaaaaaaaaaaaaaaaaaagtttaattgccagaagaattccttcactgagaacttgtccatcctgtgtttcagcatcaattcaaccaagaaatgaaggagcagattcaaagtggttatttttattatcttacctccactgggttttcagtcccaatggagattgtgagacctggcaagaccttgagatcagtagcatccctgaggggtaaacacaagactggtccactgtctgctgccctgactttcctacaactcttaagaggtttgcagtccccattcctcatagccagccatagaaatctttccctgaaacaggaaacactttgggcagcagagcttctcatcccattccaggtagacaaccacacccctaaacactcctctccataactgaaggtcagagggtgaagggaatagtctctgctctctgtgaccaggaacttcactcgttcctttccagcatcattcctgctctcaagcgcctgagtctgggccttttctacctagtgggctacacactgctcagcccccacatcacagaagactatctcctcactgaagactatgacgtgagtgtctactaaagcagcagcagcatgactgcaccagagctagaaaatggacaggcaaggatccctacagatagcagagaagtaggaaatatcatctacaagtgcatgttggttttgctctagatctgtgagttgtcaatgccagccgtgctgggacatgttcatcagccagcactgaacaaccttcgcgggcacagggctgtgccaggtgcacatttagcacccgttgccttctctaggagccgctcctagcttgccttatcacatccacgtgacccctcagagcacagcagcttctgattctccatcctattttcttctcttgactgatacatttgggcacttctagggaattcagaaaccaagggaaggggggaagtgctggcttttgctcctgcccagctgaaaggcttgaaaacagttcagtaattctgggcaggtttctctccttaaattaaaatccaatatgggcccctctgtacttaacattccaaatgctcattccaaacactttgccaacgaaggcaaacagtagagaagttaaatacagtgctgcccttgaggctctccaagggaaaggcgaatgaatattctccaggccctctgcttattcctctctgcctattgtgaaggcaatcaggccagactattgagggcatctggcagcaggactcaggcaggtatgaagtagccagccacaagtgtgaaaaggaagagtgctgagagaaactgcctagtcatgtgatatccctaatgcactgtgctttcttccctcaagaaccaccccttctggttccgctgcatgtacatgctgatctggggcaagtttgtgctgtacaaatatgtcacctgttggctggtcacagtaagtagaaaagttgaaacaaggtcctatttagacaagccatgggggccagtatggggagtggcaagagccctaactgagctattccctctcaggaaggagtatgcattttgacgggcctgggcttcaatggctttgaagaaaagggcaaggcaaagtgggatgcctgtgccaacatgaaggtgtggctctttgaaacaaacccccgcttcactggcaccattgcctcattcaacatcaacaccaacgcctgggtggcccggtgagctgctggtggggagcctggaccctggttccttccttccactgtcttcccagattggagggcaggggtgtaccatgtcacccctatgcgtctttcccatctgggcagaaccccctgtcgctcacactgactttgacccccacctatacccccctcccaaaaaaaccattactgtcatatttgaaaaaaaggcaagatataaaagtgcgttaagacctgggtgttactccagctctgccaatggacttatgtcctccactgccctgtttatcaacagctttacttgtttgtccccaccactagagtgtgggcagcttgagtagagtgtctggttcaccactgatctcagcatcagcctcagtcactgctgctgaaccaagtggctcgtgcgcacacggtctccagctccgccttgggtctgctttccatctctaaaagtaatcagtcagcactgcctcctgtaccctctgggggctacacgtgggaacccaccagcactccaatccaatcctcagggtgaggacccagaggcaggtggcgggatgcaaggaccagtcagtttgagggtcgccccacccacccttttctccagctacatcttcaaacgactcaagttccttggaaataaagaactctctcagggtctctcgttgctattcctggccctctggcacggcctgcactcaggatacctggtctgcttccagatggaattcctcattgttattgtggaaagacaggtaggcctccagggtgggggtgaaggggaatataagggacaagatgctgatgagctcctcctccctccccaggctgccaggctcattcaagagagccccaccctgagcaagctggccgccattactgtcctccagcccttctactatttggtgcaacagaccatccactggctcttcatgggttactccatgactgccttctgcctcttcacgtgggacaaatggcttaaggcaagtgaaggcctgcttgtgagactgggagggactcactgcaacctcaaaggttgcaaaggacactccaggcctgtctaccttagtggcctctctctccacaggtgtataaatccatctatttccttggccacatcttcttcctgagcctactattcatattgccttatattcacaaagcaatggtgccaaggaaagagaagttaaagaagatggaataatccatttccctggtaagttaatacagctaaactaaaactaccaccaggttacagaatagagcaacagactggaaaaaaacaatagtattagaaatctggggtgaattccaaggattagcctggctactaaggaacacagtatgggcaatgactactgtgacttattgaggcatgctaggaaacatctggaagggctatagaccaggaattacaggagtaactaaccagccttccaaactcctcttgtcttgcaggtggcctgtgcgggactggtgcagaaactactcgtctcccttttcacagcactcctttgccccagagcagagaatggaaaagccagggaggtggaagatcgatgcttccagctgtgcctctgctgccagccaagtcttcatttggggccaaaggggaaacttttttttggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgagccaccgtgcccggcccaaaggggaaactcttgtgggaggagcagaggggctcacatctcccctctgattcccccatgcacattgccttatctctccccatctagccaggaatctattgtgtttttcttctgccaatttactatgattgtgtatgtgccgctaccaccaccccccccatgggggggtggagaggggtgcaaggccctgcctgctccactttttctaccttggaactgtattagataaaatcacttctgtttgttcagtttttc

SEQ ID NO: 467 - DNA, 38641 bp, Homo sapiens
accacaaagccacttagcggcagagcctcgcacccgcgaagattattactagggagatgtttttacccctgaggacacctgagcccttaagtggggcaggcttcgagggaggggggccgataaggcgacttcagacagggcaatcacgatgggcgcttgagttctgcgcagaattttgacaagggggagggtcttggcttgaagacagagcgtggagtcatttaaggataatggaagggcataagcagaagctcaaggataaaaagcactgaaattcttgagctggcggcagggctgaacgtagctcagtgaaagatcctttcttgccacatcctctctaagccaggctgtgagaaccgcgggaaacgaaggagaagggtggcggtggggtcagtaaagggccggcccaaggtgcatcttttaggtcctgatgctaggagcagccgtccctgcccctatattcctctcactgggtaggtttgctcgggagtggctacctcccaggcaaaaattcggcctggttaaactggaaagaccaggaaagcccgcccacgggcgtccggggaacgcctgcaaagtgccagcaccctaccaacccaggcgccgcacgggtggggtcgcggccgcaggctcttccggggcgggcctagcctgacgcaggaggaggggcggcccccgtcgcacaagaaccaatcacgactgtcgcttctacgtggctagcattgaccaataggagaccgtagtgatagcgacggggaaattcaaacgtgtttgcggaaaggagtttgggttccatcttttcatttccccagcgcagctttctgtaggtaagttctgtcttaccggtgcaccggcgcactgaggaacagccgcagccggtgtaggggctcattgttagcgctggtcggtgaggggtggggcgaggtgggggcagctcggagccaggtatgcgacgcggctaaacgagctggagggggaggggatgtctcactgcctcagcgggtctggccggtggggtgatgcaggaggttttgttgaggaagtaagaagtgggtgtggcccacgctggaaagaaggggtggtggggtacctgcgcacaagatcgttttccaaaggacagtctctcttgttttgggggttagaactgggaaagaagcgggtggccgtgatctgacagttatctttcaaacctgacttaagaggtggagtgataccttgctgcaactttatgactttttttcattgttaaacctgaagacggggcagcattgttatcagtgacactgagttggtgtttgagagtcacaaagatacgattaacaataagactgcagacactttattgaacaaacaccaccaccatgcagataagcaagtgctcagtaccagtacaatagtttcttagtgttagattaaggtagcaaatcgtgattctgctagatatgcacaagaataaatctgcggatttcctaattatcagtaaagccccatcatgtttatattctgctttgaaagcacttgcactggaagatttactcaagtaaagcaggcgaataaaggaattgttattcccattgccaaacgaattctttatgtctatgtcactaccagaatccaagcaatctttatgtgtatgtcgctaccaaaatccaagcaaacactctatcatattttttttaagtgacactaaatttgcagatttctacagtgtgacgtcattgatgttatattgggggaaaaagtatacttggcctatgaaaccttggtgaataaattacaaagatgtgtaccttgttgttgtgcacttacctccattaatactagcctaataatagctgcatttagatgtgttcacaaaacgaatgctttagtcgtctgggttctaaaaagctagtgcatttttttctttgatgctagttaaagtaggagttatgactgttcagtttttttcttagaaatggaatccgaggatttaagtggcagagaattgacaattgattccataatgaacaaagtgagagacattaaaaataagtttaaaaatgaagaccttactgatgaactaagcttgaataaaatttctgctgatactacaggtgagtttttcttttcttttaagttagtaactgtttgttgggtatcctctaaggtaaagatatagtactaatcactttatttataatttactcatgtgtttattgtctttctcctccattagaatgcaggctacatgatggcagggtttttgtctgttatatccacagaactttgaatggtgtctggcacatggtaggtaggcacttaaacatttattgaacaatgattaatgggtgaaaatgcccagagtttaatactctagctcttctaaaagtattagctcagaagcctgattctttactgtatttcaaatggttggtcatttgaatggtgacctttggataattttcttacatctatactaacctttaaatagatgaggaattgaaaataaatggaagaacctgtgatctaatcatggtggctgactgttcactttgaaaaaacctagaaaatgatagttttagtgttaagcaaaatcttaatggagtataattgtgcttaattatgtcactaacaaaggttgtacatcaaggcaattgagtattttaagtactgaggaagattcaaagatgcttaaaaccatagtttctttctagatgagaatttatatattcactatgctacattgtaatgcatgctgggcatcataggaatactagcatgataaaacacaaatgttttatttgttgattagaggaagaatagggtactcaggcatgaggaatgcatctgcaaagccacagatggcaatgtgtgttttttagacatttcacagactaatttcttaggaaagcaataggaggtaaaaatagaaaattaaggtcagaccaaattaaatttaaaacgacaaagcaaagttatgcatgcactatattttagtagaaagtagaaacaaattttatttataaaagtaaagatgtaggctttgttgaaagtgactgaagttaatagaaggaataatagcttctctggaaatctgaatttaatattgcttagtaataaccaaaatatcctgaacagaagactgacattcaagttatctttttaaaaaactaacactgaagaaagtaaaaagtacatttcagtgtgaacattttgtctgaaggttattcttgctgtttctgttggttggggttccacagagagaaacctgacagtcacaagaggtcctataaattccaaaggtctagaccacggtaactatgagtttgttggaccaagaaattatcagggcctctagcagaaatttaggttacttggagagaagaaaatgattgtctcatttgtttattttttgtaaagctggtttggttttacaagtaagtatgaggtatacagagataatgttgaatggttaaggttgtaaagaaggttatgttaggactggagcagtaggtttaatgaataaatcattgatgggagaattttctaagttaattagtacaagtggcagtgggagagatttagttttctatggataggtaggatgctaaaattatagttatcctgcaacagcataaaattttcttaaactacatacaatttttaaaggctacttacaaaaaaactcacttatttccaaatgttttctttccttcaaaatatatagcttttggataaagtataccttcataaaagataaatacacgataaataagttacttgtatttatatgaacttttacaattttaaaaagtattataaggactttatgtacattgatactgacagtacaaatgtttgactatattttgaaggaaaaatgcaatttggcatttgttttatgtcttttcttgtgatatattttgttccccttatttagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagcgtaagtattagcattttaactatgttcaactatgttacataatatgtaactacactgcaaagagagaaaataaaaaacatggcagtattgtgagaaaatattaatttttttaccaaatacttttgcttatagttaacaagagactaatgtaaactcttttctatgcacgtttccacaacagtttacttattttaaactgcctaaaaagatttttttaaaataacttattagtatttaattttacccacagaaaaaagcaatatcccatgttttttggaaaattgaatgaagcattatcaaatttaagtagctatgttctttttcttaaattttgactcaaatcttttattacagtattcaagagccagatgatgcacgtgactactttcaaatggccagagcaaactgcaagaaatttgcttttgttcatatatcttttgcacaatttgaactgtcacaaggtaatctgaaaatgtcaaattcaaattttaagtaaaggataacttattacaacttacttcctaatattaaatcatatatatgaagtggaaatttgaggcaaaagacattaaagttgatcagatgagaatatggggagaaaatgccacctaaatgtaaatgcagagaatatctgttatactagcttttccatgtataaagagtaatccagggaaatgagcatgaacattgtgtatgtgctactagttagattcaggaaacatctaaaggaaagtagctgcttcactgagtatttgtaggaagaaggatatcagatatttaagctagagctttaaatatctagagcttacataaacttttcttatgctatggtttcatagcaccaaaatgtacattaaagtgtagctatgtaacttggtggtcaagtaaactatatatctgtgtgtgtgtgtgtgtgtgtgtgtgtgtgtgtgtgtgtagcgttaattggtagttctttaaaataaaaaagtaaactgctgtagaaactatttcttgctcacttggttcttcatagtctggatttttttgggtaggaccaagacaatctcttcctaagacatttttaacctggccattccttagtcttttctcattttccagggcctttggatacaccctcagtctgccctctggccaggtgtttccattctcccactgccttgtttctgctacaactgtgatccaatttactgccagtgataaacatattaacactattggaagaatccccatgatggtttccatagcagggattggtcactggagagtattccccaggattgagcctggagaaaataattatatgactcagaaataatttgagaaccctgaattgttacccattcagatgatttctgagtcctagtaattgtcttctccaatatgtcctttgctctatcaggttactttttagaactattatccctttcttctctagaaaaatggattcctccttgcttgttagagaaaatttggcaaggcttctttctctccattctgcttgaaaatttcttgaggtattgtggcctctcaataacaaccataaattttacatgtttagaacatgtaaatattgaaactcttaaattgagttatctgtaaaaaagacgaactttatctataccactttatctgcaatgtggtagtaatgcacagtgatgcaatgtggtcaaatgcattgcacagtaatgcagtgtggtcaaattatgattattttgagcacagttgatggcttggctgtcaggaaataatgcagcatccctgaagtcctatgcagagtctggtgtgtgagtatttttatagggatggaggacatttcagtttttaccagattcttaaagaaatctctgatctcaatactaagctatctgattaattaagcttcttaagcctttctctcttttcttgtgctaaaatacacaatacatgaaattctaccactacttagtaaatgtagatgtaagcactatcaaagatatttttaaaaatttataaactaccagaagctagagatcatctcttaagcatttttatacgctaagtaccaagtgcatagcatagctcaatggctcccataaatgttgataatattctgtaagatatgtgatgtatacatttaatatttatatgtcaaatgctaggggtaagtttaccaatttttttggtaatctgtccatactcagaaaggtaattatgatagttcctcagttattctgcattctttttcaggctggtatagctgagtgtgacagctaaagattaatctgtatttattatgtttttccccgaaaatccttttgatggaagatgctctttaacaaaagatgtcatccttcccttaactaaatgtcattatgaatgatacttattatagcatgttgtaagagactgatgctcttggcacttttgtaacatctagaatgccctcctgtttctaactgttgtgattggcctttgctgtcccctgttggtaactgctttgttacacttctgttacttctgaaagtggacagtggtgataaactaatgcaaaattacgtcagctacatattgcaaggaaactatttggtatgcattgttatcagaagagagttggttatctgcataaaaagtgagagattgcttacttgcctatgaaataaaatacatgagccttggaataaatatttttgcttaagtctttttgatttttttttctaggtcctgatgaatacgtatctgggtggtctgggtggtgggcattttactgcctaaaaatgacaattatcttttgctttgttaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcaggtaactattaaggtatactaatactttctgtggtaggtagtacttcaaataaagattcgggataataatttatagaaaaatattatttatgtagaatggttaaaatctaagattaaattgtaaaggaggtaagactgagaagtaaaaaagtctctacaaccccatgcaaatttgtcttttttgctaactaaactttcgttaacacatgaaaaacaactctaagcaagagaatttttttttttttgcttttggaaatagagaatgtgcttttaccctggggaaatagttatataatttaagagaatttgaagaagtagttagataattatcttggtatcatcttcatgtctgcatatcttacttggggacaagtatttcctatgaattgacttttaaaatattcttatttgtaagatcacttttttgtacttgtcttatttcttataaatttaatcatagtttcaaaatttttacagcatctacggtattaactgcccaagaatcattttccggttcacttgggcatttacagaataggaacaacagttgtgattccagaggacagactactaaagccaggtttttatatgggtaaggaaacggaaacagtttttaaatgttcatcttctatgtaagtacatctgtgttttttaatgtaattacatgtatctgcatatatgttttcatgtgtgtgataatgtttagcagtagagtagaaatacatattaatattgttctttgaaaaattgggggtattttctttctgtttagagagaacatgccaccacaagatgcagaaataggttaccggaattcattgagacaaactaacaaaactaaacaggtaagttactttcaatctgcttgattaaggtggtgatagtctttatttcctagttggttatttaatctttcaaaatatttttagtcatgcccatttggaagagtcccagttaaccttctaaatagcccagattgtgatgtgaagacagatgattcagttgtaccttgttttatgaaaaggtatgttgagttttaatttttaaaatttgttgtccgtatgggaagattaatggcagaatggtcttaaagtcttttactgagtaatagtaattatgattaaatttttattcagttttagaagataatctctaaatgttgtcaggaacaaaggaatgagtggagaaaataactttgttttgctttttcactcattaaaaatattcattaaaggagctttaaaaggaaaaaatattaagtcaacattaagcttaaaagactgatatttgaggatttgtcacttacgggtaggctgtctgctaagaatctcttcctgttttgtttgagagtctccataacgggtagaaggaggtctgggaacaaatatttgctccagatagttcaaggggagaatcgctgtcagtgggatagatgattattcttttgcttgagtctagtgcttcaagaagtgggacaggttaggtacagatgaattactgttcatcacatccagtgtgttctccttccctcaatttgcttgtttattccctgttaagaaatgggaatgtagcctgtagctcagctaaaggagagttattttggcctattcttaattctgaccaacatttgtaatatttatattggaaaaggctccttacagtccagagaatcattttgcaaataaactttagaaatacgattgtttttcattactatcttttataattacatttctattatatttagacttgactaaatattgacattaaaagaacattttgtttgtcaaggttaagctttaaagtcttatcactatgatttcatcttgttcatctctatttcaaatacctagctcaagaataaaggagattttcttccgctccaaaaaattaaaaacaaaaacagaaaaactgcagccattttcttggttcctgttatcgatagacaatgctaggtactgtggaggtccacagaagtgctataccctggttcttatcctttagctatttgtaattggaaatgtagtttcatctgtatactttgcctttcccacagtctaaccctaactccaattgttactgattagataatgaagaagtaggcgatcacctgtgtcacttttgtcattgcccagcacgtaattttgttagctaagtcacttttgtattggaattatgtcactctaaaaaatgtctttttaagagatttttttcaataaaaagtatgtatattattaaaaatccaacttgagatgaaaaaatacattgaaaattttttttttcaaatttaatgttaaaattattttgtttcacgggtaaaagacaaacctctagatcagaatgccgagatttggttgtgcctggatctaaaccaagtggaaatgattcctgtgaattaagaaatttaaaggtattttaattctatatcattatataaagcaagggttcctgatctgggaggatcagtattcatggagctttttctggggaaagggtttataaatagttcatgtatctccaacagtgttccacataccccaagagctgtgggactacgagtgggaagttggtgcagaagtcctagactatgtttctccaagattaaggtggtagagcaaggatcaacaatcttttaagagaatcatgaagtaatatttattatgcacgtgtttaagcagatagttggcctgggtttgggaatacgtgactgggggaactgttgcccccaagttttgttttttgttatgtttaatcatatgattttggtaagacatcttaaaaaaaaatgagagagtaaattgagttagggcagaggtgaggacataaataatcctgacctcctgacatggcagagcaactttgtgtggacttaaaggaaataattttagttcctggtacactgtgatttttagtggttatactattattataattgagttaaacccctggcatcatgatgtgggtcttttcaattttatgttctttgtaatgcctccctctttcatgacctatgctttaagtattaatttttcctaatcctggctgtcctagagaacagtgcataattgtgtcaaaaagattgttctctggatttagagtaactactctcttaagttatgcagttactagttttgacttatttttggtgataaaatagccatcacagtaacaaaatacttaaatcttttttcttgtcatgaggcatactctatgttgaattcaaactttctaaccctttccatctttaagtgaaatatattttagcaattgattaatacatccactgaaagcaaattggccagatttatggttatgacccttcccatttctctaattaataattcaggcagttaacctttgctgggggtttgtgagtctacatataattataatagaaaattttatgagcaatccatgtatagataagactttagtatattgaacagtaagacagattagtagtactactatttatgggactttatttgattttctttttcatgtagtctgttcaaaatagtcatttcaaggaacctctggtgtcagatgaaaagagttctgaacttattattactgattcaataaccctgaagaataaaacggaatcaagtcttctagctaaattagaaggtaagagtaacaaaatcagtagacttgtatgtttagttaagaaaaccacttgatagcttaagaaagcagactagccacctaagaattatgatgtgaaactgtgtctatgttcttttatcttgaatttccgttcagttatatagggtatatgaaaagtactgaatccgcagcaaaggaaatttatttacctaaaaggtgcataaaagaaagagtggagggaaaatgcaatggaactgagttttttttctcagttggcttgacaaatactttctggaagggatacaaaagctgtttttatatgacagctctcatcttttatcaagcgtttggttttctactgcatgggtactgtgatacatgttctagggatatataagtggataaaacagtgtcccaaggaggttgcagttcagtgtggaagatacacagagatatataaatgcaatgctgaatagaatgtggagattgtcatgagagccacataaatgaaatgctatgagaattcagaagagggagaaattaaggaactaatttggtttaggagaaataaggaaatattttgtgatgatggtgaagtttgaagaaacaaattaggatttaaatgggaaataatagagtatttcagatgaagaggataacacagacaacgagtaaaatgtttcaggaacaagagactgtctagttatgctgcagactgtaacatgggtagtgtgcaaataggaaataagactaggcggactttgaatgctattagattttttatttatttttagaatgcagggtaccattaaagatatttaaacagatcattaataggatgatcattgtccagatagaggttgccagattggatgtattaatttttaatttgttttaataggactgaggagggactttgggacaaagtgaggcttgcctttgccagggactttgctgaaagtccaatatcccaagaatgcctcagtcccaggcaaacggggacacacacaaaaaaacattattttggttgggaacagattcttattcctagcgtttggtggaaagtgtttacatttcatattttcttggcatctattgtaactggtatgattgagaaaatcatctttatcaaatatgcttgttaatagtactctcaatacctaatttaatgttttaaatgaatgcttgttgtctacactataccagtaatactttattaatataataaagcatatagtcagaacactgcccaaatcacaagagtgctgcacaatgaaataacacaagtgactgcatacttgtaaccaatagccagatcaaaaaatacaacattactaacacctcaataacctccttgatcctcctcctaaatacctctctccttccagatgtaatcattattctgatttctaacaccacagaatgaaataatacagtgtgtattcttgtatttgcttactcactgttgtttatggaactcatccatgtttttatgatatatagtctgttgatttttattgccgtatactatttaactagtgtaaatatagtataatttgtttattcacatgtacatggataacagttttttgtctaatgaataatgctgctatgaatattttggtgtcttttgattcacatatgtacaaatttctattgagtgtattccaagagtgggattgttgggttacaggatatgcatgtgttcagctttggaagatggtgccaaacagtctgaaaagtggttgtgctaaccttagaccagcaattatgttgctcctgctcctgttctttgcaatcattgtattggcttttaattttaggcattctgatgctatctagtggtatctacctcgttgtggttttaatttgcattttgcatttccttaatgtctacttttgaacatcatttcatatatttattggccatgtggatactctcttgtaacatactgcaactctgtcacccaggttgcagtcttgctaatatttctgttggtttttctttctttttctcattgatttttaagaggtatttatatgatctagatataaatcatttgttggaatatgtgtttgtaagggaaaacgcataattatttttctttccctttttagtttcttagctgagacactctcctgaaaatgcaagaacgattaacaatagaaaaacaagcagaagtttgttaacatgtgctctacccatcacctgggcgggttcagttcagaagtatttctttctctccaagcagtggatttgcttaaatggtattttaacaaagagccataaatcttaaatattggcaagacaaaggagagaacagttccaatctttaaaagcaggaaaatgtggaaaactagtaaaatctatttccagattcctctggtgcctgctagtgctttctgggccaaaaagcaagtgttgtctccagtaaggaaagatttatatcctgccatcaggcaagatatttccatattttttagatttatcattttacttttcaccttctgatttatatctttcctgagtttaatgtttacatatgtgtaagatcaagtgtcagggttcattatttttccccataatggatatccaggtgacctggcaccatttattgaaaagatcctcctttacctcactgacctgttgtaaattaggtgattctatgtatggtgtctggctttggattcttttctgttctatattcatttttgtctttttctttttttgagacagggtcttgctctgtcacccagattgcagtgcagtggtgcaatcacagctcattgcaacctccgcctcctgggcacaagtgatccttctacctcagcctcctaagtagctgggacttctaggcatgtgccaccatgcccggctaatttttagtttttttgtagagatggagtcttgctatgttgcccaggctggtctcaaactcctgagttcaagcaatctgcccacctcagcttcccaaagtgctgggattacaagtgtgagctatcacaccaggcctaatgctctcttagtagctgcactaagtcttgatatctgtcagtgtaaatttttcaactttgttgaaaattcacgactattttggctattcctggcctttggatttccatataaacactagaatctatcttttggttaccacttttaaaacatgggattgtgattgatatttaactgaacctataaagaaatttgggagaaactgacatctttacaattaagttttacagctcaataacctagcatatcttttcattcatttaaagtaatgagataattattttctgtgtagagacctagtgtatcttttgctaggtttattcttgaatatttttttaatgctgatcagatattcttgatattttttgatgctgtgatagtgaatggtatctttttaaaaaccttttctagcctgagcaacaaagggaaaccttgtctacagaaaagttagctgggtgtggtggtatgtacctgtggtcccagctatgcaggaggctgaggtgaaaggatcacttgagcccaggaggtcgagactgcaatgagccatgatcacatgatcatgccactgcactccagcctgggtgacagaagaagaccttgtctcaaaaaaaaaaaactttgttgttagtttataaaaaatataattgatttttacttatttatgcattgctaaatttactgagtaattctaatagttttccatgcattttttggatttttacaggtacacagttatgtttgaaaatagtatagctggccgggcacggtggctcacacctgtaatcccagcactttgggaggccgaggcaggcagattgcctgaggtcaggagttcgaaactagcctggccagtgtggtgaaaccccatctctgctaaaaatacaaaaaaaaaaaaattagccgggtgtggtggcaggtgcctgtaatcccagctaatcgggaagctgaggcaggagaatcgcttgaacctgggaggcggaagttgcagtgagctgagatcctgccattacactccagcagcctgggcaatagagcgagactccgtctcaaaaaaaaaaaaaaaaaaaaaatatagcttttttccttttgaatccttttaactttcttttctatgccttgttataattgctatgacctccagtataacagtgaatagaaagggatgataggtgccattcttgtctcattccttattttaagggaaagctgtcaatattttatccttagtatgatcattactgtagagttttgtccctactttttgtcagattgagtaagttctgttttatactgaggctactaataatagttttttttgtgtgactgggtgttgaattttatcagatgttttttctgcatctatttagttaattatatattttccgtctctattctgttattatggcaaattacattgactttcaaatgttaatcaaactttgcatttaggaataagcccaatttggatataattttttatctcctttgtctatcaattgctaatatttcgtttaggacttttgtatccattataatgaaaggagtggaactgtgtatttgtagaatgttaaatatattgttgaggcgttttgtttatagaccctttgagagaataaattacaaactagcataaggtgaaatttttatgttaaactagaggtcttgtaactgacttaagtccggctgcttgctactcagaggcaaaaaagacaagaaatgaggtgtgatgaaaggaaagcaattttattaaccaaatgctagcagttggagaatgcccaggctcttactttcaaaagactattctgtaatttctgaaacatgctttcccataagataattttttcttaattggaaatgacccagacatctcataagcatcaattatttaattcaaaataatttgaaagtccactacaggcatttatctcatttacatgccctgagctttttccatttttaagtttttctagattacttctgaaaactgaaatgttatacaaagctagtcattatttgaagttgtttccctgttaaccatttttacagtctgagtaacaggtaaacaacctaagtaagaatcttagagttaaatatattttgccgataactcagaagattgagctgttttcattgaaccaccaatctaaattaaattagtcttacttgtcaaaaaaaatcacacaaagattagtctgtttttgactgtgtttatagtcttataaccttgatgtcaaaccctgacatcttaatatatagacatagacaaatataaaaccatttggtcaataaactcagacaaaaatgtatgctgataattctaaagacattttatttttattaataattttaaaatcacttttatttaccaaagattcatatgaacttgaaaagcattaggacttacttaatttatgagtactcatttacttataagccaatttggtagcatgctagattcaacatatacatgtatgtacatataaacatgtctaaacatgtatacatacaggcacaaagatccaatagcttttacctcagaatctagccataagatgacaatacaaactcaccactttataaaagacagctgatcctaattatttttctgatgaaattggaacctgttcacatggctaaaccttgtttgccctgataggtaatctaaggaaagctgtcaaccaaaatttgggtaaaaaagtctctatggcaatttcgttttaaaaacctcttttatcctttttttccccttttttcttcagtttcaaatgagttactaatgattctgttataatcataactggctgacctgtataagaaaaataaaaaaacaaaatctccaagtgagataaaacagtgagttttatctcaactcaactagcttaataacagcacattcaaagcaggcagaaaagaaaagagaaaatagagagctagctttagaagactgtttaattttgtagttaaagattaaccatttgagctctgaatttttcttactggaatttgcccatagttttaaaatgtgcagaaaaacgggccataatgtgtaaccagctggagtcccagatagtccaggaaagagctcacatgctttctcccctaacaaagcttgacgcagatacaagaaatattctggagtccaaaagaggatgacaaaaatcagaggccaggttgttggaaaccatttcttccctagcggggagaggagcagcctatcttgctgctttctagtcttgctgggcgggacggagacagtttcaaagcacccttggaaagagggataacgctaaacagagacacaaatacaggcggatccaatgcagatggagcattccaaacccatccccaagaaggggagactggagaaaagtcctgagatcttgtctcaaatccagacagcactgcagagtgacctgcattgggtccagatggcaaagagacccaaatggcaccacagatgacctatactaggtccagataactagaaagtgcagatggctaagatggaggatttcccagtacactctggttaatttatccaacccttgaattctgttgacctccaagatgccacttccctttcactaactgagtgttacagcagctgatgccacaaagggaagggaaggaaaaatccttcagacaagggtggtctccctagctgctgggagttccttaaggtcccagctgcagggtcagctagccatgagcagctggcatttgcaagtggctcctgcgttggcctggtagcctgagtgggtgagccttggcctgctcccacagccaattgctccacttgttggaaaccaggcgtacaggctgagcccctcaaaacacacagttcctcacacagggcaccacatttgtaactgactcaagtccggctcttcacaacacagaggccaaaaacatgagaagtgaggtgtggtggaaggaaaacagttttattaatcaaatgctagcagctggggactggccaggctcatgccctcaaaagaccatttcaactttttgggctgagtgaaggggtttaaaaaggaaaaggtgtggaagagatgcaggagtggtgcaggtctgaatgtcttgttgtgatagttatattgagtaattgcccatctggaggtatggtttgtgtcatcttgacttcagctgggtaatgctaggctaactgttcgaaactccccccatgcaagaggagtctgcaactccatctctgcttggtttgtttcaaaactggcccctgaaatttctaagcaagtacgtaattagataagtgaacactgttcatggacatgcctggtgggaaagggagaaactaagggtttcaaagtatgcttccaggctgaaagcaaaaaggaaaaaaaaatgttctaaattgcattttgagggttggatactcggtctatgaaaagtgatgaattagcttctctattagtaagactttataacatctatatgtttttaaatttttacttatttattggtaaagaagcatttaaatgtggcaaggtctctgacaaagttcttagtaacaatgtaggaagatgactatagtgcaactttgtgaaattgacttgctaaaagcaaattgttaagcagctggcttaaagcttttagtttctctccctccttgattgtttttaagaactaaatactcatatagtttgtaatatgttctgttgtttaggcttagtttattatgatcaaatattcttgctttttaatgacaacaaatacaatttcagaaactaaagagtatcaagaaccagaggttccagagagtaaccagaaacagtggcaatctaagagaaagtcagagtgtattaaccagaatcctgctgcatcttcaaatcactggcagattccggagttagcccgaaaagttaatacagaggtaacttttccactaaagtacaatattgcttttttgttcataatgcatttccgaaggttgatgatcatattaaatgttttcttttattaaatgtgtatgatatttagtagaatagtttatttaaaggtttttaaaatcatttataaagtggtgatcagtagcagtcatacgttcagtaagtcaggctaaattattttctatcttcgatagtgtttctagattgccgatagactggtgctatgggccaaatctagttcttagcctgattgtgtaaataaagacttactggaacactgacacactcattcatttaatgtctatggctgcttttgcattataagagcagagttgattagttgtattagagaccacttggcctgcaaagtttaaaatgtttactatctggtcctttaccgaaaactgtatgctgatctctgaactagcgcagtgctgtcccaagcacttaacagtttcctgtggtcatactcattgataaaaatagaaaaatatagcctagacaacgtacatgaatttgtaacatactgagtcatcattcctggtggcttttcggaaggaatgatcaagtaggatactaaagagctatagctgcagttcatggccatagtttccttaccatttcttttcagtgacttgtagtaaatatagtaaaggctttattaattcagtggttctcaaacatttggccttttatactcttaattatcagtgcccctaaagagcttttgtttatgttgattatatctatctctatttactatattaggaagtaaagccaagaaactttaaaaatgtttattaatttattaaaaataactgagggctgggcacgatggctcacgcctgtaatcccagcactttgggaggccaaggcgggcagatcacgaggtcaggagatcgagaccatcttggctaacatggtgaaaccctgtctctactaaaaatacaaaaaattagccgggtgtggtggtgggcgcctgtagtcccagctacttgggaggctgaggcaggagaatggtgtgaacccaggaggcggagcttgcagtgagcagatatcatgccactgcactccggcctgggtgacagagcgagactctgtctcaaaaaaaataaaatgaaataaaataactgataaactcatgtgaatataaatgtacttttatgaaaaatatgtattttctgaaacaaaataactacagtgggaagagtagcactgtgttagagtttttacaaatctaatgattggcttaacagaagactagattcttatgtctgcttttgcattcaatgtatttcattattacatgtcatacagtctctggaaaactccttatatactcatgagaaaataaaagtgagaaaggtaaatattgtcatagtaagatctcttaagtagtagatgtagataacaaatgctagatgataaggatcctgataggttgagtcatagattgtatcaaaccagcatctcctcttttttttctatttgaaaattgtacactaataggattgtaagggaactgaaaaccatatggatcattaaagaaatgcaaagcaaaaccataattagatactacttcacacccactaggacggctgtaattcaagagacaataacaagtgttggcaaggatgtggagaattttagaaccttcatatgctgctagtgggaatgtaaaatggtgcagtcattttggataagagtctgggagttcttcaaaaggttaaacgtagctttatatgatccaataattccactcctaggtttgtagttaagagaattgaaaacatacatccacacaaatatttgtacataaatattcatagcagcattttcataattgccaaaaagtggaaataacaaaatatccaaccgatgaatggataaagaaaatgtggtacatccatacaatggaatgttaatcaacaataaacagtaatgaagtactagtacatgttacaacataagtgaacatttacaacgtgctaagtgaaagaagctcaccacaaaagcccatatattttatgatcccatttagataaaatggtcagaataggcaaatccatagaggtggaaagtagattagtggttgccaggggctgggagcagtggggagtggggagtgattgctaatgggtgtgagttttctttttagaagacgaaaatattctaaaattggattgtggtgatggttgcacagctgtgaaccactgagcaactaaaaaccattgaatagtacacgtagaaagaaaaagtatagaatctaggcagtttcttgtggatactgcttgtccagcagtcccttcaagggaggattgtttttgtctcacatctcacttaccatatggctgtgtgctctctgttctgtgtccagaccatttcttcctctttcttgcaaaaggcctgctcttttgatacttctgacttactctcatctctgaatgtcctggtaactccccatcattccttgaagatacaaggctctggatcaaccagatcccaacaactgtcattgtttttgttggcttctacacccctgtgtattaccagtcctacagctggccttcatttttctaacttcttcgtgtctcatgaccatttccttaattttactttagccacctactccttatatcctcaattctgacctccaaaatcgcagatgctaacattccactctatgatcgtgatctttttcattttccttgttcattaatcttattacagcagttcctcagtaacatctttaccactaatcttaaaatatgtgcgtgcttgtacgtgagcacagacacacgaagtcttaaatgagagggaaaatttatcctggaaaaaaaatttcttggccaagactgaaatgtagaaagtaggatagatttagtcattgtaattctcaagtgcgtaatgaggaccagtgtgttgaaattataatagataaaccaatataatccaaattatctgcaaatattttctaataactaaagctgtcctgaaattgaagtgaacctctgtagactagtgagtgcttagttactaaaagtattcaagcaaaacttggttctctatttaattgagatgtgctacagcaggggttagcaaactttatgtaaagggttagcaggctttccaggctagatgggctctgttgtagcttttcacctctgccattagagcatgaaaataaaagccatagacaatatgtaaacaaattggcatagccatattctaataaaactttgtttacaaaaataggcaggcagcaggccacattcagcctgagcctgtaggctgtaatttgctgatttctgctgcagcggatgttccttcatcattgtttggggtttgtataggatgaatcctataggttcttttttttttttttttcccaacaatgcttttggaaaaagaatttctacaggttctgtctcttcttatggaggacacaagataggcatttgtcattccacattttgctaagtaattagtatttgtctacatttgaggagaagggaatagagttttattgattaaagaaaggctgattttcagaaacacaggatactattttagatgataagaatttaatacttgttacaatagctctgatggaagagaatgttaaattctgttttaagtaattttgtgtgccttccctgtacttgccatcagtttgagcagaatgcactaggcttaagaatttggagtaaaataactacactaaaaaaattattgaaagtctaaaatgtatatatatgcctatctcttttagtatgcctttgtatatcatatgttattattttattttaaaagttataatatttgtaaaaactagtgaacaggcaactaatttaaaaactaaatcatggtgttctttattttgttttagcagaaacataccacttttgagcaacctgtcttttcagtttcaaaacagtcaccaccaatatcaacatctaaatggtttgacccaaaatctatttgtaagacaccaagcagcaataccttggatgattacatgagctggtaattactttggccccttgcttgattggcagggtggtatgatagaattaacatgggcttctgggccaaataaatctgggattaaatcctgctcttttactttaaagactttccatcttcatattattttttcagcatcagtgttttcatctataaaatggaaagggggaagtggttgcaataatgcatatttttaaggattgttgtgcatgtagtttctgtcatatcgtaatctgtacctacaacctataaatattctaaggatgtaaaacgtcttgataatcatgtattgccatacagatatctctctattaagagagagattttaaaggttagcattcttagagcagataaagagtagatgaattttttcacataagtggtgttaattggaaagtgatagcttctggaagagattggtttttacagttcatgtagttctggaggtattcaaaggtgtagtatttgagtgaataggaatgatggataagtgaagaagttcgatgatgagtgtgctgatagggaacacaagggatactacaaaagaaaatgaatgacatttcagagaaaggaaataaagggatgcgatacattataaccatcaaccggtggctatatctttaatgtcttaggggatagcttaaatccgtgttgtcttttgcgtttcattttcataatgtaatccttgatcttaattagaactggtcttaaagattttataacccagcctcttacctacttaatatagttttactatatattgcctcattttattatatgtagaatattctaaagaatgattgctaactaaaatagcgataatagatatttcttgtgatactaggttaattattgttaacaaatatttgtggagctcttttgtgccaagcattgttctaggtgttgaggatatattaatagcaaaaaggcaaacaaagcacaaatgtatactggacagatttaagctcaaaggccaaactcctgtgatgtaattggctttctgatatttctagcaagccattatagaacattattgtttaaaaaaaaactcaaaatctatggccggccacaagctgatgtttgctaaattcatataaaataaccctaaccactttgtattttaaatgccatcttttcaaacaaagatttcttgtctgcatacaaatatttactttcagaaagaattccccaaaattaaatatccggtggtggcatatctggaataagtgtcagctatatcatgaaaactaacttgggttctgtttgatgtaacacttttaagtttatatcagtctaaaatacatgaaactgaatcagacttatttgttaaattgtaatgttttaaataaaaatatatatatatttcctagttttagaactccagttgtaaagaatgactttccacctgcttgtcagttgtcaacaccttatggccaacctgcctgtttccagcagcaacagcatcaaatacttgccactccacttcaaaatttacaggttcgataagctttatatatgatggtatatgttaagatacagtccgttttacagcttttatttttatagcatctagttatcaagaaaggtcttaagaacttggccattcttatttccactagacaaaacttttctgatattctaataagagtgtgccttgtggctttgagaggttggttattgaagaagcttacgaagctactcttaataactaggccaaaggatccagtttgaatagctggataaaatttctcttatgaatcaaggttaccttttattttttatttttatttatttatttatttatttatttatttattttttgagacagagtctcgctctattgcccaagctggagtgcagtggcgcgatctcgggtgactacaacctctgcttcccaggttcaagcgattctcgtgccttagcctcccgagtagctgagattacaggcacgcaccaccacacctggctaatttttgtatttttactagagacagggtttcaccatgttgctcaggctggtctcaaactcctggcctcaaaccatccgcccgcctcagccccccaaagttctggggttacaggcatgagccactgcgcctggccagcgttactttttgttgtgttttgtcagctgctagtgagcagcttcattttgtttgttagtatacaattcatttggaaatgtaaattttcaaaaatatcagaatagcaatatgaggtactgctagaatgtattatactaataactaaactaagaggaaagattttttgctgatgaggcaaaagttggtttctagtaactgtcctagaggcagcttaatactggtagaaaacatgggccttggagacactgggcatgaatcttagcctcactacttacagtctgtgtgatcttttgcaagttacctaaattttcggtgcccatttcattatctataaaattagtaaagctaactacctcctaggatggttgtgaagattaaattagttaatatagacgtaactcctaatacagagcatgacacttagtaaatcagaaatgttagtagcaattgttatttaaataaaacaataaaaaacccatgagtaattaactataaaaatcaactgataaaaaaattagctgacagaataagaacagtggttgtcagggaagggaggaagaatggggagttactgtttaatgggtatagagtttcagtggtatttgcaccaccatccatcaccagaactttttcatcatcacatactgaatgtacttaatgccactgaattgtacctaaaaatggttaaagtggtaaattttgcattatgtataatttgcacagtttgaaagaataatggacaaaataatgagctgacagtagatactaactggaaagaggtgatagtgttttaaggattgaaacaatataataaattacaaaggaaaaacaaaaatgatccagtttgttcatgcattgattcaaaacacatttatttagctattactagtgtcaggccctgtttgagttgcaatccagaagacgagtcacagatgacaagtgaaggggcttggtggagccttctagaagaggccagtgtcagaagagaactgaaacgaggccacagtgtggctagaggtcaggaaggggaaggagtgaggcccaaggtttgctgggcccttaagttttaccctaagagggtgggaagctttggaagaggttgaagcagggaagtgaaatgatccaatttgcattttggaaactctaaccacagtgagtagggcatactaagggggatgcgggaagtcctgtggaggaaaccagagttcacattagtgttgagtcagaaataagaattactttattctaaaaactgtcagcagccgtggagaaaggacattgaactgctttcttcccttggcaatgttcacagttttaaatatgaaaggaagaagacagagaaggcacaaaaggaggagtggggaaaccttgatgaaattacaacacatacatgtttagaagcccaatactttgttacaggaaatatatatagacaatgtatctcaatcctagaggtgaaaaaattagaatacttatctttttatttaaataggagattacatgagagattctaccatttggaacctaaagcaggccttagttaaattgaggtttattcagaccttgtttaacttggttaatcagctaatcaggaggtctttttgtttcaccttctttatcagctcagaataagtcctctcagcactccatctgttcaaagcatttataggtacacagagagatcctccaatataagggaaggaatgatggggctggttgtatagtacatcaactgaaagtttgctggggaagacgctgaggttctgaaaaattaagtaacttgttgaacatcactcaggacaaagttgggggctgtattaatgagttcttacactgctataaagaaaagaggtttaattggctaatggttccacaggctgtacagtaggcatgatgctggcaatctggttggcttctggggaggcctcaggaaactttcaatcatggcagaaggtgaaagggagcaaatgtcacatggctggagtgggagggagagagagagttgggggcagatgccacatacttttaaatgaccagatctcttgagaactctcagagaagcactgaggaggaaatctacccccatgattcagtcacctctcaccaggccccgcctccaacattgggaattacaatttgacatgaaatttgacagatccaaaccatatcagggacattgctgaaatttgcatttgtctcattgactttggagctcttagcaccttagcacattgcttcctttataatataacgctaaatgagaaagaagaatacagatatagccggatggtagtggcatgcctgtaatcccagctactcgggaggctgaggagaagaatcgcttgatcctgggaggcagagggtgcagtgagccgagatcatgccactgcagtccagtctgggaggcagagtgagatgctgtctcaaaaaaaaaaaaaaagaaaagaatgcagctataattatgtgtgtgtatatgtacatatgtaagtaaagaggtataaggaaaaagaatagaaaagaaaaatgaaaaatataattttatattttatttttatatatatttttaagcttataagtttgcagattgcatattaagtggttttttcctccttaaattttctttttaagtcaaaactagttaaagggggagaccttggaagtttgtctacattattttttaaggttttttttctttgattaagtagagcaagtccttttaaaaatattgtaacatttctaattaagatttaagataatttcaaaatggggagcagttgactgtaccaaatgtaagctagtttcttaggtatattgattaacttttatttatatattttacttatttaggttttagcatcttcttcagcaaatgaatgcatttcggttaaaggaagaatttattccatattaaagcagataggaagtggaggttcaagcaaggtaagtatcttaaaatatttacgaaataaataaaaatattttaaactttctgtttttttgtctttttacctgtgagggctgcttttcctttacttctaggggcgatgctgcccttgagccaaaaagccatcttaacacctgcctttctcttcccgctgcccctcacatgtgacatatcctctttagatctcttattcccagtcttctgcctttcctttcaatgtcctgtgcttctaaacttcttctttaataacaaaaacattgacatggggtagcgaatgaccactatgtattatcacaaaagaatcagaaatttctgagtcagaatgtgatgtaaattgctaatatgtttagaatcattcagcaaggatttttactaatggattttgttttcttttgagttattcatttcagaaacagaattcagtaacaaatgaatttctggaattagattattttctaaatttacctgagttctaaatttatatcgttttacatctctggatagaaggcatcttaagcattatctaaatttaccatcattaattgtcattcaattaaatctacttccattagatttttgccttcatcactcaccagaataactgtaatcaagaacactaatgacctccatttttttgccaaatctaattcttagcttagattttggattacttagcatttgggacaactgattttttttttcgcagtgaagcttttttccgcacttggtttgtgtttttctcttctcaaactgtccatacctattgtcttcttcgtgttactgatctcagtgaagcactgctccgggcttagtcctcagcattctttcatctttttcttaaactcattcattggtgttctctttcaatcttgtggtttcaaataacatgtgtatgctgacaattcccaaacttgtatttccagctcatacctctcctttgaattccagacttgtatattcaacatcgcttcttagtgtctaccaggcatttaaaacaatatgtccaaacacaactcttgctccatagcttttcccatttgagtaaatggcagcttcattcttccagttgattgaacaaaaaattggtgcctcttactctcatacacatatctagccaatcagcagatcttgttagttctacttcaaagtatctctagaatctatttctcacatctccagcattattattttggtcaaggcaacttttgtattttcacctaaattactttaatagcctcctaaaggaattcatttactcagtccttgccctcctggtctatttttttaaattgtatattgacaaattagagttgtatatttttatggggtacaaagtggtattagctttttaaatacaatatgaaatgattaagctaattaacatctattacctcaattatttgtgtgtaatgagaacattagcaattgactctctgcaatattgaaatgtataatatccaattattattttcagcatgctatgctaatcatctaaaaaaaatcaaacttgtttctcctatttgaggctttgtatcccttcaccaacatctccccatttctctcaacctccagcctttggtaaccaccattgtcaaaggtagtatgagctctgctctatgagtttaatttttagatttcgcatataagtgagaacatgaggtatttgtctttctgtatttagcctatttcagttcctcctggcttattttaacatgacatcctattttcctctagatatcctcatgtgtcttctcagttaggccttccttgcccacactgtaaaacttcaactcccacctttcaatcaccagtgttctccattccccaccggtttgtttttctctgtatcttaccttctaacatgttctgtaatttacttatttggtttgttgtttgtgtccctctgcacttgaatgtgagctccatgaagatagggatgtttttctgatttgctcagtgatattagcccctgcatccagaacagtacctagaacagatagggattgaatttattagttgaattgagtaaactgtctgtcctcagctcttttgctattgtaagttgttaaggatgacacattaaacagacattgttggactcattttaagttttactgtaatttcctaatcccactaacaataattagaattgcataaggctgtcttattaacttaccaaaaataaggtatgtgcattaccatgtgtatcaactcttcaataaatattggtttcattatacatttccttttatcaatctatttgaattacctaatttaattgctttcgtagaaattacttggttaatatttattatttatttgttttttggctatattttagtagtatcaaggtattgagacttaatagaggtatttatttacttgtatgttttcagagaatgtagagtagtcttaatggcattttaacatttttttccttggagtataatgaaggtgtaagcttacttaagtcaagggccaagtgataaagcaatggctggcccatattttctgaattcaattaaattatcatttaagttaattatgatagagttgaaaaaaatcaaatgcctcaaagaaagtaacatgctttatgaaactaataccatttatgctttgcctgtttcagagtttaggcagtgaccaacttttaaggaggctattgagagtatctagaacagtcatggggtaatgagaatggtcaagacactggtaacttcccataaaactaacaaatcacaactctgacactatctctatgaaactgaaataaggcttacctaaaccggattgcaagagttttgccagaacagagacagtgggggcaataataaactcattcatgcaaaaattgctaaatctaggcacaatagagaaaacaacatctgtgaattgaattgactctgtatcatagcctttagtcatccttaacttttttatttttccttgagaccgtgtctcactattttgccgaggctggactcaaactgctgggctcaagcaattgtcccacctcagccttctgagtagttgggattaaaggagcaaactactgcaccaggcttgtccttaacattttggaaagtctttttctttatgctgtttccctgtttagggcatccaacagattgttatatatatctgaagtttaaacttttcttacatgttgatatagaaactttagatttatacctttaaattattgaatgcccatcatcataggtcattgggaatggactgttactctgctatcagaattatttttcttccttctacactcaaaataggcccagaaacttttaatgttcatgtcagtatttcctttagaattttctcaacctaaaatcctaataaatttagaatcattgtgtgatagtgtataaatagtatattctaaacttctctttgttctactctgtaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattagtaagaattctttttaaatttaaaaagaaaactttttgccataattcttcaggtaaatatttagtaaactttaatataacctagccatttattgttttgttgcttttatttgtttaattgcagtgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggtatttaacagtttttttatatttgtaaggttaaaatctttgttaatagtgtcatcttagagaaatatacctataattttagggcattggttattggtgtctttaacgagatcaactaaataattagaagtttatttaaagataaaggaacaaaaccatttcttaaaacaccgttaacccaaaggatataggacatcaactcaagttccgacatctgtaatacaaaatgtatttttctcagtattaacgtagtctgtcatccttatctccaaatacttggattatagcaggtctaagactttggggttcaggcatcctgaaaatatgagatgtttactttattcattctcctaatcattttgtattgtatgccctgtgtgagaagttggtttttttgtttgttttttactgttaggcctaccttctgggttggtttttacttgtccttggttctttttagggtttttctctgcctttaccttatcctatatatttttttgttcttaataactgttatcctagttaattgtaatttatctcctcctcatctctctctcttaaattatcttaaaagataattcaccagtgatcaagatcagggctataggggtggagatgtcaggagcattagggtcttactgtctggcagtataatttgtgatgctctctagtgggcagtgaatcacagtggttaagaggatagattctgaagccagactgtctggcttcaattctaactgtcacttaggctgtgtgaccttgtacaagttacttaaactctcattgccttagcttccttgccttatagtggggatgatgataatacttcagcattgatgtgaagattaaatgatgcagtactgtataaacaatgaacttagaacagtgcctggcacataacaagtgctatgtaaatatttgcagaatatataaaaaaattattgaattgggttcactaattgaaggaataaatacagcttgacctgtagactgtgaattttttggtccttagaatgttttgcattgtttaatattacagtggatttttattttaaaggcattgttcacagtgatcttaaaccagctaactttctgatagttgatggaatgctaaagctaattgattttgggattgcaaaccaaatgcaaccagatacaacaagtgttgttaaagattctcaggtaagacttaatgttggttctctcacagtagagttcaattctttttttacctgtgaagtattatattgcaaatgagtgttatatttttaatcacctcattcttcaaaggatttgaagtcttttaataagaatagatttaaaaatataaaccatgatcattgtaatgtagaatagaaagtcaagatcaaatagtaatatctccagcaattgtgaatggttttcctatagctgaagtagagaaacagtaataccttccttggaaatcacttggtcgtgatcaaaaattgacctgaaaatttggctcagagtttccttgtagcaaagagggagttgcagttatatgtttttcactgtctatgaggtaagatcatttttattcttctagagaagccgaccttttcctatcactgaaattggaaaaaaaattcttaagtgggccttcatattgtaaatgccataagtattataagcaacatttttataatagatattgcaacagcaaactaaaagacgttgttctataaaaactaaagcaatggcaccaaagtatatctaaaagatattcttgcttggaaccaagatgatatgttccatgtttacagatttttgatgtgagtccaccttaatcccaggagtaaaatagactttgttaggaggaatgatggacgacatgccctatttgacagtcatgtctctttgtatcaaaagtatggcagatcaatgagttgtaaatcagcttgacaatatcttccatgtcaaggccctaaagtagatatattctgtgtttaaagcaaaccatgtattttagaagaaaatgagctcattgtaaggttggcatatcctactgtagaaactcagaggactactgtgagacaaagctagatggtatttttgtttgtatattggtgggcttatttaaaaaatatatttttttaaagttgagtatgttacaacaagaaacgaatggtaagtccctcaatggcctcaaagtttatggccattaataggattttagcctggagagtttttagggcaggctttactagttgcccagtataatcatagaaaaagcacagcattctgaaaggagtcactttgctgattatgaacccaactcgttttgctgcagttgtgaagaaatttgatatatatatcttaacgttgtcagcagttatttgaaatttgcaaggatatcattgaaatttataattacccaagtttccaaggatctggcatttgtatttttaagaatctaaaacttaaagtataataataataataataataataataataatctcaaaaaaaaatctaaagcagaattaaatattttcattgatttgtgttttctctgacttggcatataggttggcacagttaattatatgccaccagaagcaatcaaagatatgtcttcctccagagagaatgggaaatctaagtcaaaggtactgaaaagattatttacatcacaattatctggcaacagtagggaatgcactattttctgaataaacttaccagataacaatttctttaagttctaaaactttttaggccattacagagacattgctggtttttttcgtttccaattcttactatttttcaccacttattcgtttgtgaattctacatttccaagtacagctggagaatgtaattgttttctggcctgccactggctacttttccactgactttatctcgctacctcgatgagtttgcgttagcctcatgggtgccctttgtccggggctccttttgcctaccttgatgccttgggctcccaggctaacccttctttctctacatcagtgtaaccaagtgggtgcaagcacacattgtcccagggacctgtattcattcaagtcatagatctgcctcttcattaacaactgtctttggccaagtgacttgcctagtttccctgtctctaaattgtgcctatagacagtgcctattgtaaaataaattgaggattaaatgggaaagaatatataaagtacttagtacatttatccagctcagaatcattgcttgataaatgtgtttttatttactaaattttattttcctccttagaaaatctggcttgtaagtgtttttcaaataactggcatacaattttgccaaatgttttcataaaattctttttatatttgtttagcctccactcttctaaaacttaaatttcttgtgtttttattagactttctgtggttttgttcttcttaaataagcagttcctgacttcatttatcaactctattttcatttgctttacaacttgagtacttgtgataaccagaaacttttctctatgattaaccatatttatggtttatcatttaatgcccatgacaatgtacttttataatttctatatcagagttgagaaaacagacacatagcattaccagttagtaacacatcttcaagatatgttaaaggtaatattaatttcatataactaattatttacttgaaatagctgaaatgattggaattgtgtaattggcttagatataactattctatttaaaagaattgctaactgaattagttttttactttgaagatgttttaaagcttgtaaatacttgaggattttggacacaagctccgcatagttctatagtatatgtgcttgggtttaaagttgtattgcttatttattatttccaatggtcttgtctgaagggttgcataatttaagcaacctttgaaactgtatacatactttgtacttatataaaaatttattataatccagtaattctggggaaaacaaacttaaaacttacattttttaattttatattttcacaagttgggaagaatttaatattttgtcttaattgcaatattttaattatgaggttatagaaagatttaaagtaaagctcatatcttctgatggaataaccaactgaaatgaaaactagaaaaagatgttttgtcatgttaacataatgtagtacacattcattgagatttaattatgattttaaatatgtatatttaatatatatgttttttcattttatatgaaaataacagcaacttttttgtgtttgtttgtttttttcttagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaaggtaatattaatttcatgtaactaattatttacttaaaagaaatagttgaaataattggaattatgtaactggcttagatataactgttctattcaaaagaattgctaactgaattagtttttttactttgaagatgttttaaagcttgtaaatacttggggattttgcaaaagtgccttgggagaaataatcttgtcataatactttagtgggatatctaaaaagtaacttttataatataatgtaatctggaaaaatactttatcaatatcatatatgaaaacctgctttgtttttcttttaaaatatctttgttttaatagtgttgtttaaaaagggacccaaaacagaggatatccattcctgagctcctggctcatccatatgttcaaattcaaactcatccaggtactacttctttaaaaatttgtttattactagattggtagtataaacagtctgttacctattaatataacaaagacagaatctaaattggctaccctttgtcagcctgcctttttccttaaggaagttccattattataaatagtaaagtaaataaacttttttttctttacttctggtatttatttttacttattccagataacgggttataatcagtgataaattataagaatatcactttgtgctattaaacaaaatgtgtatttacaatggacttatatttttcttactggtactagtgtattattgatttattttatagttaaccaaatggccaagggaaccactgaagaaatgaaatatgttctgggccaacttgttggtctgaattctcctaactccattttgaaagctgctaaagtaagtatgtctattctttacattaatttttactgttttatatagtgaattcgacacttaaggaaacaggtagtctgaagaaaagttggtccaatcatcagatcagttatgaaacatgtttctacatttagatacttaacatgtgcattttgacaaatatcgatttacttgatttatattcttcttctgcatacagtacagttcaaagtagatcatcacataaggtgcattcaaaagattgctgtcacgtctcaactggaatacatttaatataggaatatagtgtgtcttttaattcagcaccattattaatacagcttttgaattcattccttttagccagttttttccttagagacattacatgtaatggcttttttgaagctgtacacagcaatcaacacaattctcaaagcacaagtctcaagctttttagcttcccaatgtccatttatatctataccatgatttttcaaacacctagttatttctagaaccctgtgaatgcttattgaccaactgatttagccaacaagcagttactaattatgtatttcagttacaacattatcataaaattatgggaacctaaactatcaatactcgtagctctctggatacatataaaatccatctaagttgccaagaacttgaatacattttttgaaggaatttactatatattcactatatttgcatttatatgatatgaggtacctgttttcttaaattttctcaaatgctaatggctaaatcaatggatttagtaattaaaagtggaccaaatttgttttgtaattgctctgtattttgtatctccatgttttaagtttatactaatatattattcaaagcctcttatagctatagttgaggtggattatttttataactgaagttgtatgttccttgagggcaaagatgtctgccatcttcataagttagatgttagctgagtcttaaatcatttttaaatacatggattttaatatatatctaattattatatttatataatttgtaatgtcttctatttattagcttattatcatctgagaatataaagtttcctaataaatatattttgtataggaatttacctaagactggctttatttaagaaaaagtaaagagataaagaaggccttgaaggctcatatgtatgtttattagtagctctgttatatttctctcatagaaagattgagttatatctcatgataggtaatgcttaaggccaagcttcgtgtttaaaattctttattatctctaatagtttataaaataatttcccaactgtaagaacaagagagaaataaatgtattatatttagaatacatcaaaatacatctactgatgtgacagtacatttaactaaaaaattgcaaaacagatttgtgttttttaatttcagactttatatgaacactatagtggtggtgaaagtcataattcttcatcctccaagacttttgaaaaaaaaaggggaaaaaaatgatttgcagttattcgtaatgtcagataccacctataaaatatattggactgttatactcttgaatccctgtggaaatctacatttgaagacaacatcactctgaagtgttatcagcaaaaaaaattcagtagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatgacactaacattt

SEQ ID NO: 468 - DNA, 180088 bp, Homo sapiens
attgttagagacctgtcattgatagcagttgctagttgctgccttttaagagctcgttgattcctctgcaaggtggtgcagcatcctctgtcccttcattcatttcagatctactcaggtctccctgtaaacagatctctcggatcaataagcatgaatgacgaagactacagcaccatctatgacacaatccaaaatgagaggacgtatgaggttccagaccagccagaagaaaatgaaagtccccattatgatgatgtccatgagtacttaaggccagaaaatgatttatatgccactcagctgaatacccatgagtatgattttgtgtcagtctataccattaagggtgaagagaccagcttggcctctgtccagtcagaagacagaggctacctcctgcctgatgagatatactctgaactccaggaggctcatccaggtgagccccaggaggacaggggcatctcaatggaagggttatattcatcaacccaggaccagcaactctgcgcagcagaactccaggagaatgggagtgtgatgaaggaagatctgccttctccttcaagcttcaccattcagcacagtaaggccttctctaccaccaagtattcctgctattctgatgctgaaggtttggaagaaaaggagggagctcacatgaaccctgagatttacctctttgtgaaggtaaggtctgcctctgacaggcataccctgttcatgcagatattatggctggtgttttattttgctctgaatgaccagggaaagattcataatgccatggtccttggatctcaatacatattcaggagtcggagggactaaatcagtcattagagtgtactcagctcttcacaaaattagaggaattggaaggtgcatttaaagcacgtatttaatcactgacttttacataccatgggcaaagtatttttcaaaacggttcacataagtgagccataactgctgcccaaatccttgccattgtggctgacattaagtacatttttctgtctggttaaatttcctttgtcaacatgtttaaaagtgaaaccaaagcttgtgaaagaaagaccttcttgtgcttctaaggtcacagatttgtcagataggtggtcaataaaggctatctctgtcactagcttgcccctttggcaccaatataactaaaaatttgatgaagtcaaatgatttcagtagtagtaagacactaccagtgttaatgtttaatgcttacgatatctaaacagaaccttggtgatctttgtattagatgataaagtaataaagttatggttataaatattatcaaaatgtaaagtgtttcagacctaaacaaatcatctttattaatcaagatggcaggccctttttccccaacatctcccccacaatattcatatttatgtgatttttagaaatgttttcacatttattatataaatatatttgtaaatgctgctctttcctgccaataaaaatgattataaacctacagaaaccatagttcatactcatttctctcttccccagttcccagtaacatttctgatgaaacacactttactaattttgccctttgttgtcttgtaatttgttcttttctctaattgttttgtgtgtaaatcatggatcacttattctactacaaggtccttttaaaaataatctagtatagtgcttggttcacacatacataccagacacacattgccttgtactctgctgagcatttggggggaaagggctgtgcaagacaaggcccttgctcttaagtaatgaataatatggtgacagagacagacttgcactcaatgtattctaatacaatatagtaagagatgaaacagaggagtgggtggagtgtgtgggtgttcagagaaggagtgctgagatgtgtactgagtttggagcagctccacggaggaggtgatgttagaacaggtgcattcacgcagttttctgacctccatatccacatcatcactgtcacactgtgcaaacaaacttttttttttttcttttttgagacagagtctcactgtgtcacccaggctggagtgcaatggcatgatctcagctcactgcaactttcacctcccagattcaaatgattctcctgcttcagcctcccgagtagctgggattacaggcatgtgccacctggtctggctaatttttgaatttttagtagagatggggttttgccatgttggccaggctggtctcaaactcctaacctcaagtgatccacccgcctcaacctcccagagtgctgggattacagacgtgagccacagctcctggccacagacttttttaaagtgaggactagatgtattttttttttctcatggcagaagcatccatgcaacctgtgacaggcaaagtgggtcatcaccatgatcatcatcatggacccatctgacattatttctaaatttggctaagtgtttatctcactagaaattagcctatggctggtattgagcaaaaacagaagtagtaggaaaaagaagtgttggtacttcctggcagtaccagcaacagggaaaattgattgactataacatgtaattcctaaattacttaaaatttcctaaagcaaatattagatttaactctttaagtttacattctttttagcataattgtgtgaactgaaaggccatagagtgtcccactgacctcagcttctatgcataaactcctttttaaggatattcagtaataaaaagagcggcagttataatccctgcttcctagctccacactcggccctatcttcactgaagttccttacccaatgttgaatggaagtagaatatataaaatcgagtaaaacagggccttctctgcttgagtgaaactgtagggtgtgagtgtgacctctcaggccttttcctcttccctgctctgtggaagggatgttggtcccccacactggagggagctctgtggctcactgtcttcctagtagggcttacggcttttcagttctggatgttcttctcctgggctgttttagtgtggaccactgggctgcattgatacttgtattcatttgtgtatgttttcacctgttctagacatgttggtgagaatgtcatgcaggtttgtaagtatatgtttaaccaacattttattgaggcttaatcatttcagagtgttgaccaattatttaattaagtaacatatgtcattcatttattcattcaacagatcttatgtcaggtgctgggtttacaccaatgaagaaaaaaaaagtctcgtctcccatgcacttttttttttttgggacggagtttcactctgccacccaggctggagggcagctcactgcaacctctgcctcccgagtagcttagattacaggcatgcgccaccatgcccaggtaatttttgtatttttagtagagacgggttttcactatgttgttcaggatggtctcgatttcttgacttcagtgatccacccacctcggcctcccaaagttctgggattacaggcatgagccaccgcgcccagccatgtctcccaggcactttgcattgtagtgggagagacaactgataaacaaataaacaaataaatataaaatagggctaatggtgaaaatgctataaaacaggatatgggtgtattaatttcttatttctgctctaacaaattacctaaaacttagtggattaaaagaatacaaatattctcttacagttctgggggtcagaagtctgaaatgagtcttatggggctaaactcaaggtgtcagcagagctgttttccttctggaggctctggggagaatttgtttctttctcttttccatcttctagaagcagatctcattcctcgcgcatggcccacatcacatcacctcttctcgccctgtttccatcatcccattgccttcttccgactctccttgcatttctcttgtaaggaactttgcgattagattggacccacaaggataatccgggataatctcctcattttaaaattcttagttgaatcacatttgcaagtccgtttgtcacataaagtaatctgcagcttctgggaattcggacatggccatatttggcggatggagagtgacggtaagtaggcgcgaggcagtagtgtggctgcagtgggtgagccagggaggcaaggtggtaggagatgaggctggagaggtgcagaggcacagaccatgatcacagcagtccttaggggccactaggggaacctcactcactctgagtgacagcgggaggcattgggcgattttggaaggaacagtatggccacctttttataacaggctgtagctgggacgggtagacacagtaacagggaaaaacagtttagaggcaactgacaaacttcaggcaagagatgagggtgcgttactgtgacagcagtggagcattgggattgttttgaagggaaagcccaagcattttgctgaagaatttgatgtgggtgaaaagaaaaataaagagccatggttgactctagagattatagtgagctatggaccccttctcagaaaatgtgcgaatgagaaagctgatattcgctaatgtgtctgtatgtatgtatgttaaagagaggggatgggtggtgagagagatggagagagaaaaaagcattctagtattttgtttaatgcaaaggaagaaagtattctgataatggttattgcaaaagaaaatggtacaaataaacaccatttgtcctatacataatttatgtcatttattatggaagcggaatatgtcttagagcaggtttttgttttcgtttttgtcttgagacagggtctcactctgttgcccaagctggagggcaatggtgcaaacacagctcattgcagcctcaatctcctgggctcaagccattctcccgcctcagcctctagaatagctgggaccacaggtgtgcaccaccatacccatctaattaaattttttgtttgtttgtttgtttgtttgtagagacagggtcttgccccgttgccagggctgttcttaaactcctgggctcaagtgattctcccacctcagcctcccaaaatgctaggattacaagcagaagccactgtgcccagcccctagagcaggttttgaagtctggttgcatggatttgaaacctactttagcagattaatttctgttaaattattgagcttctctcagcctcaatttcctcattgataaaatggacattatgataccttcctcatagggttattataaagattaaataagataatgcttataagttgcttaatatagtatctgacatatggtaaatgtcaatatataggagcctaaattattacttattgtgataaattggaaccattcaggaaatgacgttttattttaagcatagtgctttgcagcaagcattcagtaaatatcctactgggtttttcaaacatgagcaatacaatattgtggaaagagcagtggtcagggaattctaacacaactttgtcaatacttttgcataaaatgtccctggacccaaatttcttcatccttgaaaggaatctttcctagatcttacagtcttagattccaaggtgtatggctccaactcctggtcagtgtgtacatgtgtatatggcaccacctattatccactctaagatactgctcaacactgactatggtttctagatttggctgtggttggaaaagttgacataagaacaacactcctgtccacactcagctcacgtgaagcctgtcccttggaaagtatctgcagcttcagagcctatctctgatagaacacttatagggccctcatgcggggatgcacaggttgtgcactgaacaagtttagggggcactattcacagaaaatgtaaatgtcctgttgaagtcaggcaacagaacaacactggttaatactttttagactcatagcccataattattctaaaggaattattcactataatttggctcagcatagtaaagtgctccagaattgtcgtaattactattattgccatagcagaggtgcctgatgtggttataggggtcatggtattcaaaatggggcactcaacataatccatgtggtgttagaatactataattagaatgaaaaataataagcaacatttctattgaacttttatctaaccaccttaaatgttaatattttatatattttacaatgagcacagtgtactcttacagtagtatatacatatataatttgtaagtgagtaaatatacatatattgtgggtaaatgttttatattgatagggatatgcaattttaaaaaaacattactgatttgtaggctttccttccttttctgctatgatctgtgggcctggacctctttccttggccaagagctgatgagaacagatccccttacttcctaggttcttcctggatgctttcataagcaacacatttagtgcatttaccttggaggcaaacaaagttttatcattgcaggtgagaaacttataaaatccccttgaggaaatgagataaatgaagctggattgggatgttgagatgtggctcaaaggacgtcccaggcagtgggctcagcagaagcagagtcacagccaacactcacatgtgtatggcaaggtccatttggttgagtgggtcagaaggcccacataggtgaagagcagatgacgaagttgaataactaagagtgctgcctttcactgcaaactaaggggcttggatcttatcctgagagcaaccaagagtaatagaatgttctgaggaggataccatgagcaaaacaatgtttaggacagcaagcaaattaaaaagaatttccacctaccagctagaacagaaccaaacagacatcatgctttgtttcaaagattagttcaagtatttagatataaatatatcatatatcattaacactgtatctcttcaactgatcatctggatgtgtccacgtatttaaatctgtggcttcatataaaccaattttcgtggaaaaagctagctggtgtgatgctgatttatatattatctatctgtgtatccagctactttatattttgtgagggtaagggggagatatatggattcagcacaaggttttgattgttattttagtatagtttccagtttaaaaagtgtgtttgcatggggtgagatagcctggctggactcacttaattagagtgctgggaacacaatcaaggcccagttttattcaaaattattttctaggtgcccatatgaactggtttgctttgtgaatcaatgccattaatcaaagactctcagaatcttagcactgtgccaagaatgtggaaagtcagaggagtgaaccaaccttcctaaggctgcctgcaaatcactggcaagctagtacattgggctgtccatccaggggatttttctttatatcggcattcctagcctgggaatatattcatatgttcatgaatatgcttcagaaggttgaggaacattctagaaccctatgcaaaaatatttgtgccagatgatttcaggagggtccatgaactctcagaaatgttaactatcactgtgatgctttccactttccctgcctgggtactcacaccttgtgtgcccatgtgggaggggtagaataagctatggggtgaaacaaatccttttctaagccttttagcacctttaggaaccatgggaagaaaccttcatgaaagaataataaagaagcatcaccaaataatcatgtgagagttatgttaactctgaaaatgaaagtgatgtgatactctgaaatacatatccccaaattagggcccatatttttttctaaagaatgttttgcaatttttcccccaagagactacaaactcaatgtcaatgcatgcactactaatcccatcatcctggacagcatcactaattgtacaaactaaaacttctgaataacttggatttgcatttctcctttactttcaatagtgcaatcgatttcacctctgaaaatattctctcctcttcatcttggccactactgatcagtgtcatcttgaccacagctgtttaactggtcactctgcctctagagtcatccatctccctaggatcccccctccccccacctagccacaggaatgatccacatgtgtttctttttttttttttttcttttaagttcaggggtacattagcagatttgttatataggtaaatttgtgttatgggggtttgttgtacagattatttcatcactcaggtattaagcctattcccattagttattttccctgatcctctccctcctcccaccctctaccctccgataggccccagtgtgtgttgttcccctctatttgtctgtgtgttctcatcatttagctcccacttatgggtgagagcatgcggtgtttggttttctgttcctgcattagtttgctaaggataatggcctccagctctacccatgttcctgcaaagaacatgatctcgttcttttatggttgcatagtattccatggtatatatgtaccacattttctttatccagtctaccatttataggcattcaggttgattccatgtctttgctattgcgaatagtgctgcaaagaacttatgcatccatgtgtctttatgatagaacaatttatattcctttaggtatatacccagtaatgagattgctgggtagaagggtcattctgtttttaggtctctgaggaatcaccaccacactgctttccacaaaggctgaactaacttacactctaatcaacagtgtataagtggtcattaatctctgcaactttgccagcacctgttattttttgactttttaataatagccattctgactggtatgagatggtatttcattatgattttgatttgtatttctctaataattagcgataagctttttttcatatggttgttggccccatgtatgtcttcttttgaaaagtattcatgtcctttgcccactttttaatgggattgtttttttcttgtaaatttgttaaatttatatgaaaaaaaatttaagttccttttagatgctggatattacatctttgtcagatacatagcttgcaaaatttttctcctgttctgtaggttgtttactctgttgatagtttcttttgctgttcagaagctctttagtttaattagatcccatttgtgaatttttgcttttgtttcaactgattttggcatctttgtcatgaaatctttgcctgtttctatgcccagaatggtattgcttaggttgtcttccaaggtttttatagttctgggctttacatttaaatctttaatctatcttgagttgatttttgtatatgaaataaagaaggggtccagtttcaatcttctgcatatggctagacagttatcccagcacaatttattgaatagggagtcctctccccattgcttgtttttgtcagctttgtcgaagatctgatggttataggtgtgcggccgtattttggggctgtctattctgttccattggtgaatgtgtctgtttttgtatcaataccatgctgtttgggttactgtagccttgtgtatattttgaagttgggtagcatgatgcctccagctttgttctttttgcttagggttgccttggctatttgggttcttttttggcttcatatgaatttttaaatagttctttttttttagttctgtgtagaatgtcactggtagtttgataggaatagcattgaatctataaattgctttgggcaatatggccattttaatgatattgattctccttgtacacaagcatggaatgtttttccatttgtttgtgtcctctctgatttctttgagtagtgttttataattctcattgtaaagatttttcacctgtctggttagctgtattcctaggtattttattcttttgtggcaatcataaatgggattgcattcctgatttggctctcagcttgactgttgttggtgtataggaatactagtgatttttgtacattgattttatatcctgaaacttcactgaagttgcttactagcttaaggagcttttgggccaagactatggggttttctagatataaaatcatgtcatctacaaacagggatagtttgactttctctgtacctatttggatgccttttatttctttctcttacctgattgttctggcaagaacttccaatactatgttgaataggagtggtgagagagggccttcttgtcttgtgctggttttcaaaaggtatagttccagcttttgttcattcagtatgatgttggatcttgccttgtcacagatggctcttattattttgaggcatgttcctttgatacctagtttattgagagcttttaacatgaagggatgttgaattttatcagaaagccttttctgcatctattgagttaatcacgtttttttgtctttagttctgtgtatgtgatgagtcacatttattgatttgcatatgttgaaccaaccttgcatcccagggataaagcttacttgatcatggtggataagctttttgatgtgctgctgaattcagtttgccagtattttgtggaagatttttgcattaatgttcatcatagatattggcctgaagttttctttttttgctgtatctctgccaggttttgctattaggatgatgttggcctcatagaatgagttagggaggagtccttcctcttccattttttggaagttttagtaggaatggtaccagctcttctttgtacatctggtaggattcagctgtgaatctttctggtcatgggcttttttttctttttttgtttttttggcaggctatttattaccgattcaattttggaacgcattattggtctgttcagggattcagtttcttcctggttcagtcttgggagggtgtatgtgtccaggaatttatcaattttcttctagattttctcatttgtgtgcataggggtgttcatcgtattctctgatagttatttgtattcctgtggagtcagtgataatatcccttttgttgtttctaattgtgtttatttggatcttctctctttcacatgtgcttctttagagcacatcagaccatgccattcccctgattttagttatgcagtagctccctattgctccaggaaaaaggccaggatggagcgaatgcataaaagtttttcatgatactcagacttttagctaagacttcattacttgtcactcctcattcaccctgtgtcttaaaaacattcactagcctgtacttccctgcacacttcatggttctgggcctttgctccagttgccctctttcaatgcttttccttcctgtcctttcaaatgcagcctagaagtcaccttttcaggagggctttcctcgtccctccctaaaaggctgggctgtgttggctctgcactccttcattgttcttaccttaatgtattagtttgccaggacttctgcaataaagtatctcaaactgggtggcttaaacaacagaactttactttctcacaatactggaggctagaagagcaagatcaaggtgttggcagggttggtttcttctgagtcatctctccaaggcttgtagatcaccatcttctttctctctgtgtcttcacatggtcttccccctgtgcatgtttgtgtcctaatcttctcttcttataagaacaccagtcattttggattagggctcaccctaatgacctcattttaacttaatcacctctttaaagaccctatcttaaatgcagccacattccaagggtttaggatttcaacatacaaacttggggggtatgtatacaattcgggccataacattaaatgctatgattacttgtttatatctttatatctccctagctgtgaactcctgaaggaagatctgcctccattctcatatacttggtccattggcatacttaaaatgatggttgaatgaaggaaggagggaggaaataagttacccccaggaatctccagggtaatgagggaggaggaagccttgggccagtggctggcagcagtagtaagagtggtagtccaagccctctgtatcagctttgtagggttgctgtaacaaattactgaaaacatggtgttttaaaacaacagaaacttattctcttacagttattgaggccagagtctaaagatagggtattgtcagggccacactccttctgaaggctctaggggagagttctttcttgtactttttagcttctgttggcttctggcaatctttggcttgtggttgcatcacgccagtctctgcctccttcatcacatggccttctccctggtgttcctgtatctgtttccccttatcttctctgataaacacttgggattggatatagggccaccttaactcaggatgatttcatctcaagatccttagcttaaattatatctacaaatacgctttttccaaataaggtcatattttcaggttccaggtggacataacttttttaaggccactcttcaacccactactgtctgaaggaagaatgagttggattgaatgggaacccccagacatgggcagccagttccagaatccatatttcccccttgatgcaagggactatgtaagaatttagtggactgtttgtatcttcatctctttagttctcaggcactcattagaatgcctggcacattcctagcatcatcctgaagttggacagaaagccagtacgctgagtgcttatttgatcttttgagctctaaagggacattggagtcaaagggcttgaggatttgcacagcaactggggttagacactgcaaggagcagcctgtggaagccatgtggctagaactaattcagtgcatccttgttcctgggcctgcctttgtatttctgcattaatatgatttactgaacactgttttgtcaacagacacagaagccaaactagacgtggtgatcaggagaaaaggttcagtgtcaaccctgcgggagagaatatcagctggccaggatgtggcttccaatcagaatatcaagggggagatagtgttagactagtcggtgggggtcattttttgaactcccattttttaaagggcaatttaccagactatcagctccttggggaacgaatcttgtttcttatctcggtagctccgtgtcctgtgggggcactgagcttgttgtagtggggactcggtaaatttggtcaaagtgaactaaacagttatccctgagaccctcagctagccttcattcaaccagtggagtaaagaccatcccttggaacgaaattgcaaattggatactcaattcccctgctgtaaaccttccctattgccaacatgatcaagttcacctttgagcgtcccattacaaagcctttgcatgttctgcccctagcaacctaatggcttctctaattccatctcccaccatgctctacctcactcaccgtgtcccaggagtactgagctctccacaaataggatgctgttctgctccatccagctttgcccatgctgatacctctgcctacaacaccttctcctctccttcatctggttaaatcctcatctttctgaactcattttccctgggaagcagtttctgaaccttcagatcattctaggtattctccctcagtgcctgccttcattttagcacctcttacctcattttaaaattatctggttaagtgtgtatctcccccagtctattacaagactgaaagctccacaaggaaagcactttccagctacatcttattcaaccatgtaccccccacagttagcacaaagtctggtccatagtcagggctcataaatatgtgttgatttaaaccaaattggttatggggggcgggggatagttcagtttgcttttggaaggaaagcttcttggtgtgttctgggaaatttggtcagtattcaagcaaagatccttgagtacctgcagctattgatatttgactttagggtagagtggggtctatggcaagtcctggtgacaaaccagctagtcagggagaaaacagagaaggaaaattcatactcaggcatcctgtgattttgtaaatgggaaaaaggggatatagtgagtaaaaaatagaggtgctcccacatagaaacaggattttgacaagtcctgttgagcagcagcaggttttggaacccagctgacattgccccctgcccccgctttgaataggttgattgtttgcctggttctaagtttgaaaagtacaaaagatagagttgcttcccaaccatactccttcagacacctcatttccattttcagaggcagtcccttctacacatttcattaatatgccccttgagacattttatgtgcattccagcaaatatgtgtacaagttcgtatatttggaattctctccttttttaattttatttgacacaaatgcattataccatatgccctagtatgtatgttgctttatggggccaacagtattgggatataatttacatacattaaaagtccacaattttaagtgtgcatttgagggagttttgacaaatgtatacagtcatctaaccatcaccataatcatgatgtggcacattcccatcacctcaaaaggctctgtcttacctcctttgctgtgagtcccttcccagacacctcctgcctcctagaaggatctttctattattacagtttttgcttttaaaacatattgtataaataggcttaaactctgtgtaatcttttgtgtgtggtttctttcataatgcttttgaactcaccatgttggtacgtaaatcagcagttggtccctttttattactgagttgtattccattgtgtgaatgtattgtgctacaactttttatgcattcagcagttgagggcacttggattcttttccagtttttggctgttaaaaatgaggctgctataaagatttatgtgtaagcttttgtgttgattatgttttatatttcatttgggtaaatatttagaagtggaactatttagttatatggttagtgaatgtttaaccttttttttaaaaaaaaaaaaaaaccttgaaaattgttttcaaagtggctgtcaaaatttgtatgagatttctagctactgcctttccaggattcagcattgccagttttttaagtttgaagcatactgataaatatatcacggcatttcactaaattgtagctttaatttttatttttctagtgactaattaggctgagcatcttttcatgtacttattagtcatccttctgtcttctttggtgaagcacctattcaaatattttgcttattattttagcatttgatcttattactattaaattttaaaacctctttatatagtcaagacaatttctttatacatgttttgcaaatagtttataagtatggcctgacttttcattttcatgacagtgtcttttgaagagcagatcttttttgtttcggtgaaacccatttatcaattctttaatgctatggtttgtgttttttgtgtgctatctaggaaatgtttgtctaacccaaggtcacaaagattttttgttttcttccagaacttttatagatctggttctatcatccacttcaagtttattttgtatatggtacaacatatggatttattttcttccctttcctccctcccttcttctcttccttcattccctttaatgtcaaatacatcgattaattttcaaatgttaaacaaatcttgcatttttgggctaaaccccacttagtaatgatttattattattttatagacttctaaatttgacttgctacaattttgttgttgaatttacaacaatgttgttgatatgttgttgatatgtagaatgttgtagatatgtttctagatttgatttgctacaattttgttaaatatttttgcatattcatgagaaatattcaggtgtatttgtctggatttaatattaggataatgcccacctagaatgagatgggaatgtgtttcctcttctattttctgaaagagtttttgtggaagtgatactatttcttccctaatagtttggtagaattcactagtaaaactatctttactagagatttcttggtgggaaggtttttccccttgcaaattcagtgaatttaatagatatagggatattcaggttattgctttctttgtcactgagtttgataatttgtttccttcaaattatttgctgtttaaattgttgaatttattgtcaattctctcttcatattttcttctatcttcttaaacataagatgtatgtttatatagcagttttaatgtccttatatactaattttgatcattttaaccatatatgggtttatattgatatttttcatgcttggttatgagttgcattttcttagttatttgcatacactagtaatatcttttggctgccagacatactgaattttatgttgttgtatactggattttgttgtgttcctttaaaaagtgtcaggcctcattctgggatatagttaagtgacatagaatgaatttaatccttttgagccttgcttttaagctttgtagaagtgggtccagaaacgccctagtctacagctcatgtggcttcattaccgaagcaatggccttccgaggactctgcccaatgccctgtgtactaggaggtctttccactcttcctactgggaacacaaattattaccagccctgtgtaagatcctgggattgcttcttttatgcatctctagttctttccccatacttgatagttttctcccatgcacatgcagatcaggacttagtcaaagattcaaggggactcctctgcacatctcaagagtgctctctaagctctctctctctgttaggaactgcatctcctctggtatttagatctgtaaattctatctgccttgaccttcccgaactccaaactccattgtctgctcaactcagagagactgtcaggctgtgtttgggtcccgtgtatcctattcctaatgtctgaaaaccatcatttcatatactttgtctgttggtactgttgtatttgttaagggtaaatctggtttcttttactctgtcaggccagaagtggaggttgttgcaattgactctaagatctccatttatcttgagttgcttctctgttcttctggaatattgcccttttgggttcaagaatgagttggagtttggcatgtagtcataaagttcaactggactaaaatccagtgataataatcattaaagtgacattgtgagatgacagctatagcaacatattttggccttctgacaaaaaactcctttctgacccttgtttccattctctttaaagatatgctgtctttttcaaagtctttatcttccactttaagataaagatacaaaataaagactttgcaaaaggcagcataccatttttcagcaatgagaaaacagggaaacagatgcctcagccagtcattcactgacacagcctaagtgcaatgtcacttcatcttttaacctcttaccattcaagcctctgatgattctatgaatttctttagaaaactctagaaaaaatggaatttattgttgccaaaatgaagtcccattctccagctaccttccaatactcagccccaagtgttgagaatctatttgtgcatgaattgtgatgcgtacctaggaaaatgcgctgatcagcagctctgctcctagatgggtaacactccctcaaaagtatgacagactctccctgtgcatgaagcatgtgtttcaggcatggaaccaagtgatttgtgcaatcttgtgaggacaaaggttagaaaactgggctcgaaggcatgtcccacttttatgctttataagcagtgcccttctgcctcccttcacgagcctgggggtcagcagaagggcagggcctgtcagaggctgtcagcctccatgcacagggcaccatggacaacagtaacatggcaacagcttaaataaataagacagtacattgtttaagaaacaactaatgttctgaggtttcagtgataacaaccacaaagtaaacatgcaaggtggtaagaaatacctggcatgaatgccttttgttaaaagttgaaccacaagtgcatttttttttacactctactgaagtatttttgttatattcttctttggtggcaagaaaggaaagaatatggtgagtaatcttttatatttacaatagcagctctctataaactggcttggttcttctagaactgcactattcaaaatggtagccattagcgcatgtggctgtttaaatttaaatgaattacagtgaaataaaattagaaatgcagctcctcagtcacaccagccacatctcaagtgctctacagctacaagtggctaatggccactgtgttggaaaaggcagcttctgtcatcacagaacattctgtaggacagtgctattacagggagatctgggttcagatctggcttgaagaccaatcagttctgtggtcacaggctcttccctgggtctttattcttgtctgaatataaaaggtggagtgatgggatttagtgagacagatgagttttcatgtccacaaaataaagaaaccattggagaaaagtattcacactgaaaaagaacatctgtgatacaacttggtatgaatctattggtttgaaatgataactattaggcaaagcaaacagcccttacaaatctccataaagctgtcaaaatccaatggccacgtccaggcccattaagtgtctctctttggccaagaggaaccatcaaagctgcagaaactttgaggactgaggatgttgcccctctagtctctaaggccaaatgcaacattaagcctggaaccaagacacagacatcaggacagtgcacttgaccacccttctcagtcaaaacaacttgttggctgggcgtggtggctcacgcctgtattcccaacactttggcaggccaaggcgggcagctcacaaggtcaggagatcgagaccatcctggccaacatggtgaaacccagtctctaataaaacacacaaaaacatcagccaggcatggtggtgcatgcctgtagtcccagctacttgggtggctgaggcaggggaattgcttgaacccgggagacagaggttgcagtcagctatgattgcactactgcactccagcctggtgacagagcaagactccgtctaaaacaaacaaacaaacaaacaaacaaaaacaaaaacaaaaatctataaaggtgatggttaagcaattctcttgtgagtgtggtgagttcttattccataataaaaattttatagctgcaagaatgagcctctcgtctattgcctattccttcctatgtctctctttaatatgtcaaatcaacaggttgataaatctttatagaacccgcactctgtacctaatgtgcagatactgcaagagataagaaaacagtccaagttgggggttcgttctttctgtggggctgtgaccagttggttcaggaagaaggattcacaacatgaaggacttaggaattaatgctagagttctggtggaatcaggttctagagcatataatgctcagtactgaataaccactgaaggcacgcagagatggaacaggactggatttttcaaggaagctttcatgaaggaagcaggctttaagctctgaaaaaaaatgcaggcaccagggtggcaggtaggatcagggaagagattccaggcctcagcaattacattgtcctacccaatcctgtgctgctttaagaggaggtttagcatagtggatcaaagcatacactctcaagcaagagcgtgtgggttcaaattctgattttgtcatttattaagtctgtgatcttgggcaatctacttaacctttcactagattgctgtgaggattaaatgagtttatatatgtaaaattctaggcacaaaataagcaccatacaactattagcacccccactcccaccccaccctcttttttcacagagattgtttttacttgtatttacattgagaatctcttaaaagtaacctcaataattttacaagtaatttccataattgtcagtttgatttctttaattaaaaaaatttttaataagtaaatacaccgtatttagggcaaaccaacttgcataatcatcctgatggatgcctcagctcttcttaccaaaatactcatgtcagcagggccctggacaggatctgcttcaccatatttgagactcaaagagactgactatgcctcctaaattataccacagaaactatttggtttagaaagatgtctctgtagtatcagtgttctcctcttgttttttaatttttttatttttaatatttgctgggaaaactacatattcatatgcagaagaatgaaactagacccctatctctcaccatatacaaaaatcaaatcaaaattggattaaagacttaaatctaagacttcaaactatgaaactactacaagaaaacattgaggaaaatctctaggacattggtctgaccaaacatttattgagcaataccccacaaactcaggcaatcctgttcttatgtgagaggggtgattattatacttccacttcctcactccctctgggaggcagactggcagcatgggaagggcatgcagctctgagtgcaaactgactttagtctcagtggctacttgcaatccgggcaaacctaggcagtgtcttaaccttatggagccttcttttcctcatctaaaatatgggacattaatgcccacttcacaggcttgtttggaacactgaaatagaatttccaacacaatacctggcatgtgtcttggcatgtggagggagctccctcgaatgtcccaacagttgaatttactatcactgtttctgagaagcagccatatcactgccactcaattcttcaggctatttgtacatgaaagaggcaaaacttcctgcagtccaaactggctctgcctacagcaacaatagcaagtttcccaaataaatttaaatacaaaattaaagcaaataataggaatagcatgaatacatatctgttgcaaaccctaacacatacacttatatttctaatttgtgtacaaccgtatgcaatgtggccttggtcttgacagtgctaagacaggctacacccttgtgtgattatctctccagaaggatagaggcaagtggatcattctccacaacagtgtttgcattggtaagtggatttagaggcagacaagaaaatccactctagtaagcttaagcagagagggatttattacagatttgagaagctcacaggatttctacttaggggtagacaccaaccaagcttaagtactgcacatccaggttgagcctggagaaacactcaaccacactctgagattgttctagaaaaaaccccacagcttcctgctgttggcatctatggtactagggactgtgcaccagaacttccaacacagatgcaacctgcagaaccaaatgcctctgccatggtgttctcctgtaagatcacatgcaactgctgctgagtgtggctccttctgccaacctgttatcgcacattatacctttttttttgtggaatctggaacacctagactctagctgcaagggaatctgggatttttttcttccaccgttgagcctttatagtacaagaagccataccaggtaggtttgtaaaggttgtagtgagtccctctgcagtatctgtcaaagaacacaagttcacctccactatgaaagacttctctggtccccagccacccagattcagcaggtccctccagattgtgcccatggcactttgcacatattccagacattgtctccattacattgaatcagttatttgttcacacaaaggttttctttgttaaaatgaatcatggaggagtaggaaaggcacaagctttggaagtacaattgaattcaaatctcaaatttgccgtttactaactctttagccttggaggaaattccttaatatctctgattattgacatctctatttatagaatgtggtatgatacccaccacagacacttgccatgaagagtgaagtgcttaactgaatcactgatgcattacatgtgttcaggagatggaaaattccctctaaatcttcttatcattaagagcaaaaataattttaatttcaactttgtatctctctgggtagttaaaattcatgtctgctatatgccagattttctgctaggtattgaaatgataaaaatgaacaaaagtcttgcaagtgttcttaatataggtgggaagagacatatccagacaaacacacacacacacacacacatacacaatggttatacaaagtgataatgtgtggagaaggagtgattgatctttcaggggcagggagaaagcccagaaagatttcacaactcaatgtgtgagttgggttgtaaaggtcatgtaggaatttaggtggaacaagggaaggggaagctgaccaggcagtagcagtaatgtgagggtatttgagatcaacaagtagttcataaaatagagtcagtagagcagggagttggaaagagatgggcacagctggctgtcatgaactgggacaaactgctctaaacaccactaattgtgtaggttgtaccacatatgagggcacctggctagtttgtaggggtggggatggttctggtatccagccaagtcagcccaaaaagacagttgcctgcagggctgtcgcttgaaatcaaattggcaccctgctgtgaaaggttttgtgtgccaaattaaggagtctgaaatttaccttgtaggtaatggggagtcatcaaaagttaagcagaatagacttaagtacatttgcccacaaaagcaactctggttcaatgagaaggatagaagcaagctgtattagtctattttcacgctgctgataaacacaaacctgagactgggaagaaaaagaggtttaattggacttacagttccacatggctggggaggactcagagtcacggcaagaggagaaaagcacttcttacatggcggtggccagagaaaatgaggaagaagcaaaagcagaaattcctgataaacccatcagattttgtgagacttattcactgtcatgaaaatagcatgggaaagaccagtcctcatgattgaattacctccccctgggtccctcccacaacacatgggaattctgggggatacaattaaagttgagatttgtgtgaggacacagccaaaccatatcacaggcagaccaattagcaggctcagatgaatagaatgcaacatcataccactggggagagatgataagcgtctgaatcaacatgagtagcagtaagaaaatgcaatgaggatcattttgaaaaccatttagaaggtagaacttctgagatatgcatggtacccagctggatgtggaagaccatgtggattgtgacagcagaaattagggaggagcagattggtctttttggggggtgaggagggttttcaacattttattcttcccttgaattatataaactgatttgtgcagtaggcaggaaggcatatgagtatgaagtttaaaagagaaacaagatcagatacagagatctcattgacttgtagagataatagctatagtcactgatgtaaacagagttgccccaaaagaagtagagtcccccaataaggctttcatgtacattgtgcatagtggtatcccagtaaataattaacattggtctctgtggtgtagggggactcctatctttagcatttactgatttctgtagtgtaagttctcccaccatagctgatttcaagctaccaatatggcatcactgaacagggagtcggaaagagatgggcacagctggctgtcatgagctgggacgagctgctcaacacaccactaattgtgtaggttgtaccacatatgagggtacctggctagtttgtcgggggtgcagtggtggagatggttctggcatccagcccagtcaacccaagaagccagttgcctgcagggctgcctctgcaaggaggggaaatttattctacattatttgtccagaaggggaactttttcccaattctgagcccagaattcaagagggctaagtatggagccctgaggaacaccaacatttaagcaacagggaaagaagacccctcaaaaaacaccatacaagaggggtgggcagacagggctcatatctaagcactacccctttctagtttgatgatcttagtcaaattactttccttctctgtgcctcagtttttactattttttacattgaggtaaaaatatacataacgtaaaatttaacatctgcaccatttttaagtgtacagttcagtggcatcaaatgtactcagactgttgtgctacaatcactaccatacactcagagaacttttgttttgcacaattcaaaggctgtacctattaaacagtcactccccattcacctcttcccatagccccagccaataaccactttactttctgtctctgtgtttggctactctaggtacctcatacaaagggcatcatacagtaagtttcaccatgttttaaatgagaagacaacaccttccttgtaagagttgtaatcctcagatggactgtgaggattccagctgaacacttcacatctcacacatgcctagcacagagaggcactcagtaaaggacagccaccagctcccatgtgtgagagatgcggtgcaagatgcttatgggagacatgagggggaaaaagacactgttcttgccttcacaggtcttcagctcagaaagattttgtatttacaagtaactattattaaatcaaaaagtgaaatttttcaaaagaaaagtactgatggcctggcgcggtggctcacgcctgtaatcccagcactttgggaggccgaggcgggcagatcacctgaggtcaggagttccacaccagcctggccaacatggcaaaaccccatctctactaaaagtacaaaaattagccgggcttggtggttcacgcctgttttcccagcactttgggaggctgaagtgggcagatcacctgaggtctggagttccaagccagcctggccaacgtggtgaaacaccgtctctactaaaaatagaaaaattagccaggcatgttggtgggcacctgtaattccagctactcaggaggctgaggtgtgagaattacttgaacctggaaggcggaggtttcagtgagctgagatggcgccactgcactccagcctgggtgacaagagcgagactctgtctcaaaaaaagaaagaaagaaagaaagaaaagaactgacaatgttcttcgggaatttagaagatgagattgtcaatggctaagaaaatcagagaaaagtttacagaaaagggaacatctctttgaaaggtttggcccaaatggtaatagcaaaaaaggaccctttgtgaagacagactgcatacaccaaaacattgcactggtcatctcaggctgccatgacaaaaccacacagactgcatggctgaagcaacagaaacttattttttcacggttctggataaaagttcaccatcaatgtgccagcatgatcagtttctggtgaagactttcctcctggcttgcagacagccaccgtcttgctgtatctccacatggaaatgaaagagaaagctctctggttctcttcttaaaaggatagtaaacctattggatcaggcccccgccctatggcctcattcagccttaattacttccttagaggccccaactccaaatatagccataatagtggttagggattcaacatatgaatttgttgtcaggggtgtgggggagacacaaatagtctataaaaggcatcgaggtgggaaatcatcactcgtttatagggaacattcaataatatttggatgatgcataagggggttgaaagtggaggagctggagaaatgaaattatacccagggattagcttggatcacaggaggcctttgagtagcagctaagacttttagagtgtgtttggtctgtggcagggagaatctgagggttttaaacagggactttgcaaggtcagaagtgtgctttgggaagatggttttggcagtggtgggttttatagccagtcttgttctcattgccttggagcagagaaggaagggcaagtgctggcagattagatacctgccagaatatcccaactagatctttcaggttgctttcctgaatgccagtcggtccctcgtttgactggctgtgaaggaacacacaagtctggggtactcttgtgaaaaatcattttgagggcaaacatcccccagcctacccccacctggagcttcccaagcatcaattccaaagcaaaacaggcttctttatctcagtcaaaggttttgaataggaactgaccaaatgaatgatccactggtcaaaataactttggacagtttcttgctgactgctgagcacacagcaaagctacctgatcttgcatttcatgatatggtatctagttctcagaggttgtaaatggtcaaatctcaattacagggctcttcagggcaacactgcagagaggaatgcctctccccagggtaaagttctcgtcaaactccttaggcaattggtcccagcagccactgcgacaacaactaaaaatagccatagtataaaaccccagcttccaggaaagctgagaggaaatagtttgctaagaagcacagactgtgataaagcattgcctggtgttttccaacacatcatgggacgtgatgagttcccagaaatcattaataccgacctcaacgattaaagtacatttactgggtgggagggaaggccactttctaaattataagcaacttcagagatcatctagcagcactgttcagtataggcctgagcaatatgaggttgtgcacatcactcttccacctacatactttcatccttttattcatttagcaagtgttaactgggcacggctcaattcctcactccgttctgctcaaacatcctcctcaccatctaatatagcacctctgaatttctgtttccttattctcctgttttctttatatcactggcattgtgctttatttattggttgtccatctgccctaccagcctgtcacccagctccaggggcaggactttgcctgtttgcggtctgtcacggaatgattatactgaatgcatatgtgtatcaggccctgccctccagtgtctctcctctctctctctctgcaactcctattagttggaggttgacccttctgtatttggcctctgtctctagtcatttctctcatatttttatttgcttttttgctcaatgatttcagaggctttccttatttctagctcttctattaaatttttcatttttagcagttatgttcttaatttttaataactctgatcttattctctgattgttccttttccaaagtgtcctgtactacatcataagggccgagtggcaggggaggccaagtcaatcatcattcctttggggtgatcagggaatggatctccagatgccagaaagagaaagtctttaccctggcacctccacaccgagactggaagcacaagctctccccacaccctcaaatggctgcctgtggagggaactttccatgtagaggccacaggtaaaaggctcccagtgcactgcacagagctgggatgtgggagttggctgctgtctggcaaagttgttctaggatagaatttcactgactccctccaatggagtcccatatcatacctcccacccactgtgggatgggccaactccaagctgacagcttctctagggtcctggaaaagaacagggcccccacctcctctgtacctaccttagggtttattctgagctataatattttctgtactctattatctctcaacattttcctacctatcttctctcttccagaagtttgtcaacaacccttgtcattggtgacactgtcttattttcttaactgttgtaagattgttccttttcctacttctctactcttatttcagcaggatctcaggataatctgcagacagtaatatttcaatcattgtgcatgagcaaagggttctaaatacagcttgggagctggtgaatgtgaagtgtgtaaacaggaccctttactgcaaggcttttcagcacttcaatttgcaaacaagaataggtcctgcaaatctcaaagagggggtgtggtatgaagcatttctcaattatttgaccacaagaatttcttctttttttttttttcagggaaatctcatcatttttgtgttccaagaaatatactatggaaaatactagactaatttatcagtgtcatgctagccctgggagtgcaaaacagtagacattaacaatgtttgctgaatgcaggtgcaaaaggaggctgagtcaatgggtcctaaataccactcacacccaagtaacagatttactttgtggagatgatggtttatctcagatagtcagtgcagtggaaagaacacccaggctgaattcagactaacataatagctgggtgccattaggcaaattgaattatttgagccccaatttccatatctgtgatatgggaataatatctgctttttttattttatgaggtagttttgagcatcaaaagataaaatatatgagatggtattttataaaatgtaaagcactaaacaaatacaaggaattattattattgtgaaactcagttgccatgtcacagcagttagaacgtgaaagggaaaagacatttgagcattctctaaccatatcatgtggctggttgcccagtcatcctaaacttagagattgccccaactgcagaatcacagggaaaaacacagaaaaaaaaggagagaaaccctaaccgtcttatggattgcacgtagagctaaatcaagactttatcctcactttacaagtgaagacttgagctagagaaacaagagactcagcaatctttatctggaaaggaccttagatgtcatttgaaccaacttacttgttttagatgcatagaaactggcccagagaggttaagtaatttgccccccatcacactgagataattgtgctagcaagcaggtctccaagttcctggccaacataactcaactcaacaaatgtttatggagagtggagtaccattgccccaagggccagggcatacacaagtgggagcctcaatttctatcctgaaggagcttacaagtgcaagagaggaaagagtgacagtaaacactagagaagggctgataatttaagactgggttgttcagttatgttctaagagttcagagatgggggccactgttgatgactaaggcagacagaaaaatctttttgtagttggtattctccattttcagaacttttgactcacacacagtggctcatgcccatagtcccagctactctggaggctgaggcaggaggatttcttgaggctagaagtttgagaaattctgtcctttcacctcaaagattccatggggaggaatgcacacacacacacacacacacacatacacacacactttataccttaaatacaacctgccataaatctcaagggtagtttcttgaccttaaaatcgccaagaaaaaaagaggaccagtagagtccattatacctgaaaagtatttgctaccacctaagccatctcaaaagtgtctcagagcccatgattcttttgtggcaaagaagacaaagcacccatttccctggcaacaacttttatttagtattcaaataacatccctgtgtttggaaggccagtgcatcttttagtgttttaatttctaaagtttatagagcagcaaattggtttggcatctgttagtaactctgccctaagatgggatgattcaaacttggcaactagcaagcactgtctcccattagtagcagtaataatgaaatgatgtggttgaacatctcaggatgccaagtttactttgtgcttggacaaatggtatattgtgttggttttcatttcttaaaaggtccttataaaagcctcccctttttatttatgttagaaaactcaatttaaccaaataagcagaaccagagtgcagggcatcaacagcgtcagagactgggtgtactacgtgcaggaatctgtccacagctgcaggtacagttactttcaactgaacagattaactttggttgctctgcatagggatgtggtccaggcacttacagggacacagagaaacatggagaaggatcaatggacaagtgaataaacagcccagtgacatccattgggctttaaaatggtttgctgctgaggagatatattggcaattggtgtgatgggacctcctaaggccagagcttatttctgaacatatatcccacagagcacacattccttgagatactccacacaaaaaaatggctaaagaaacttgagaaacagtccctaattctcctcttgcagattcacagtacacattagcttataaaaggagcagagacatcagtcaaaaaaccttgaatcttgtttaactcagcatttcccattttggaaacaattaactataacttaccaaacattggaattgctatgtctcgagctttctgcctgaggctatttacatagcctgtcaaaagctgatggcaaagaagtgaaaattgtagtctatatgacatatctgtttttgtccctgagttaatttacccaacccaatgttttgtttcttgtttatgttagttctgcctattcccacagccaggttgactgctcttgcctggatctgaaggttatattgaaatggggactcatacctgggtctgttggtctccaaagcctgtatttttaactatgtgatactctgcttaatactgagggcgtttaaattcccctcaatggttgggtactttcattgtctcctatatcagtcaactattcctatctgctagaaatgaaaaaagaaaagagaggaaggggagaagggagacagggagagggattaatttcttgtagaagcatgggtaaaacttaatcacagggacatttttgagcatttgtaactttatcacaagttcttgctgttttcacaagttcctgggagatgttatgcttggaggtaggttaaaaatattatttaaaggatgaaacctattcatcttccctggatagggaaagaatcccaaagatgattatgaaagagatagtctaggattactccctacaagttttcctgtggagcagcccctaaactgctcttctcaaccttcatttgcaaagcaaaacagcattagtgtaatcagtcccctatctttcccaaatctgccttaccctagtagttgcaggggatattcaaacaggaggcctggagaaagtgcttttgaacagcaagctcctttgttttcctcccttgcctctgaccactctggcttttaaattctcaaatttgaattctcaaattagattttgtctgacctttagcattgcttggcaactatgaagagtccattttccctactgtggccacggtctgaaccacgcattctgatgctaagccactgcatgtgcctgactgacatgacactgcaggctcttggcccccattcttcccccgggagacaagtggcacctgatggcattgccaacttctcactggttaaactatattgaattgtgtccattgccagcctcaactccctcccaggcaaggaggaaggccagggctctgatcagggctgaggtttcaggagctggactagtaatggagctggggttgatgaggaggtgggaggtggggtgactgctgggtggagcaaagcaagcagcagccaaggtgagttttgagaaaaggaggccatttaccactggcaaagagactggaaagaaagatgcctgctgtgtatgaggccaaagagcaagcagagagagtatttgaaacagggaggatggaaaagagtcaagcctgaaaatcttcccatgctaagactgggttaggagcagaggcagccctagaatttgtgaacctgaagttcatgcttttaaggagccctccttcagaaacaaaaatgaaattccaactacaaaatataatatggggctgggagcagtggctcatgcctgtaatcccagcagtttgggaggcccaggtgggtggatcacttgaggtcaggaattcgagaccaacttggccaatatggcaaaaccctgtctctagtaaaaatacaaaaattaaccaggcgtggtggcatgcacctgtaatctcagctactcaggaggctgaggcatgagaatcgcttgaaccagggatgtagaggttgcagtgagccaaaattgcgccactgcactccagcctaggggacagagtgagactttgtctaaaaaaaaaaaaaaaagtagatatggaagtgaatatttatttagaatatgaaaaggaattaaaacaaatttgcagacttttagaaaactattatataccacagatatcaaaaaatcccaaaaggtaaattaatattttattatgtggataacatatacctgtaatactgttttttctgttttttttgaaacatacactttgaatgcctcttcatttgccaatgattttgtaatatcctgatttgtgggagagaagacaggtaacacaattcctccactaggatgatcaatcaacattgacttttagtattaatagttgggacgtaaaactgcaactgtttatagaagtactacaggtttgtatgcaaatacataaaagtctactttgggtacttcccactgaaaaatatatggtgcatttgttattgtatatgttgcattattgtgtatattcctgacaagagagaatttctgttttgactaggcattggtgaaaactagatcctctgtttacaattttacatatctgataactgggagaacttcccacagactagcttctagctctatatctttcaaatttcaatcttcatatcctgcatatttctggtgctgatgccataggatacatttatattgtgacatgaccatctttgggtcatgacctgagtgaagtcagcacaatgggcatcaagagtattactgaaggccagctcttcaccatgatggttaacaataatgtaactattaccggaaataacttaggaccacacaaatatatctcactaaacccaaactaaatatatgcctaatttaacttcccacttagtgaagtacccaagatgcccatggcaactctaataccatctgaggctagtggaagtataacagagggaaagctgtaatgaaaagaggcattggtcttaaccagttgcagctcaaatatcttatgcttgcaaattttgcaaaaataaatcatgtgaacactacggtaggtccctttctgggcatgggaagggagcagtgaaagtgagaggtcttggactttgagttttatgattatgacaataaatcatccttgcgttaggtcagagtattccaagcttcttcctatactaaccagataaatggacacagattgtttccaccatcgtgattattaaattgtcaaatcaatgatggttgagccatcttgggcaccacacttcctccaggcatgcagtgaggactggtcatctccgctggcccctgtgcatgtctgttaggaacaaacacctcctgtgtagttagacttcgctgacacaggcttctatttaaggagatgactgttattaatagaaagagtgctaaaactactctaaacagaaatggacatggtttcaagtggactttatcaaaatcatcatggtatacacccatctgaaagtaaaaagcaagtttcacatgaatgatggggtctcttaagtgaccacactgaattgaccatacaggcttttctaagtaaaatgtctaatctcagaaaaggcagtaccaggtggtctgatgttaaagagacttttgaccatttcccactctctttgcactgttagtcaacagtcactggttggttttgggaaatggtactgacacttcatttcgtttcttttgtttccattgaggtggaattgatgagcttgttttgctgttgattttactgtaactaggaaggtccttaagtgaggcagataagatggcagcagaagctatcagaggaggagaaaggaaccttagagattgtcttcattacatagtggagggaactaaaaccccaagaggaaaagttacacatcagttagaagaagcattactcaggggtaagcaaggcaagtttcatctctggaatctagtccactttgtttctgtactttcaatccaaactaatgtttcaccaaagtcctactggagaagatggtttgggtaactatggagtaattctggcaccctctcctcagccccagctccccaatcccatgccccaaagtgattgcacctgcctttacacaggtaaggcgattgtcaaaacttgtatttgaaaaataataataccaaatgcttatgttcatgtgcgttccttagccagtgcttccaatgactggaacatgttcaaaattgcatgaatactatttcatagaagagaataagatgtggaagatagctgtattttggtaaataccaattagtaatatggcataattggaactttataagatataaaaaataaaaaatatttataatttgtaataatttactaaatttaaaaagtaggtatagttgtttaaagataaaattattttgactttgaataatgattaaataagttcctctctggcttactgctttcttattcacgtgtcttgtttgatcaaacagggagccatagatacacagacactaagtaaacttccatgaacaaccccaaaagacaggtagaccatcttgttacctagaaggccaatggtttcttggcaaccagcatcatggagaatgggccagtgactctctgccctcactctgtggtgtttcatgaagtcatatatactctgagtcaatccagggtgagtcatattcccctgggcaggcagttcccacattgcaaaaggaaggaaggaaaggaagcaagaaaaataataataactcggtggttattgtgttaaataaagtacatttcaatatgttgtaccaggtggtaaaattatagaagccaatcttttctgaaaatgcaagatgcggtatgttggatcaagtgatttaaaaaaaatgtaattgttttcaaacttgtttatcttctgacctcttggaactgcctattaaaaagaggaagctaattcctctggcaaactttgtggaaacttgacacagagtcttagggtggtattaaaaatgcaacagggcattttactctcagaggagagcgggtgtggtgggggactacggcccactcactgctccaggtcagcaagctaagaatgatttatttatggcaagcatgctagatgccagccgcttctggaggagctgagtgctcaagaatgaaggcctcaaacacaggagatgaatctcccataacctctgatgatttatgagagagttattaatttgattctcattgtcaggtgatggatcaagatacattttgaatttgagctattgttctttcactttctttgtcttcagtaggatatagtttagattgtaactttcattaattgtgttataatcctacaagtagctgaatatgcattctttttcatcttcagtcactctatggcccccaaatcatataagaaaaatagatgactgtttagttagagaagtaagttcccagaagcattttcatccaggctcaccccaagaaacctacattcctgccactgtcaagcgggtctgctctccagatgtgaagcaaaagatcaccaaatctccatttccattttacctttgccctgaaggtttgtaacaatactgaaagcaaataactcaaatccacagtgcaaaatttccaaatttatgtaaatttctggacaggcctggtcttaaaccaagtgatgatacaggtaaaatctctttccaaagccaccatttccctccactacttcttgttttccccttccttgttctcccctctttatgtaccctctttgggtactactctcggaaaagagcctgtcaagtgcagtcattccagggaataaatatgatctgaggtggttatttttatcaaggtattttccttttttattagtcaaaaagcctcaactggagcaaggaaccctttgtaaaacttcaagccacaacagatggcatcttccaaggaaagaacctttgaagcattcacaggtgactaccacagagaccctcatgggtgactactgtgctaatggctgcttttgaatttgggcagctccgcaggtagataccaggcactattttgctcccagcattgtagttgtttcttttctcccacaagcatatggaagcaggcaatgcatcttatccaacttcgcctaccccacaacacacagcagaggacattgcacacagcaggctgactggcatccgatgaatctgtgaactgaagagtgggctgtccctccttttaagaatgcaatgataaactctgctgccctctgcaagttagatacagagagctccttgccatacctcagtgtagagcaccacctccctcctcatttttcacattggtgaatggagacatagcacagtgcatgagctgccctcaggaagtaaatgaagcacaagtgaagggacattcctttcttcccatctccacagttcagattttgtgtgtgtgtgttgcctgaactgtactctgaagtggctcctaaacttagcttcttctaactgctacaattaccctctgactttgaaacaactttctccacctcaatataaaaagtgaacctagtacattaggagtttgccttatgtgatttggcagcacaaaagttccaaaataagttgacctgttatacttccaccacctccagcctttctctatctcaccaccagccctatcatttttcctgtactttgcaggtatttgagaacatggtgcataagcaaatgaagacattaacctggtttcacaatctagttcccttctgtgtaattataggccagcttcttaaaacttctaatcctcacttttctcatctataaaataagaaaatacaatacatgctttataaggctatagcaaagagtagatgaaccaatgtatacaaagtacctagcacagtacatggtacacagagggtgctcaataactgtacatcattatcagcaccgttaatagtctcatcatcactgttgcatctagtaactgcaaccaactctgttggtgctaatgacgcaaagtcattaggagtgatttatgggtgggctatgtagaatcagaaggtaaaaatccctgcaaattacacacttctgaaatatatctctgtttttcagtcagcaaccttgctccttggaaacaaaatcacataagcaagagagaacgtgcacccagaagcatgtgccttggccctcccacttggtggacattgtgttttacctgttgagggaggcatgtagtagagcacagaaggtctgagtgtctgaggtctggattctagctttgtctctattgccaatggttagcagggtgaccttgactaagtgccccatctctctgaggttctgcatcctcacctggcaaacaggaaccgagactcaatactccatgtcatcttgggctcgggtacatgtagtccatgttttgtttaaacacatagtctgtgttttgttgctgatgtatctacttccctccttttttgttcttttcattgtctcattgagagggcaaggcaaggatgaaaacaaacaggaaaacagcaccctctagggtttttcagaggcatgactgtactgatgatgtgtgacgtgctggagtatgaaggacatctggctaaacaccccgagtggcctcagtgcctcccaaggcctgcctgccccacctcctaggtgggccattcagtcttgtttctatcttgaagggaatttaaataaatttattttgaaaaaagaaaaaactacccaaaacaaaaacaaaaaaaacctacagaacttggggaaattattgaaaaaaaaattaatttcaacttcataagccattttctatttcaaagataagtttgttattgaatgcagaaatacaacctttttaatgctttcattgaaatagttaagaaactgttcagaatatttaagcaaggcaaacgagcattttattaattcaatattttaatttttaaaaagagtgattttgaaagcccattttagtttggttttggatttattattctccttcctgacatgagacaaaaatcaataaaagagaacattattctctcctagaaaacagagtcacagcaagtcaaaaatcacctggtctaatattcccattatatagataatgaaactggtagtccagtgcctttgtttctaattgagagcttctagtgctttttggtggagtagacataatagtgatggcagtgacaagactcaatacaaaaaattataaacattaactttattattaacaaataataataaacattaactctgtgtcaggcactctgccatatcttacctggagcccctcatttaatctttgcaaccacccaacaagttagttgctattgttactcccattttatagttgatgaaatgtaagcatagagaagttaggtaactgttctaaaattcaaaacttatcaatactcggggctttaggtatacaaccacaaacctaactcacattcaaatgagcagacatgtaattaaattgataccactgggctttttatgacctctaattttttggttttgaaacaacaaccaaaaaaatccctgttttcttttgaaacttcttcctaagcattgtgaggataaagtgaggaacgaagaactgggatgagcaataaaaggtaggctgtaaacagactctaaggaaaggagtggggaggtggcctgtctcaatattagttagttaggagccagttatttggactgaggtatagtttgcaattcaaccacgaccctgcatgagttaatgggaccattaattatttacaaaagcataatgatagtaatggtgttggtttttcttgcatgcaatgcaaggtatagcagttaaacttattttggaaatataaagaaaaagcttaattaatatgaaacctttattaaactctatgcacctgcaattatattttcttctgttatttggtaaaagcacacaaatgcacactctctgaacacatagctttgtgtattctaacatagtttttcatatgcatatttcctcatatttcactttcaatagctacataatattattccaccatcttgatgtatcacaattttcttagtcatttccctattgctgaggcttttgtattgttcccagttataaataacactgctatactatttacagaccatttttaatttgggggatttttttatgtatgttcccaagagcttaacttctgtgtcaaagtgtacaacatatcatatcttttggtagattgctttctagaaagactaacaaattgcaagaccaataacattgcatttgtagtattccatttttctgatttatccactacaactgccacaactgctacaactgctatttataattttagctttttttaaaaaaaccacaatactatcaccattgccccctgcaccacagccactactatcaccatctccttcatcaacacaagaaacaccaacaccattactattatcagctaccgtcgacatcaacatcactaccaacaacatcgtcatccaccaccaccatcatcaacttcacgaacaccaccaccaccccaccatcagcatcattatcacctttatcaatgcaacctctaccacatcaccatcatcattcaccaccatcatcatcatcaagcccactaccaacaatgccagcgccattactttcaccaccaccactattactgtgttccgctaccattaccaccacctgtactactatctgtaccaccaccaagcctcatccaccatcattcccatcacctccaccaatgccatcaccatgatcagctattatcaccattattaacactatgagcaacaaatcaaatactaccaatcgcgttgtcttcaacaacaccaccaacaaacaacagtgtcatcacatgctaccgtcaccatcattttcaccaccaccattaccagcactagtaccatcatcattatcttccaccaccactattgctgcctaccattaacggaaacattcaatatgtgccagatactgtactgaatggtttatttacattaatcattttatcctcacactaatcctttaagtataatagctgtatgctactgattagaaaatggatgctgagaggttgggaccctgaatcaaagacacagctaaaaagtggcaaggcaggatccatatctacatctatctgattccaaagctcattgtctgaattgccagggtttacagttacttaactgatatgctgtggtgttttaaaggttttttgtttacatctctttagttgctattgagactgaacatttttccatgtgctgatttattgtctgcatttccttatgtgtatgccctccatttatttcctatgatctcattttgaagaaaagctgaatactgaccttaattagatgaattctctgttcatttcttaagagtagagcttcctttttaacatttataacttacaattttttaacttccttacaatcccttttgttttttattccaacatatctgttttatttataattatatctcagcaaatcagaaatgttttttcttctttaattgaaaataatatgcttattttattcgttttctttttatgtttattttatgcttatgtttattttgctttgaccaaaatttattataatatataatatgaggaatgaatctaatgccgtctctgcaccatgacctgattgtcctctgtattaaatactgatcacttcttgcctatgtatatctggtttttttaatgtaataagttcttattatggtctaaatttactttggaaatatctattgtctccacccatctttttcctgcttttaactgaatgtcatgatgttttggtaattgtcacatattttaaaatccagaaggtaaataccaatccctttagaaaaaataaatttagtatattttccctcatgttattctggaagaatcttaaaatcagtgtttcagattttatagaatatactatggagattttaattattattgtaagaacagagagttttgttatcttcagaatatttggctttctatgcatgaatgagttataattcttcatttataaatagtattcttttattcctataagattgtatccttttaaaataagtttcttattgagagctaaattcttatgtatgcatttaatgatattcttatctccatagtacatagatgttacatcatcataagttattcatcaccttaataccaggatacaagtaattttagtgaatttatcttttcccaactcatctgcttttgctctaactacaacatctaggaagataaatagttcagatgctgtagcaattttctctgttacttgaaaacaatatctaaattagtataaactaggaaatcttctgaaagccataatgtttcagaaaggcatgtccccagatgaaccaatctgggaaagagagtgctagagagaatctccagacacgtgggttttcattaatgtagattaagtctggctgagcccactagaactgactgaatttttctaaaactgttgacatgaagtagggtttttatgccagtaaacttccctttcttaagttctctccttttctttttcactctcatttccattgttcatggctcttacatgttgactttagcagagtaacagtgaagaatggtgtaagctggaaaatcatccaagagaagggcctctgggaagtcaacctaatgcaggcctgggttgtcccctttctcccaaggacagagcacaactaaggggatcatggggcatgaggacccacctgggtgggaagcacctctctgaaaggcagggccattcagtctaaagcctagattttgtagttagagttcaaaatccattcatttatacaacaaatattattcagccatgcagtctgctaactgactggacaaaacatctatctgtgcttcatttttttttcatttatgaaagtgaaaggaaaaaatgaaggcataggatcaagtgagctcctgggtcccttctacttgagaattagtatatctaatactgaagaatagctaccagagggactgggccaatgagctctaccagataataagccagtattagtgagtcctatgaatacaaaaagtcccactgaggccaatcccaggctctatctgaaggcctaggtctcatcctctttccctgaggcttattgtcacttgcctaatcttctcaatgtaattgtattatcttccacccacacagcaaaatgtcttttggtgaatccctacctgtaaccaaataccaatccttcctgtgattctgtagttattcagcccccttgtaccttcagttagcccgcaattaccacttccctggtgcacacccaagataggtaaggaatgaatgaatattcatccttgggcaaatcatctaacttctccaattcatggtttccttatcaatgaatagtgctactgatacttaattggaattattgtcctcagcattaaatgacacctgattcaaaatagggtgcccaacacataaaaattttacccatattatcttacttcatacccaaataattctgtaagataattaggacaggtgatattgccatcatcttggggcaaaaggaaatcaggaagtttaagtgacatgtatcaagtttcaaggtaacttggttcagcaaaccaaggaagctctctgacattggtgccattctttaggtgatccattcacttatttatttattcattcctttgttcttccattaatttattactgagcatagtcttttggccccctctctcagccctttccacccaacaatacaactgaagcaatctgctccttcaagctgactgagcatgccattcagtggataaattgtgaccaaaagattgtaattttgattttggaaccaaatcaaggtttggacacagatatacaaaagagctctttagcatgttgtaagtaaagggggaaaaatgaataatcattcaccggccagaatgacagtgatgtccttcttatgatgaaggtccttggatatgcatgaaggaagcaaaagaaatgacacatggcatctgtatgaaaaatatgaagacctttggttgaatatgggttgttaaactaaggatgaaaaaaaaatgggggaaggtatttttttcttgcttgttcttctggaagaatctcaaaattggtgtttcaacttttatagactatactaaggagactttaattatcttattttaaatttttaagtaaggagatagagaatttggagtgcagtgattcttaagaacaagacttcccttattatttttgaaacaagctatcacaattcttatactacaaaacatataaagtatggaaactacaaaccctttggaatctaccagcaaaacatttgatactataaaatgccactgaattcattcaataggtattcattattccacaaatactgagcacatttccagcactatgtatacactgtgaataaatacaaataactgtaagatgtggtcctattctcaaagactttgcagtcggcctggcgcagtggctcacgcctgtaatcccagcactttgggaggccgaggcaggcggaacacgaggtcaggagaaggagaccattctggctaacatggtgaaaccccgtctctactgaaaatacaaaaaattagctgggcgtggtggcaggcgcctgtagtcccagctactcgggaggctgaggcaggagaatggtgtgaacctgggaggcagagcttgcagtgaaccgagaccgcgccaactgcactccagcctgggcggcagaatgagactccgtctcaaaaaaaaaaaaaaaaaaaaagaccttgcagtctaggtggggagacaagacaagaatgaaaggaaaactaataataaaacacaatttgggattaaacaaaaggggtaaaataaataaactgccaaataataaatagttgccaaatgaaacaataggagcgatcctgagtttgaaagatcgttaagagaaggcctccaagcaaggtgggatttgagaatttgagcacaagtaaggtgcaggggaggccctttgggtggggaggagtcattaaaaaccaactctgggcagggcatgcttgctcacgcctgtaatcccagcactttgggaggccgaggcaggcagatcacaaggtgaagagattgagaccatcctggccaacatggtgaaaccccatctctactaaaaatacaaaaaaattagctgggtgtggtggcacgcacctgtagtcccagctacttgggaggctgaggcaggagaatcagttgaacctaggaggcagaggttgcagtgagctgagatcgcaccactgcactccagcctggtgacagagggagaatccatcttaaaaaaaaaaagaaaataaaagaaaaaagaaaaccaccagctctggctgcaacacagccctgggtctgctcagtgtcccagtcaaactattgtcctttagagtaagttgagcaattgtacaaatcattaattactcagcccaaatgaccaaagtgagagcccagaggagatgcagactgtgtgcagttttgatgtgagtctctgttagattttcagacacaattctgcaagattcaatatccagaggcaaacaaaccaacacaacagtagagatggagccagtgatagggaagttcaggcagagttatgtgtttaaaaggcattgaggcatcggacaatagccagggagtcattaaacaatatatttgtttaaacaatacaccctgaaacaaatgactcaccttgttatttagtcaaaaagctatttactgaaagaaaaatagtttctgctctcttagtttcttttttcttcctctaatattactcagtggcttgaaaacttctgctatcttctaagaaagacaatataaaacagtggctatacagaggcaggaagcctgagttcctggcctggttttgccattgatactttgaaacttgagacatgtcacttaaacttcccgatctcctttttccccaagatgatggcaatatcacctatcctagttatcttactgaattatttggatataaagtaagataatatgggtaaaactttttaatgtgtcaggcacctattttgaatcaggtgccatttaatgctgaggacaataattccaatgaagtattagtagctctatttacagataaggaaactatgaattggagaagtgacttgcccaaggccatacagctattacggtcccacttctccgaaccttagtagtcacccttctctataatgcccaaatgacatagtttgagtccgtgccctacatgcctgctctagcctctgtcagctggaggctccttttgctataagaagttttgagatatgaagttgaaagagcacagtgcttgagctgggatgttgccagtctgtgtcaagcttacacggaactgtccaatgaagctaaggcagaaagagatgggctgaggggatttgacagagtgcccaaagcttgagctaccaccactttttccttttttaattttttttaaagagacagggtcttgttctgtcacctaagctggagtgcaatggtgcaatcatagctcactgcagacttgaactcctgggctcaagcaatcctgccccctcagcctcccaaagtgctgaggttacaggcataagccacagcaccagtttacctttcattcttaaatacagtatgttaaacatctcagcctgaagcacccatattgagattatttcccagctcagggatacccgaatggtgggttttgccttccatctccaagattataaaggctttctaataagcagcttgtctccactttggtgcaagttagaattacctggggaactttcaagatagtcctggtgtccaggccacatgccagaccaatgaaatcagaatatatggtgatgggagatggaaataaatacttcagtagctcccacatgcagccaagtaagagaaccattgattccataaaacaaagaaagggtctccccacggcaaatttgaacttctggtattttaagatccagacactggtaacaggaagaagctactctggcatcatttccaatagtagctttgtgtttgttttgtttatgttatactaacatgtggcaagttcctgggttttaccctaggtcttcttattctaagccaccattgttgcctttaaaaaataataacctcttgtattaacatagcattttttggccatctactctgcttactcttaaaaccagtctctagatgtcatttaagagtcaaatgttgatttttaaaaattgattcttatttaatagagatatattgaaggttatcagtcaagtcagcacaggagagacaatgcaggaaagactctcccaaatacaaagataaatctagagataaattcctctatgaatagaaacttagtttaacaaagtgatgttaattcccccaccctttggtgtttcttctctctgctctgtccagggtctctgtgaagctctcagaatgaggaagggctggcaggtcttcccatgtgtgggcccattaggtggcaaggctatggagacctgcagaatggtatccagcccccaaactctcttctgttcacttttgctgcagtgtcttcagtgggcatgagcccacggaggttatcaaaagtatagatttgatgaattctggatatatgaccaaatgagctattacaagaatagtttacaagtcagctctgactgcccaaatgcctgacacaggaaaccatttttacaaatacatatgttttcttataatactttaataaagaaaataagtctgcatacatcttaaaaaaaaaaaaactatagatttggccgggtgtggtggctcatgcctgtaatcccagcactttgggaggccgaggcgggcggatcatgaggtcaggagttcgagactatcctggccaatatggtgaaaccctgtcggtactaaaaacacaaaaattagctgggcgtggtggcacatgcctgtagtcccaggtactcaggaggctgaggcaggagaattgcttgaacccgggaggcggagtttgcagtgagctaagatcacgccactgcactccagcctgggtggcagagcaagactccatctcaaaaaaaaaaaaaaaaaaaaaaaaatgtagatttccaggccctacccttagattcaatatttgtgagaggagctcagagaaatccatttttaagaagctccctaagtgattctgctacagattgtccttggaaactgcttcctctgctcccctcacatggaaatcaggcttttgtgttatgtaatgtattctctgagagttgcttttaagatgcaggtgtgaccagcccgagtagctcactaagttcctctcggctttggcagacttaagaataagggcacgaagaggatttcaatatgtgtttatggaatgaatgaaaagaggtttctgaatccagggatgagtctgtagatgaggaaattcacttcccaaagataaacgtggttgacttcatatggggggttggaggcagcacacatagcctgagggattctgtgtgggttgggcagagtccagcatgctggcatgccttggcctttccccaacacttaattagaactaacacctaacttcttgtgaaaaaaggagaaagtcagatgatataaaaatgcataaagtaaaagctgaaaagttctccctccccaatcttactatcctgaaataaccacttgatacggtttggattcgtgtcaccacccaaatctcatgaactgcaattcccattgttggaggaggaagctgatcagaggtgattggatcatgggggtggacttccccttttttgttcccatgatagtgagtgagttctcatcagatctggttgtttaaaagtgtgtagcacctcccctttctctctcttcctcctgctatagccatgtaagccatgcctcctttctcttccaccatgattgtaagtttcctgaggccttctcagccatgcttcctgtacagcctatggaactgagtcaattaaatctcttttctttgtaaattactcagtctcatatagttcttgatagcagtccaagaatggactaatacaccactatttacaatttagtatctagccttccaggaaatatatatgtacacatatatatatatttgttgtgtgtgtgtgtgtgtgtatatatatatatatgttgtgtacatatatatgttgtatatatatatgtgtgtatatatatatgttatatatatatgtgtatatatatattttacaaagatgaaatgactatatgcactctttcatagtttgatttttttttcacttaacaacatatcaagggcttcttttcatgtcattccatatttttttatgatatcctttcttatatggatgcaccaaaatgtaccccattgatctcctactaaaaggacatttagtttggtacatacatcctttgctcacttaagagtttcctatcagtggacctcttgaccattataaggcccaaatttgtcttcaacttgaatagataataggcccaccaaaaatattgtaccaatatacacttcctacccacattgcagacttacccacaatttttattacaaatcttttgaacattttaccaattgaataaatgagaaaatctcttcctggtgcaacttgattttcttagcttagtaggatgccttttcatatatttatttatccctgcattcctttttcaatgaactaagtgttcacatcttttactgagagtcaaggctcaccttgttgttttcatatattgtattttattattttcattatggcacccgttggcacacagcaaataatcatgtactgaagacagcatattctgcagaaaggatgaggggcaagggatccagcaacttactattttaaatgcactgcttatattatttagtacataagaacttcaagaactggagcaacatctcatattctgcaaaacacagtgatgggaataaaataggatcttaataaatatttgttgaataaaatgagtaaatgtagacagagactgatatagacatatactatgtgcctgcatctgtgctaggtacagggaaacagtacttagcacataagaaacacaatttcttctttttaaaacatgatggtttgttagggcttcagatgtttaaaatgagaatttcgctgcaagaagtgatgaatagagggatgattagatgtctcctgtacttgaagatcttagttctaaaaggcaacagatacataaacaaataatttccatgtaatagagcaagagtagaggtttgcacagggtgctgtgggagcatgagttttaaggatgatgacaacttaggtggatgaggaaacatgaagaaagtatttcaagcaacatgagcaaaggcatggaggtttggaacagcaaggtgtgcatgtaggaaatcaagccattttagggtttcccagaatctatagagcctgaaggcacaggaggtcaggtggactgatgggaagaacacagggagcaggtcccaacctagtacatcattctggggagtgcagtccatgccgagccactaaagggttttgagcaagggcggggtgtgacctgacacaaattgtagatggcatgtcctggctaccaagagaaggatggatttgagggatgaaatgggtggccaagaaagagagaaagcaaaagagcagttaggaaggttctatgtttattcagaaataaggtgatgaggctgcagtaatgaggatgaagggtagagagatctcagagtagacacttggtggctaattggacttgagatgatggaaggattaaacaaaaatatgggcttggtttctggttttagtgataggatctatgacaatgtcactcactggtaaagaaaatgcgggatatggacaggatttggggaagaaattggtagtgcactatcttggaaatactaaccttgagaaaactaggacactcaagggaggttctcggcagacatttatatatacgtatgaggctctcaaggaggttacaaaggctaaaagttaaaattggagaatgaatgaattcaggaggggactggatttcaaggcagggaccttcatgagcctcccctataactcacttatagccaggcataactcccagggtaacttcatttccctttgagggcccatcacaactgcagatctggaatgaattctggtctggactcttgaagcccttttaatccctaacaggagcaggggaagctcatcagtgcaattctttactgttgaatgggagcgaactacttgttgatcagttgttaaactttccttccccagaaagatgtcaattctgcagcccaacagtagtttgcttgtggtgaatggaaaattgaggttcactggtgtgggctgcactgtcaaagccaaggatacacttttttttttgtaagaagatgggctcccctaagaaacaaggttgggaagagggcctctttcagtcctcaccttttactatgtcatcatgaattagtttcttgttaaacatttgtcagtttcaatgacccacagccaggttttaggagagacaacatataggataaggcataaaggtacattggagagtcacagaggctagtcctggctcttccactttctagttcagggaacttgggcaagtcactttacttctctgtgtctgttttctgatcttgttgaaatggggataataagaaaaatgtctgttcttctacctctcaggactgctgttatgataagataataatttcggaaatcccatgcaaatattattatggtttgaagatgcctggctgagagcctgaacttagaaagcctcagtaaacagccgttaagtgaactgtgccatgaaaaacactcattcccttgcccatttattcaacaactgcttgttaagtgtctgctctgtgtaaggcactgtgctcattgctagggatataaggaaagaacagactccatgaaaggcatggaagaaccgtaaatgtatattactaagttaaagaattcagtctgaaaaaggttcattctgtaggatttcaactacatgacattctgggaaagcgaaactatggagacagtaaaagatcagtggtttccaggggttagtgggggtgggggaggaatgaataggcagggcacagaggatatttagggcggtgaaaatactccataggatactataatgatagacacatgttattataaatttgtccaaaactatggaatgtataataccaagagtaaatgtaaactatctaatgaaactatggactttgggtgactatgatgtgcctatgtaggtttgtcagttgtaacaaatgtaccactctggtgatgaatgttgataatgggggaggctgtgcatgtgtggaggcagggtgtacatgggaaatctataccttcagttcaattttgctgtgaactaaaactgttataaaaacaaagtctaatagagagagagggagagaaaatagatcatacatggcttagaagcacctataacctataacttactggaagagaaaggaatgtaaacagattttcaaatactgataaatgggaggtataatcatgcatgtacagtattagttagcttttcatattacaatattttatcttcatttgtgaccaatgcatgcagagggtcagtactgttcattgttcagacaggacccccttattttttattcactgcaggcaaatggccacccagtggtgaatgactccaaccacctgggacttcccgagaagggatgagtgatgctgtatggtcagcattcacatggccaggcatgcagcatctctatgaccagctggaaaggagcagaggaggcattggtgttgactggtgaactcaatcagaccactttggcatggctgttttgcatccttctgccttttaatttgttgacttcccacaaggagacagtgcttatgagtaaggcagagcttaggtcagcagtttgactctttccacattaatgttgggaggcttcatgaagggcattaagtcttgtgtccattgatgcagtgactttgcgctgtgttaatgggggataaacgactgagtctatattctgctttattcatcctgggacttaattttatcagagagaaaaaataacaatgattccatttacgaggtgacaaaagagcaaggtaaaaaagaattaatttcaatgtaatggaatgaacttcaatgcaatttttttaaaaagcataaaatcacttagctaaaatatcagcctttgggagaggtttctcccatcctccacaagtcctggccttctgtagttgctgccaatgagcaaaaccaagtgtgaggaattttgagataaaaaatttatattgcaaaggtgtcttagaataatatttatcttttatacacaggagtgcattgctaacttttgcaaaggcatttaattgaagaaattatgaataattacagagaaatacaaaaatcgtttcttctaagtaagtttctgcaaactcaacatatattcagtggagccatcattattggttatgctggaactctttcactgaatgaaaacttctgggcagattttctccaacgatgtattgaaactacaaaggttgaataatataattacataggaaaaggtgaaaatgtgatcccacagtgtagaccccatagggatataatgggggaattcaagcttgtacttcagctcctccagcataaaatgctttgtcccacctaagggccatcatacatgctgttcccatctctcttcccttcagtcttcaaatgaacagctccttttcatctttcaggtctgggcttaaatgtcatcacttcagagaggccttcccagtggaactctgtgcaggaggcttcctcacccccttcactgtgattctctacccagattcctttgttagctttgatcataatttaatattgtacatctatttgtttgcttatgtgtttgttctgtctcccacaatggattgcaagacccaccaggcacaggatgttcacaactgttttattccctaaggtatattcaatgtctctcggagcacctaagatataaataggtggtcagtagataaattcatgtgaaaatgataattatggcaattgccatctcagtggaatcacaaatgagattactatctcatttgtgaggcagttggtgctatctcatcttctggttatctcgtcttctggttattcaaacttagacaaggagcatcttttctcaatgctgttagctttatttcaattgtattttcctaaaagcatattgtgtctacttagctggaaatggggtgaggggtgggagcaccccacatgcattttgagcactatgatctccttgtgagcaaggcctgggtcttactcataaatttatccccagcattgagtacaacatctggcacagaacagctgcccaggaagtgtttgttgaatttaatgaaattgagatatttgaagaactttctgccttctccttggaagaaggaaattgaagcaattaaaataatgctctctgattttctgtcaaccaagttttatggggataggagtaatcttcctggcagatcataaaagattgcacagttgagtaaagtacatgacaaaaacggaatcaaagctaccttcctgaatatagattaaagagaactacttattatagtgctacagaaatgaatttcctctgtgtctgcctcactaggaccagaaaatgttttattctatttctttgagattctaaattggagagcgatgcatatataaggatgtatatggaaacagaaaacagcttaaatacagacatgttcctagaattctacaggaggacttttacattgcttcccccacctttaggatagattcttcttaaaaataataataataattcaggctagaccaatgctgttcatctccaagaaagcacttgtaattttctcaatagtattttatgtctttcaggaaataatttcttatgttgctcaaagagctcatgccataccagggagaaacagtgaaataaagatgaaggctatatcagtccgttctcatactgctataaagagatacctgagactgggtaatttataaagaaaagaggtttaattgactcaccattccacatggctgggaggcctcaggaaactcacaatcatggcagaaagcagagggaaagcaaggcatgtcttacttggcgggaggagagagagagaacaaagggggaagtgccacagacttttaaaccatcagatctcatgggaactcactatcatgagaacagcaagggggaaattcgtcctcatgatccagtcacctcccaccaggtctctcccctgacacgtggtgattacaattcgacatgagatttgggtggggacacagagccaaaccatgttaaaggccatccagcattccattctttacctgggagcatttccttttttgaatgattcagcagctgatcttcagccttcatttccaggctgggcctttactatttttatttctttggtttactattcacttaaacacattagtaataaagtcatactagctagtgcttatttattgaggtcattataagcagatacttgggactctaacaacctgggattcaaatccccagctctagcgctttctagctcactcactaatttgtatatatcagcttcttcatctgcaaaatgaggtaacaatagtagctcccgcatactgaagtttgcagtgagggattaagtgagatgttgcctctgaaattctttgctcagtgcctcccttatacacatttggggaaaaataactcttttgttctttgtttatgggtcagtcactgtgttgggtgcattatacatatttataaataatattaatcaaactacacaaatttcagggaaagtatagttatctttgtcttacaggtaaaggaactgaggctccgagaggttgaaccaccagattagaggactagaaattcctgaattcagaatttctggatctcagtctagtgctctttttattatactataagacattctcttttgaaaaaaaaatcaattaatggagacattatttattattttttaacttttattctgtaccatgtatgatcaccttaaatctacacacatagcctttctctggaattctgtcaattcctgaacatatttttacttttgtatcttagcttaggagactgttgtgtttttatgaggatttagaactttaatactttttattcacctcaagattggcgtcactcttaaagtgtatcactgtgttgatgcctcatgtccaccttctaatagccatgaggtcttttttctatcatatagaccacctcttgcctacagccctctatacagattctaactaatgtgagtataaataaatgtccagttgcaaacattagaaaactcaattcaagattgtctgagccaaaaaagaattttactaaccattaggacaggaaaatctagtggtatcaagtttcaggcactgagacatccaagtcagaacttgggcttcctctctatgtatcttggctcttgttttctctctgttggctttactctcagtcaggttctgtcttagtggtggtgggatagttcaaagagctctaggaacataccctagtctctttataagtccagcagaagtaaaaatggtcttctaaatttctgagaaaaagtcctagaattgaatctcattggatcccagttgatcatgtgcccattttgaaccaatcactgtgactagagattgcagtgttctgactggccaacatgagtcacctgaccatccttaaggctttacttcaacctaaggtactgtgaatggaggaaggtagatccccaaggaaactgggtaactcaaggcaaatggaatctagttgtctaagattatgacaactgtttatttgtattttcagaactttaatttgtgtgatcgtgggtgtttgcccaattccctcaaaatattctacattctactctcacaaatgtaactgctggcttcctattcccgatgtccctaaccttgctttccccccaacccttgctctctttaatgctattcccttttttgagttattaaagatcattactggtcaattagcaagatggactgttcaccaaaagaaaatcagatgtgtaggtcagagtaatactaggtgacagttgtgggtggattttttttttttttgaattttgttatatgtatttatcttggactccgtccaaggtttttaaaaagtatttgtataatagttgtatttttaaggtgatcttgccaaagctaaagtaggagcttgaccattaagtgaggacaatcaccagagcagtaaatcctgccaaaaatgcacggtgatgcaacagaagatgacctcagatcacttttcttctgcccgttggctcccataacttccatttcctagggctgagtattttttaatttttgtgtgccatctcttggaccctatgtttcctttttcatttcatctctgggtgtgtcttagtttaagcagagtaaaggagaactccagaatccccaaccctagccatttcttatccaagactagtcatttacttatcccaccaattcagtaagcaatttctaaatttctagtagcatcccaacctcctccaaccacatcctgggctttagcaatggagggagttccagctctgttgtttataactatccacatgaccttggataagttacttaccctttttaagtttttgcttctttatttgtgaaatgggattaataacactacctcatagggttattatagaaatgaagtgagctaataaggacttcagagttcccaacacatggtgagctctaagcaaatgttaactattattattatgatgtaactctttcatatgtttcagttcaaattagaatctttataaaaactccacactgtaatgtccatttcactggtggaaggtcaaaatcccagatggaggagacttcaaatagaagtgctggttattcattcattcattgattccatcaacaattatttattgagcatgtgcactatacaggacatattagcctgtttgtaagtatgtagcaagggaccattatatcctgtgggtcttgcaaaagaaacacaaaattggattcctgtccataagaagcttccactccagttgaaaagccataactcaatcccggaaggaataatacaggaactaagactgctcatcatcagaaggtggtatgcacactgtatgttctcaggggcttctaaaatgagtatgagcggtgtctggcacatagtagacaccccgaaaacactggttgaaggaatgagtaatgagtgaatcagtgggatgagtgatggtttttgacaaggactcttgacttcagtccagctcactcccaggcctctgcctttgctaagcaccaatagacagactgcagtgagagccaagatcattgatcatgttggccatgcccaaggacaccttaggttataaagaaatagaactaacaactcacctcaatccccctcatagcccaatctgtgacctcatgcaggtgtgatccctctaggattcacctcccttcgtctacacccagttggtcctcccacaagggcataatgtctttctgaagctgtcatcaaaatcttccagcttaaacctcaagtccttgagattgtctgggagatctcctgcagagaatgtaagttgtttaattcccatggaaatagctgctactctgggtatagtgagtgggctcaactgagtactgctaggtacataaaagctggaacttgtgactaataatgtgattgcactccggtagtgggtagggcaagcattttctgaaaaatctccccataagcatcatcattattttacagtacatgtcatttcataacacacacacacaaacacactgtctaaatatgtttattttgttttgttatttcaatgaaagtttgttttattttgttgatcagcctaattagaagcactgcatctcataaaatagaaatctcttttacatttctgaaattaatggtaagatgaggtctgatgttacagatttgaagcaaagactgtgtggaaagtgggtatggcaatagaacctgatggctttacctttttggaaattatttaagcattttgatcattttttaaatttgcatacagaaaattcacctttttggtgtgtagttctgtatattttaacacatacagaaatgtgtgtaaccaatgacacaaacaggatgcaaagtagttctatcagctgaaagctgcccctttgtaatcaagccctcatctatcccagtccctggcagccactgatcttctctccatccctataatttttttattttccagaatgtcatgtaaatgaaaccatacagtaagtaaccttttgagactgcttttctttttcacttaatatggggcatttgagatttacctgtgttgtgcaccaattaatagctcattctttttatcgctaagtgatataccgttgcataaatgttatcactttttttaattcatttacccattgaggaacatttggggatgtttccagtttggggcaattatgaataatacttttgtaaaaaaaaatttatgtaccaaggttttatgtaaacataagttttcatttctcttggataatacccagaagatggtaagtgggccatatagtaagtgtacatttgactttatatgaaaatgccaaactgctgtccagaatgactgtacaattttgcattcctaccatcaatgtatgagagttccagttgctctgtattcttgctcacacatgggattatcatgaatgcacattgtaaccattctaataggtatattgtggtatctctttatttgcattgctctactgaagaacgttgagcatattttcatgtgtttgccattggtaagtcttctaggttaaagtgtctgctcagatattttgcctatttttttagctgggtttttttttttttttttttttgagttgtaaaaattctttacaaatcctggatacaagtccttcacttcctcctcttctcattactggaagagattgcatggaattggtgttattctttctaaaatgtttagtagaattcattaatgaaggtatatggggctgtagttttcttttcttggagggctttcaactatgaatttaatatgtttaataaatataggactattcaggttatctacttctcattgagtgaattttgttagtctgtgtcttttatccattttatctaaatggtctaatttatgttcagagagttgtttgtagtactcccttatctttttgtatctgtgaagttcatagttgatatcccatcttttgtatctaacattgataatatatcttctctctctagttttttggtaaatctagtgagaaatttatcaactttattgatctttgataaaaaccagcctctagtattattgattttctctattgttttattttttcttcgatttcattaatttctgtttttatatttattattttattatttttgcttgctttggttttagctggctgttcttttttctagttccataaaatggaagcctagattataaatttcagaactttattattttccaaaataagtgttttatgtataaatttctactaagcgttgctttagctgcatctcacaaattttgatatgttgtatgttcatttgaattcagttcaaaatattttttaataatccttgaggcttccttgttgatcaatgaatttcttaaagtgtgttgcttaatttccaaataactggaagtgttttggatatctttctggatattaatttaattgattccattatggtcagagaacatactttgtataatttcattattttaacgtaatgaagtttgttctgtgacccagaatgtgatctcttttggtaaatgttccatatatatctgacaatagtgtatattatgttgttgtttgggtgggatattccacaaatgttcataaggtcaaggttattgatagtgttgtttaggtcttctatattctatattcttatggattttttgtctacttgtgctataaattaccaaaagaggagaactgaagtctctaactataattctgtatttctctttctcctttcagttccatcagctattgtttcatcaatattgaagctctgttattaagtatatatgcatttaaggttgttctatcttcttggtgagctggctctgttattattattattattatgtaatgtctctattcctgataatttcctttttctgaagtctattttgtctaatagacttacattaatatatgtttatatattattaataattatattaatttagaggttagctttcttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccatccgcctcggcctcccaaagtgctgggattacaggcgtgagccaccgcgcccggcccagctttcttttgattagtgtttgcatggcaggggcttttccatcctcttacttttaatttatcaataacattgtgtttgaagtgaattctgtaacagcatatagttgggtcttcttgttgcttttttatgcaatccaacaatcttcagcttttaatttatgtgcttagaccatttatatttagcttaagtattaatatggttatatttaggtgtaccattttattatcagttttctattctcttcctcttttctgccttttagattatttgaatatttcttgtcattccattttagcttatctgttggcttttttttttttactatacttttgttttataactcaaatagctgtttctttagggattacaatacacatacctagtttttctcaggctacttagagtttactatatcaagtaaagtatataaaccttacaactgtataaattccttgccctttaccctttatgctgcagtggtcatattattgaatctaaatatattaaaaatgctatcagatatgttatagttttcactttcaacagtcatacaaaaatatgaatgtcacacagatttgcatgtcaccctttcattggagccatgccaatcttctctgtatggtttccattttagaatatgtgctgccaaagtgagcactaaatgtgtttttaaagtactttcctggtaaaaatttattcaaaacttgcaccacatttgtgaaactatgggctggaattagacatatagtgtttttctccagacaaagctagaattgactctaaccaattattctttaacattaaagggtacaaagtaaagtccttttatcttgagctaaggcataatatgaaattgaaaatggaaaatatgcacagaaatagtttatgaccaaagaagaattattttttttgcagcatgaagctttataatatcaaaactataagttatctgcagggatgtccaaatgggagatatttcctataaaatgttattgaaagagatctgtccaaatttacaatagcagtagatatttggagaagataaaatgaaagttaactctgataggtttgggattaaggaaagagaagtcataccacacattgtttagatcatagccaaggaaatgatcgaaaatacgtgtaacacatttttcattaaaacaaaaaacaaaaaaccaaaaccctcgaagacattttatgcatataattttatttgctactgccacattgccattaagaatattgcctacacttcagtgcagggatgttctgagtctgtgcatcatgcagcgaaggcaccagtctccctctgtaaccttggtccttccctaaagtatgtagtcattggtgcagaatgtacagctgtgaaggtgactgtttctctaaaggctttggtgatgtaagcctgaagccaagcaggaggaaagcaattaaacatcaccttgattaagttataatgtaccaagagagttgcacgttgggcttggtgactgctttcttcaggaaggaggaatttgcactgagagtctgtggggacacagcctgccataaagggtagtgaggacatctttcccttttctttgcctatcagatgcctgacctttcaggaaggttcagctaaagtgccttttgctccatgaagccttttcctctcctcaccccaaccatggtaaatagtatctttacgtgacagcttgtatagctccttcatcttcccaattcatgtggcagccttagttttcatttcatgtaactattattctgaaagggattttgatctctgttaagaccgttaaaaccatgcctttgtttcctcaaagtgtgcacttccatagtgtgcactaagaaaagcagtttgtagagcagttgagaggacaggctcaagtctgtctgggtttaaatcctgacttcaccatttcctagctgaatgactagggataagttacttaaatacttcatgtctcagtttccccacttgtaaaattgggatcattatactatttgtaaatattatacaagttcacacatgtaaagtgctcaacatttttgcctagcacataataagtattattacttatttttttattaagcgataaattttttaataaagctattaaacaaatacatgtttttagtaaggaaggacatagcacaaacaggattaattaaagagaaggcaaagaagacaaagagaattccaccagattctggtgcaaaacattcaataattattttttaaagaactgaagggtgggaatgtctgttggtgcaaccactttagaaaacctatggcagtgtttacacaaggagagcattcttatacactacaactcagcaagtccactcctaagtatacatccaagagaaaagtgtctgtgaatccaaccaaaagatgtttgatagagagaatgttcgtgacagagtagtcatgatagtcacctgcacaaatgtccattgacagaagaatgaataagtaagtgtgtcggtgaaaatggatgatacacaactacacatagcacaatggatgaatctcacaaacatagtaatgagcgaaagaagccagacaccaacattccaggcaaaaagatcctatgctgctacaagccagaataatggttaccctgggacagtggagacgggagaaaagatgtggagaggagagagcaggaggagcttctagggctgtggctaacattttattcttcatctggcgctcgttacatgggtgggttggattgtgaaaattcattgaggcatacacctaagatatgtgcatcttttctgtgtttgcatcctacttcactaaaacaaccagaagagaacgggaatgaagtaagatcagaaaataaaggaagaaatagaaagaaaatgaaagaagggagaagaaaaataaacaaacccagaaggctgaaaggcatggaagccgcacctgaccgggttgactcacccctctgccccaggagccacccctgccctgccctgcccgtccccagcaccctactctccttttgcttagcccaaggatggcaaatgccccttttggtgggggttctgagcatcactaagacaggaagggctttccaagtgggtaaggctggtagtggagtaactcggaggagctgacgctttattaaagaaacagaagacttgagagccatctcctctcttccttccccttcccctttccccttcctcttccccttcccctttccccttcctcttccccttcccctttccccttcctcttccccttcccctttccccttcctcttccccttcccctttccccttcctcttccccttccccttctcctcgactctttctgccttcgcctcattatccgcccccaggacatcctcttggccttggtggctttgccaggaccagctctgtctccgcctcctgccctgcggggtcttggggcggggggccgtggcccggcccaggcccgagctgccggggtgtccccgccgcgtccccgcccggctgaccccgccctgcagccgccggctattttgggcgcgttggcggcggcgggatcgctgacagtcgcggatcctgtgacacctccgggcagcccggcacttgttgctcccacgacctgttgtcattcccttaacccggctttccccgtggccccccgcctcctcccggcttcgctccttttcatgtgagcatctgggacactgatctctcagaccccgctgctcgggctggagaatagatggttttgtgaaaaattaaacaccgccctgaagaggagccccgctgggcagcggcaggagcgcagagtgctggcccaggtgctgcagaggtggcgcctccccggcccgggacggtagccccgggcgccaacggcatgacagactcggcgacagctaacggggacgacagggaccccgagatcgagctctttgtgaaggtaggtcggggtccagtctcccgccgcacctgccgcgcctcccgccgggctcacccaccagggctcggggtgcgctggactccggaccctcccaggagggcggcgcggagccctgtgctcccccgtggcctttccgcaggccagcgccccgctgcgaggctcctgggcggaatggaggaaggcaggttccggcaggtggccgtcttctcggagagttgatccgcagtttgtccacccccgtccccgcctccgctgtcaccgctgcgagtccgagtccagagcccagcccggacgcgattcaggctggtcctgaaagacgtctccaggtgtcgggatgcggcagaaacctggctggacccgtgaacctttcctttaaaacgggaggagggggaggaatgggagagaaacgttattgacacaatgatctttggcaaagcgaaaatgacatttcttaaaattctctttctctctttcgctcagagatcctaaaataaaagccaaggagacaaaagtgttttcttgcttggtgacttgcaaagcagaaaacaagcactccattctccgacgttattatttttgtcataatcatgatttttcaaggcagtatcaaggaaatgttaggcgtttggtagtagggagagcctcccgttcaacctgatgcagacagggatgaaggagcacagtgcaaattaaatgaagtcaccttgctccttggacagaaactgcctaatgtcagagctgctgtactttatttgcaacctgtaggaggaaggatggaggcgaggctgcggcggcgtttcccggtccgccggtgtaaggagaaagaaacatttgatcagcccttggtgccgacgctgcagaagtagggaaacctgaggctgcgggagagtagcctccagggctgagcagaaacagtcgccaggacttgggggaggggaagtcggggactgcctgggcgccaagacctttcacaaagggggaaaactctctcagtgcaaagtttccctagaaatatgcagatcgctgagaagggaagagtcactggtgcctgtcaggggcctcctggcagaatttaaaaggcataaatattccctggaattgggaaaatgttattttgcccaaaagatccttctctacaagctaattaaatagatgtttgcaaaaagtatgagatctacataaaccttgataacaatctgtggtctttggtactttctgactcttaaaatgtgacttactttacacttggtacgtgatctgtctccgttgtcccagcctaccacaaaggtttgttaaatttcttctgctgggttttacattctttgtgtttatttttcaagcttacacctgacatttagtgacacttgctttcttcagcctgttctcttcccactgtggcccctgtgtgctcctttggtttctgggactccccccacccccaccccaggctggatttccaggtcctttggcagacccaggtaataaaggaggtcatttctcgtctgatgctgggtagtgttggaccttagggcagcaagggggtgttctgaaccccagcatccaggcctgggccctaggggtgaatagggagagctttaacaaagcgatgagtcttgctgctctccttgaagaaagcgattctaggacttactcagattccttgagagtggtagtttcaaggtgtcaagtttctgaaagatatttgaaacacaaataggttctttagaaccaaaggagccctttgccccactcctaggtgtggagaccgattctacctgcacctttggaattttcttgttggcagtgttggagagtctctccatttatataaaaaccttactgcacaatttgcagcgttccccaaataattctaaaatgactgtgttgtcatttgttttttccctaaaggaaatcaatgagagccaggcaggccttcatggctagctcaaaaaccagattgatggggagatcaaaacatcaggtatgaaagttgttttgactcctccctcaaccccatctttttgagcttcaggttagcagttctcatttacaagtaaatgggacaagtaaaggctagaaatattgtgaaataaagatgctgcccaggccttacttgaactgtgtcatttgagggaagcaatatccttgttgacagaatcacacttttccaaagtttggagtttctctgaggtacatgattccccataaaaagaaaggccttcttgttgatggtgtcaggtaactgaagctctttctgcagggcagggtgggttggtttctatgaagacttccaagaaggatgggtcccacccagttatagtcatgacttggtcattttcaacacccccttggaaggacctcccaacctcttgtttccactgggtgtaccactctaaatcacagtcacctaatgagtttcacaatgacatgtaattgtaattgtctcccacgtcaattgatagtcattatctgttactactactgctgataatgataatgataagaagaaggaaagattgcagcatattaggacataataagtatgttcaaataccttatctcatttgatcatcagcaactttataaggcttgattcacttatgtgaaagataaagaaaacaaataaactggattcacaggtaccttatgagactcgctgtcagagcacttgatgagctgcagtttgctcttcttgtaacagcccagggaactaagaatgataattcctcctgttctgttgaacaatacatgtgctcacagaaagtaggtaaaatgcccaaaggtagatggcagatagcattcagatccagtcctcaaatctagcagtttagactttgaatttcttgctcttttccaaatacctatatgtcaggcctgataccttattttgccaagttaggctttcaagtgccatcatggtgacatttatttatgttattaatccattctaatgtgttcatagaatgcttccaaggagactaacccatttctgctatgtactccgagtctttccctttcggggaacattctgacagtgacttttaagagattatttccccacatttttagtttctacaataagaaatgttagatcatgtcaactctgattctaatgtcccataatacctgtggatggcgcagggatttggagatgcagtacctgagttcaagtcttgcctctgcctctaattagctaaatgatcctgaacaaattatttaactttcaggagcctcactggccctcttaaaacaagagcatggttataaataaggagaccatataatttattgtccaaatctagacacttttgagagtgaaagggaatgatatcaataattaggctggaaccacaggtataacccaggatagtttgggagcaaataaggatgtgtggtcattctggttatgaaaatactgtcattgtagatttgctgtgaggattccatgggagaacataggtgaaaacactttgtaaattgaaaattgctgtaaacacactgacttgaatattatgagtcccatggcagactgaacctttctggacctgcacgtccctgatttgccttggggaacaaaggcctggctccttcctcacttgcagggatattttgagagtaaatgagataatatgtagcttggactttgatcctaagaggaggacaacaggctagaggtaatggcagtgagtgtggtttattgaaagaaatagagcaaggaagtaaaagcaaaacagaaagcaatttgaaaagacaaacacaggatgtgctgtgtaggttagatcaaggcattccacccatttgcattgcttcctccactcccagtctcacccctggaccccagaagtgactaatgatacagacaagctcgccgcaagtgtctcttcagccaggaactgaggtttcaacagaaaccagtggttctcagccttcactacctattcaatccattgagagagattttaaaacttctgatggcagtttgctccccaagccgattacatcagtgtgtctgtgggtgggaccctgaaacaatattttcatatccactctcaggtggctccagcgtgcagccctggtggagagccactgagtcataatcagaggcaggtccaatagcaggcagcttctgccaccgctgacataggtggccttgctaatgctgattaaatgtccagaacttctaacagcctcagggcatcacggtcagaagtgttgttgatagaaagcttgcatccaatcactgcccagttaacagatgctgacgaactattaagccctatccacaggactccagaacaatcgtgtatagggttggtctagtcaaagaatcatcaattcagcatgggggaagtaaaacagagttctgctaattgtctgatggaaacgactagtctttcatttattgagtggcccaaaagtttctgagtggtgcagggtgcaatacaagttgtggtgactcgtggtgtggtcatctgacttccagaacagataggatcagatcttgtggtgtcgcctctatgtccctgagctactgtgactgcctggtcaccttgggccgcttgcctaagcatgagctcactaggtttttaaagttcccttcatcatattaagctactgtgtttttctttcccactatcttcaggttttgatctgtagtcaataacgcaatacacaaatttgcctgccctgctatggcagtgagtgcttcttctcctggtaacacatccctggagagctagcgtcaagagttgtatgatgcatatttgaagtgccatggcagggtggtgggaatgaggactgggtctgcagaagctgacgtccactgccagtgttgagagctcctgcatccctgatgacttgtgttgtctctttgggcatttattggccccctccatgcaagacaaagcgtctgtcaatttagacagtcagttaggtcaaaaacttctcattcttggttccctttgagttgtcagctgctggccccatgttagtggtggcaagagatgtggtggaagagtgaaactttggtgtcaggctcgggttcaccagtgtgttggccaggatgggctgcttgacctctctggaccacagattttttttttgttttaaccagtgcagtgctaatagcagcagcacatctttcatggagttggtgtcagcatttcaagctgagtatggatctggcctattagtaagtctttctctgtaggctccatgtagcccaataagtaaaagtaaagcccttgggcttccctcccttgatgtgtacaagaagtcagaggctcagtcctaccagctgaatctcacatctcagaaccaagatacttcttgaaagaaaatgtaagtttccaaagcaggtcgtcattcagggaactggaagagaaatgttcccgattgttggagctgacccctgagaacacaagcagtgagtctcattgctgcagaccaatggcaactgaagtacagtgcaaccaccactggatctgactgcctctgactggactgctgctccataagctggagcccactagagcccatgtctggagtaatgtggttggactgactacagggtaactgcagatccctgacccactgggttcttcaaactcaggggaagttgattcctcctgtcagttgctccctcatccaagaaagctcctacataactgcttccccaaggctcctggtagccaggccagggtaaaggatcctctttattttcaagaggatccctggttctctttgcagattttactaccccttcctcaacaatcttccagctatgcatagccataggtgctctcatcaaatatactcacacatgcacacgtattatctaccaggattatggggaaaatgtcgtaggctctcactctctggtatctattaaaaaactattacccagaacacatcctgagttgtatctgttgtcaagactggaggaactagagatagtaaagatgcaaagtggttaagcatgagtttcctaagatgtagttctgtaaaggactctctctacccagggtgtcttaaatctaacactgcttgtgttctgaggggtcagctcccacagtcagggacatttctcttccagttcgctaaatgacaacctgctttggaaacgtgtcttttctttcaagaaagaagtatctaagttctgagatgtgaaattctttaaggacaaataagataaatagcctactgtctgaactgaaacgaattcttccctgtaaaaagaaatggagttgttaacttctagaagttcttttagctctgctggcatgggaagagtctttaagggggattcaaagactcttcccatgccagcagcactggaggtaaaccatgggtaggctggtggttctcagcctttggggcatgaaagagtcactgcacttgccttcttcacttgtacctgcccaggtcctgtctatagagtttcagatttaggagggtggggtgaggcccaggcatctgtatgcttaagaagctacccactggtgattctgaagcccatcaaagactgagaaccactggtgcaaaccatgggtaaatagggctgaactactcagtggagcatcaaaaggacaaaatatggtccagtcgctacttcaaacaagcatttcacaggatggaggtagccaaggcaatatgctggttcacatgaatcactccagattgacctcaaataaaccagaaaagggaggaaagaaatgcttttgacctttcttttgtaatttttcttttcttcctttgtatattttttattatataggagtgacacataattttaaatggcaatgcatgaaggagatagtaagataaagaatgtagggagttggggataaaatataatcaatcaatcaatatatgaaaatgcttacagagcacctactctgtgccaggctctgtgaaagctgaagggggctgggggagatcagagaagaagacaggctccagtagcttgtgagagtgccactgaggagtgcaatgcaaacaagcatcagtggcacatgagtgacaggaatgcaatgagtcatgcatatgatgggaccagtgtggcccaaatggtgtcttcaggcccagctttgggtagggtgggacctgagttgagtcttgaagaatgatcaggattcagaggtggccaaaagtgagcaaccatgtcaggtccagcaaaggtgtggagatggggatgctcagggcttatgagtacacggggttgtctgaagcaagtggtatatgaaaggagcaattggaaataggacagcaaaaaagccaacaacagtggcaggagggggccttgaatgggaggtaagtggtatctgctcccttgtaagtagtggggagtaactggaagtgtctacacacaataggagattgacttgggttatgtttagaaagattgatagctggacttcgtgctttagtgggaaaatcaatgaactcaaagtatgatggataccctaaaagtcctgacttgatcactgcacaatctatgcatgtaacaaaattgctcatgtaccccataaatttgtgcaaatgaaaatcgggaaaaaaaaaaaaagaaaaagaaaaaaaacaggaaaaaacaaacaaacaaaagaaagaagatctggattccaggtctgccacgcactggttgcgtgacttgctttaagggtaagttttttttttctataaaatgtgatcaacattcataaaaccatagaatttattatttggaaaagcttccagaagtcatccagtctgaccttctctgatgagataagttcccaatctaacactttgggatatacgctatgtgggtttaaggaagagtagtgagataaaatgtgagctgctgctgtttttgccattgctattacggctgcattcactgtgaccatgttggaataaggagagccctgaggcagaagtcagtgaggaggctatcccagtggtcccatcaggaggccaagtgagtccaaacaagggccaaaagacagagtgtgttgtggaatacagaagtgaatacaaaattaggtgcatgccttggaagaagcctgtgcaaatagtgtatattaggggcaccaacaccgaagactcagcagtttcctggtacattcacccctggaaaggttagtgtccacatctagaatggtgatatctttgatgggcttgaccattactgtctaagatattgtaaattgaagagtacagacaaactaattgagctttaagtttccttttaactctgaagaaagcctatgtatcctgtgaggaagggagttgctgttcattaaaatcgtttgatttggaatggtgtaatctgaagtgctggcaggccagtcctgtgcagatgttccttagaatgctgaaggatcagagctgaggatcacaggggctcagggctagggattttatctgaacttctgctcagagctacaggtgacggaggaggttccccagaggagggagcatggagaagaagtacagaaataaggacttgctttaaaaaatgtcttttggggctgggcatggtggctcatgactgtaatctcagcactttgggaggccgaggcagggggatcatgtcaggggatcgagaccatcctggccaacatggtgaaacgccgtctctagcaaaatacaaaaaaattagccgggtgtggtggcacccacctatagccccagctacttaggagactgaggcaggggaatcgcttgaacccgggaggtggatgttgcagagggctgagtttgcaccactgtactccagcctggtgacagagcaagactgtctcaaaaaaaaaaaaaaaggaaaaaaaagaaatatcatttgagagggaggaatgaggcacgtgaggagttagccaaggtgatcaaggaataagaggtaggaaataaatgcaatgtcctaggcaaaggaaatcatgtgaacaatggctcagaagcaagacaagcccggatgtgtcccagaaaactcagagctctgcttggctgtgctgaagagggtgtgaatggatattgggaaggcagataaaaatgtaagttaggggccaggcgcagtggctcacatctgtaatcccagcactttgggaggctgaggtgggcagatcatgaggtcaagagttcgagaccagcctggccaatatggtgaaaccccgtctctactaaagatacaaaaaattagctggacatggtggcgcatgcctgtaatcccagctactcaggaagttgaggcaggagaattgcttgaaccaaggaggcggaggctgcagtgggccaagattgcgccattgcactccaggctgggcgatagggcaagattccatctaaatatatatatatatatatatatatatatatatatgtatttatacatgtgtatatatatatatatatatgtatttatacatgtgtatatatatatttatacatgtatatatatatttatacatgtatatatatttatacatgtgtgtatatatatatatataaatatatatatatatatatacacacataggctctgtcctaatctctttgagctgctatgacaaaatgccatgaactaggtagcttataaacaacagaaatttatttctcacagttctggaggctggggagtctatcagtgcaccaatagatttggtgtctggtgagggccacaatgtggttcatagctgtcaccttctcactgggttctcacattgtggaggaggataactctattctcttcagcccctcatgagaacactaatcccatttgtgagggctccaccctcatgacctaatcacctcccaaagcctccacctgctaatgccaacacctcagagatgaaattttagcataggaattctggggggacacaaacattcagatctagcagatcagatcatgaagcatctctgatggcaagctgggggatccagacttttgtttataaagtggaagactgctgtgcccctacctgcctgtggagcaattgtagtttaaaagagggaagtgcttaattatctaaacatggtgcatttggccctgcatctgaggcagggtgttttggcgtgggaggcctttgcagcacgtctctggttacccacaggctttggtgtgtagaagttttgtgccagttaccccatatcctatatcaacctctatggacttcagggtgatggtttcttttccacttttgtttaacgttattctatggtaagagggaaaagaaacaagtgtccgactggagaaataacacaaaaggggaaggaggggaggatgtgcagtgaatggagtccaactgggaacccattacctagaatagagacgaagtaacaccatgtcccagttattctcttaaacatccaatttgggagattgtcatggcaacagatagaggtttcttgatccagcccaaggctcctctcctgtcaatgtccacgtctgcttcctaatgctgccagtgtgcatgggccccgtcaacaccaaggatgaagacgaggggccgtctcacctgccttttattcatttacacatttgctctctgtggcattttatagttatagcataaaatctagagacagcagtgtctttagaatttgcccctgaaaccaaaggagccatatgtccttggccctttgtcacaaatgactcaggttttacttgtggaattgaaggttctgggcagggcttccccacaggctctgggagaggggagctgtgtagggaaagttatgtggcctttcctcattcaggtactttgtgaatataacagggatctgatctgtgtggcaggattattattatgaagtcaaataagataagaaacatgaaccccttttgcaaactacagtcttcactgttcagatgtcaggcactgccttggtcggtataggtcaactgctgaaacaacaacctaccaactttttcacacagtagctcaatgcagtgtttagtgagtggtctcccccacttggactccctccaccctgtagttctgccaccctgcgggacggccaactcctttgctgggctctctacagtcagccagcacagggaagattgaagttggaggacatcatggtaggtttgcatggtcgaatcacttccacccactttccatagtccagagctcaatcctgtggctgttcctctgtgcaagggaagctgggaagtgtcatctaactgtgctgcaaggacagagaggaagcaggtttggagctagtctctaccgtagaaactaagttatgtattcttgtttcctactacaaactggcatcccacctgcagcctctctcacctcctgttgaccatgcttaatactgtccacttaatcttcctaaagaagaaccttctcctgtatgacatcgattccccatctgctagatcaacttcaactgcttccacctgatactgaaactattcttgcattccttttcccagcgttatttcccatattctgttaaaatggttccttgtgtgtacatacagttttttgaagcatttttgggtctcttatcctttgaggaaggaagatagttaatcctctcatataccaggtgatttgtcaggggctgcatgatgggttgctctatacaaacttagaaacctggagatccggactccagacctgaccactctccaccagaacagggtttcccagccttgcacaggcatgagaaccacctggggcattttccaaactccagcccaaatgtgtgaatcagagtcttcagggaaggaggtcccagatacctgtaatttaacaagtgctgcaggtgattcttgtgcccagtctggttaagggaacactgcccttaacctaaccaggccccatgggagtatccaaaacccacaggggtgagtctaacagtggaaatttaaagccctgtgacattcaaatgtaggagagatttggtaggcgagtggtcttctactgctctcaggtcaccccaaggtatataacatctcagtcattttatatagtgacctttagacttaggatctgctccatggcccgtggaattataaaaacagttgcagccttgtttattgttttgttgttggtgttgttgttgtttttgcaaaggtatttatccccatcctcaaagtataaggttcttgaagaggaaaatgttgggaaagagatagcggggatggaagagggaaaagggtaggtgagacagaggatcactgaagtggcttatgatacagaaaaaccagtcttcacacctcagtcctctttggtcccatgagtggtgtctttgcattttcaaaatcagagaatcagtttggaaattgaataatagcaacagtggctaactgctattctgaacaccttagtttcgctgattccttgaattccatggagtaggtcttggtactattcccaatttacagatgaggaaactgaaggtcagactgagtcccatctggataaatgcacaaagctaggacattgtagagcctggcttcaaacttcatcccctgacatcagaatttgtgctctctcctgcctcattttacccagccccttgtagcttaatgaggagaaattgctgcgctaaatcagaaggcattttcccaatggcgagcaagagggagatgaccaaggttttgcctttccttaattctccataggtggcaatgaatagtccaaggtcaaggtcagatcccaacacttagacaagaaagcagggcaattaccagattgggtgagttagagcagcctaaagacgcacctgttctcaagtctcctacccacttctctgccatagtgacatgaactcccattctttgatcaacccctttggcttaaggaatgtttcttagacgtccttttaaaaatatacatatgctacttgtaatgggctacctatggatgcagtagccccagctgacacattatctgggattactttatcaggtcagtaggcagagggaagaggaccagaaggaagtgggtaagagagaccaggagtattgcatgccactgggaaaaaaaagtgtacctgttgtgcattgtgggtgtggccaccaagagcagattttgtcccctggccagtttgcccaagatgtggcattggcccaagttcctcagtcaggattctagagtaagctctgaaaatcatctttgcaaggatgaagccactgacttgagagaaatcttacatctattccagtcggctcttcttccattctaagacctagagtcatttacagatatgtatggcagagtccaacaacaacaacaacaaaaaaaattacagactattcactaggcactataaatgtgagatataacaataaatctaaagaaatttacaatatcgtccatggaatttgatggattccatcgagtcctcgcaggattctagcagcttcattcctccttgaggcccagacaagttaggctgttataatgccacatagaagactgaaagcagaggtgagaataaagctgctgctgattgagtttactccctggtgtggggggtgggggtggtccagcctcactgctaggactttctgagtctttctgagacacttgccatggtcaagggtagcaggatcagggaaggcattataataaatataatttgcagagcatctctctcctatgcaccagatattgtggtgacactctgtttaatccagtatccctactcctttagatatattgtgattgttttacatgcgaaatctggcttcagaaaggttaggtgttttgctcaaggtcccatggaaagtggcagagttggggtttctgactaactccaaaaccctttaatgtgtgttcataattaaaaacaataaaaaatgaagtcaaggtacttgaaatgcacttttccatgtggcagctgtttactgaagcctaccaggtgccaggccctgggtcttgtgggggaagccagctgggacctggcagaacttgcagcctgggggtctgggagagtggcagccactgggcatttggaaggactgtggcctgaaggcaagaatgaggctatgggagctccaagccaagggacctggtatcaggaaggcactaagcagtgttttgcagcacagccagggaagaagttggggttcagttcaagtgtgcaacatgaggggagaggcccagctaagctcaggcagagaagggggagaaagccatccacctcttcccctctctcccccgtagacctgttgctagggcagattccagagcaggtgatagggggacaccaggctctccacccagtcaagaccccaggaccttctcttggtacccacctaccccaggagagtaaggacactgctggagaaaaaccatggactatctcttctggttcctctcccagttaaggtcaccctaaaggatgataagaggcttatctaggcctaacactcctcagaaagcattttccatctgtatgccaagaattgctctaactagggcgaggcaactttcattccagagtgggagaaaaatgcctctcaaagggaatgccttgttggtgaacactgtagagtgaaggaatacccagacttcatttcaaagagtggttatcagatgcacctagttgacaagaggtttgtgacatgggggatggtcaatgaagagctggaaaaagaggctctgtgatatggtttggctctgcatccccacccaaatctcaccttgaattgtaataatccccatgtgtcaagggagagacccgatgggaggtaattgaatcttgggggttgtttcccccatgctgttctcgtgatagtgagtgagtctacgagtctgatggtttcataagtgtctggcatttcccctgctggcagtcattctctctcctgctgccctgtgaagaggtgcattctaccatgattgtaagtttcctgaggtctccccagccctgcggaaccgtgagtcaattaaacctcttttctttataaattacccagtcttgggtatttcttcatagcagcatgaaaacaaaccaatacaccagggatgaaagacaaagaccatccatgcatggctctgctccttcggtttggtgctgacttccatcacctgggttcagatgaacaggtggtaacaactaaaaatggtgaccctgaagtcacaaatcagatggatactcccctcacggtgggtgtctccttcaaaggagcatgtgcaccatcatcttattattacacagacatacacagtatgtgtgtgttttacatatatacagttaacctccaaacaacgtggaggttaggggcactgacccctccatacaagttgaaaatccatgtgtaacttttgacttcctaaaatcttaactactaatagcctactactgatgggaagccttactgataacataacagtcaacacacattttgtaggctatatgcattatatatggtattattacaatacagtaaggagataacagaaaatgttatttaaaaaaccacaaggaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcctgcctgggcgacagagcgagactccgtctcaaaaaaaaaaaaaaaaaaaaaaaaccacaaggaagagaaaatagatttactattcattaagtgggagtgggtcatcataagtcttcatcctcctcatcttcacattgagtaggctgaggaggaagaggaggaggaagaggaggggttggccttattctctcgggagtgacagaggtggaagacccacttatacttatccatgtataagtggatctgtgcagttcaaacttgtgttttgcaagggtcaactgtatacacacacataatatacaggatacacatataaattttatgtgtatatataatatgtatacatacacttttctcctgagatttgaggtccaaaactgaaatacccacatccacatagtatttggcacacaccatatacccagcaaatgatattcctgtgtaaatccatacctatcttttcatttattttatattcaccaattgtcaagtaatagagcattacagtggagtttaggaaacttgatttttggttctgctttctgccattctgttattttcaactggcagcttgggtttcttcatctctaaaataaaagggttggataaaatgatacccgaggtccctttcagctctaaaagttgattctttgattctcttgtgtacctcactgtgtgaggtcccatgggaggttccaaaaggactctgctctcagggagtttacaatatacttggtgaatggccttggagctctcatagcctaggttgaggtcagcaaatgtcctctgtaaagagtcacagggtgaatgtcttagaccttaaaggctatacagtctctgttgcagctacccagttatgcctttgtagtataaaagcagctgtagacaacatgtaaacaaatggacatacctgtgttctagtaacacctcatctacaaaaacaggtgtgagctgatcgctgacctaggtacccttccaagaaggaattgaacgaatgtggcatgatgcctggagctgtgggcttggcctttgctgtaaatggttatgaggttggaggagctgccttcagtgagagtggccatattcacctgtcactgtccattccatgaagcactgagatctggcaacctcagggttgagctgtaaaatgaagcattctgaattacttggagaacattctgatgtgaatccaggttattaatattcctatcctgcatgtgttgaaatattcacaggggctgaagcttaggactttgttgccaggtccatagaaaggtttttgtggttgcggactcgagtcctcaggtggaagccctggatgtagacagaactcattccctaattctaccactacgcctcctctcacttcccctgcacttggggtgctattctgacaaatcattcccttgatatttactgcttagactcctggctcctgccaagccatgtgctgctgacacatgctgctcctctgagcagtgtcctaacatctgtgtgctgggacatagccacctgcctatgagaaggtagctaggaagtttccacttccctagtgggaactcacagcaggtctttccaggatgtcaccgtgtgaaaaatataatgattagctcatttccaaaccaattttgcataccaggtgagttagccaagccattcaagcaggaaagccattctgtgaagccccagacaaccgctcccaaggacagattacctgagaaaggagaatactgtcttatgaggtcacacattcctaatggtaaacactcagggcagtttctgctcttgactcccctacacccttgatcaaggcacttggcctctctggggaatttttcaaccatgaaacagatggaaccacattcctgggcctgctgggtcctgggcttaattcagattgtataaactcatggaacctacttatagtctctggctttggttaacttactttggttaactttcacattagccactttcattgtgtgtgtgtgcatgcctaatttcctcatgttccaggcctttttccatagtctcaaatgccatgatctggcaggaaattggttctttcttttgccaacaagtaacaataaagggcacttttgcccactattcatatgtttgtattttgggagtatttttaactgattttgttattgatgtatgtagtagatattcgtcctacttcattgctacccagtgccatttgaacacgcttcttaggcccagcatcttcaaggcagaagccaagaactggctttctttttttttttttttcttttattattatactttaagttttagggtacatgtgcacattgtgtaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgatctcattgttcaattcccacctatgagtgagaatatgcggtgtttggttttttgttcttgcgagagtttactgagaatgatgatttccagtttcatccatgtccctacaaaggacatgaactcatcattttttatggctgcatagtattccatggtgtatatgtgccacattttcttaatccagtctatcattgttggacatttggcttggttccaagtctttgctattgtgaataatgctgcaataaacatatgtgtgcatgtgtctttatagcagcatgatttatagtcttttgggtatatacccagtaatgggatggctgggtcaaatggtatttctagttctagatccctgaggaatcaccacactgacttccacaatggttgaactagtttacagtcccaccaacaatgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcgcccactttttgatggggttgtttgtttttttcctgtaaatttgtttgagttcattgtagattaaaacaagcaatggggaaaggattccctatttaataaatggtgctgggaaaactggctagccatatgtagaaagctgaaactggatcccttccctacaccttatacaaaaatcaattcaagatggattaaagacttaaactttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatcaagaactggctttctaaccccacttctcttttgcttaatttagctagagtgagttccgtggtttgcaaaaaagagcccagatcattatttctttcatttctattttttttttttttttagttctgaggtacatgtgcaggatgtgcaggtttgttacataggtaaacatgtgccatggtggtttgctgcacctatcaacccattacctgggtatgaagcccagcatgcattagctatttttcctaatgctctctctccccccaccccagccctcaacagtccccagtgtgtgtgtgttgttccacttcctgtgtccatgtgttctcattattcagctcccacttatacgtgagaacatatggcatttggtcttctgtttctgtgttagcttgctgaggataatggctttgagcttccatgtccccgcaaaggacatggtctcattcctttttatggctgcatagtattccatggtgtatgtgtaccacatttctttatccagtctcagattattatctctttagaaaaaaaataaatggaattttcttttgaatcttatagatcctatgatattaattgtaacacctaatttgagtgcttctaaatgtctcattaggatatttagcaccaaagatttattttacaacttcagtacattatttgggatgcttttaatagagaaaacagaaatgtcaacccagtattgtaggtagggcttgtatgaacacagaattatcttgagttgctgggccagccttgggaggcctgcgtaaagcagatcacactgtgagttctttctcctccctctccatcccctcttctgttaccaaattgaaggcttctcactgagtgaaatcaagttataaaaatttctgaaagcctccttcaagggaaaagaataatagtaatgacagctaacattgactaaatgcttactatgtgtgctctaatagctttatgtgaatttattatttaatccccacaactctatgtattaaatactattattaggattgtatagatgaggaaactgaggcactaatggttaagtggcttgttcaaggccacacagcttatacatgttcctaacctatcatctctcctaaggagtggccaaaggggcctgcctggtatctggggtgaaggaacagtgttcctggccaccttgaggttttttttaaaaaaaacatttctttctttaattctttcttcccatcccttttcctggacactataataggcttgaatattgagaatataccaatagtacttgttcactgtacatttcccaagtttatatgaaaatttaaaaaggaaaaggactgttatttataaatatattagttccctttaattattttctggtgagagagtgaatgggtgagggcaagagcagacataattgtaaccaactgtcaaggataggaagtgtcaaggaagcttcagcagtggttggagggaggtcaaaggtgtaggcactgggcaccctctgtctctgtaggtccgtgggcactgtacacagtggacttcctttacttgcccagatttatctgcttctttcaccactcatgagacatggtgttgggtaatacatgcccaattttttatttttatttttattttttactttaagtcccgggatacacgtgcagaacgtgcaggtttgttccataggtatacatgtgccatggtggtttgctgcaactattgacccatcctctgaattccctcccctcacccctcaccctgcaacatgccctggtgtgcgttgttcccctccctgtgtccatgtgttttcgttgtttaactcccacttatgagtgagaacatgcggtgtttggttttctgttcccgtgttagtttgctgaggacaatggcttccagcttcatccatgtccctgcaaaagacatgatctcattcatttttatgactgcatagtattccatggtgtatatgtaccacattttctttatccagtctatcatcaacgggtaaataaatgcccaatttaatactcatgtcattcactacctgagcaacaacatgtaagacagttaactgttatccttaccctcagcctgttgaattcccatctggtcagccttcactgaagatgtggtcttggtggggatatctgctgaccatgagccctgcctttagtgaaccacatggagaaataattcaacttatttatgtcaatctcaagaaaaaagctgagggctgattttaagattttaagtggagaagccaactttagcttaacacatcaaagaactttcttaaaataaaacttccccaacagagcaatggggtatcttgagaaaggtggtgagcttcccatgaacggatgtattttaacagaggctgaatgatttccgcagggcttgctatagaaagaattcgtgtatttgggcccaacacatagtactgggcacatagtaagtgtacactaaccaatcacagttgttagcaaatctgttcccactctagtggcccttgtttttaccttctccttagtttacagttttatttaaaaaggaaaggtgaaagtggtcagtacctctgttatgtgaaagtttgtcagggttagaaatgtgattgaatgatgctgtgtttttgtagtgctacagttactcagagtagcaagagaggggttttctctcccatgtcctgtggttgatgtaactcacacagatttgaggtcctcagatatttatctggtttatgttgtaacaaaattggattgaagatatttgaaagcagatgcattgatctttacttccacatttcctacaactctttttgtaaagctaagcatttcgaggtgcaaatgagagtttcagagcttgattgattgttgaataaagtcttgcctaccatagtgatcatatttataaaatattaaacatgctaatggttcccttttgtccaaaatgtattttgctcagttactttaaaatagatgtgagaacttcatagtttgcaatggcaatgtagacattagaatttcagaaattttcctcttatgaacaattagatgttttctgctcatatggccttataaaatctcccccatctctgaagatttggaaaacaggtcatgcccagtgtgcttcaggaccaactggagttttccagttttctaattgctagcatctgtttcctacaagaatcactggaccagaactgctttcttggttattgatgggaaacctctcctcaaatatctcaaaatgcttttcagacctctgcccagttagcttgtgtttgtgtgtctgtgtgtgtgtgcacacacaggcacacatatgcacacacacacagatgcacatatagaccatgtattctcaaggcaggggggtaattatcaccccaaaagtaataaaattggttcatatggggtacaaaattacactctttttatataaggcataaatatatacatacagcccttaaatagatatacagtgtatctgtggtattaagtctatataaggggtgattagggaaaacatgtttacaaagcgtccttgagggaggtgataatgaaaatagggtggagaaacactgatacagacttacagcagatatactggagtgtaaatacacaggtatttctgcattcacatacaggccacccatgcatatgatgcatatgtatctgttaggcataaacacacgctatgtagtttacccagggaattgaattcacagtggggcaggactgaattctgtggtctttctaaaattctcttcaataaagaatctctccgtgaaggatttgttttcactttcaggatccccattaaaatatttttttaaaataaactgtcattcttattttgacttgcaggcacttcaattaacatcacacagtcttcaaacacagagagtacacattcgctgtcattctctggaaaggctgcctgttagaaatgagctgggtcaacaattcatttcactagacatctgctgagcatctcctacgtgtggggcatcacagtgtatcccacaggatgtgcaggaatgcaggacaaggtccccaaggcagagtcagatttagaggtgggctttataggtgtgagcacctgataccattgaagatggtaggttagaatggcctgagagtggggaaggggcttgcctcacagcctctggaactcttgatacaactttctcttccatcgctgccctttatcaaccttattctgatgcccatctttcctcttgttaattatttttgctatgatcataagttgttttgatttcgagtgcccctaaagtcttttaggaagtagatggtatgcacaaatccacaacataacaattaaagtctaattttttaaaaatcttgttatggattcacacagtttcaaccaatagctgtgtttgacaaggctgtcaagtatcagtgttgagctcctcacattctgtctcattaacctctctttctactatagcaaccctctgctcacacatacccactcccagatgtatctgaggaagctttcttttccttccctcatccctacattcatcagttctgtagatgggacgtgaggaaaccccatcttcctccaatacaagcctgtctctaggaaatgatttccagaaataggggtatattagtttgctttgctgtgtaacaacttaccacaaatttagcagtttaaaacaaatacctttcttatctcacagtttctacgtgtcaggaatctgacaatggcttagctgggtcctctgctctgtatctcacaggctacagtcaaggtgtcagctaggactgcatccttgtctgtagttctgagtcttcttccaagctctggtgggtgttggtagaattcagtttcttgcagttttaggattgaggccctcagcccctagaggctgcctatggtacagtgccaactggccctcttcacaggaaattcacatgatagtagcttgcttttttaggactagcaagaatctcttttctagcagctttcacccagtaaggccacccaggatagcatctcttttgcttaattcaaaagcaactgatttaggccttgataacatctgcagaaaatctttcctttactatgttctgttagctagaaacaagccatagatcccattcacactcgaagggattatatataaggcatgaatgccagaaggcaaggggatctgggggtcactttagggtctgtctgctgcaggtggcttgagctaatgttcctccacaataataacagtagccagatgcttcatctaatcctcacatggacagcttgaggagagacttgatatgggtctatttcacatgaaaggaacctgagtttcagagatccagtcccttttccaagatcacagagctggtaggagaagaacccggtcttgaatccaggtttgtctgacatcacaccaatcaaacaacaacctgtgtgccacttaagggagctgacagtctgaaatactccaaggttatcattatattgcaaactcaagttttattttgacctttctggatgctcaccaactttgtttaatcttcctaaatttagattaagagcacatttctgatcttggacttggcatcagtatattttgtaaggcaggatgaacacccttactatgtaacaggggttttcagaagaaactgcagtgtgaatgttattatttaaatttttgctgtgaggtaactcacctgcaggcaggctcagagagcttgtgtgatgctacacatttatggttgatgggagtgagatgtgaaacccaccatccttctatcacacttgggtgcttgttggccaactcaagtggttttctaaaacaaaaaggaaacaaagagtaaaagtcaagatggaggattctttgtttcgttcaggcagttatatttttagctgcccctaactcactgacctattgctggaatggaaactagtgacttaaacatgaatggaaaccactttaaaaagtaatagggcattggtgctgcctacagtgaatcagagggtgaagcattcagatgagtgcaaaaagtctaccttgttttgtttgatcttaacaatacctttcatttgtaaaacacacagtagcctaaaaagaatatttgaataattatataatttaattgtcctaacaaccctgttcacatgacccaactttccagatgaggagaagagtttcagggagaaactccatgtcttccccaaggttgcctggttcagaggaaaagcagggtcttgtgcatagggattcacttccaagctcctattctacacttccctctcaagaacaaagatgcatatatggatggagacgtcgctggagagagtgcatggatgtgagatgaatcccatcatagatacacagaaacacccaggagttagacccagagtttagccatcaatgtcctgatggtgaagttcctcaaattgctagcccaggggtggggttttcactattgcctcctattctaaagggcagatattattttccctgcaactctgcccattggggaattttggtatctttaatgggatgcctaccttgccccagctaacttctggtaaattttaatattccctatttacaaaacagaaccactgcagagattgctataaagagcaaggtgggcctttctcacttgaccattcaaattaaactatattacctgacttacgtgcttattaacgtcatgagtacgatgttgtaagggcagcactggagatactggtcaaacagtaatattatcaccatagaaaactggtgaatctagaaaactacttccattgatctacatttcaatttggggatttttcttaatgtttttaccaaaatttcaaagcaattctgacttttcctagccaaaatgatatcaccttttttacagagataatatcaggaatgagaatatttatagagctctacagcttccacaggatgctgaggctaattgtcagagaagctggaaaagggtgtctcaggtcttagtgatgacaatcaggaaaggagacaatgttctcctaaaacaccacctggaaagcatcggtgggggtggggagagtacttaatgtcagagtcaatcctgttgtgtgtctcttcctcctcccaacattttgacaagagtgaaacaagattcaaatggatgtcaaatgcagcctagaaaggcagacagaatcctgcacatcagcacttccaggctacagagcagttctagccatgggggcagaagagtcatgctgctacctgggaaggggagagccttggaccctaggtactgaccctctgtattcagaacccaagcctcatagactgagactggcctttagctttctccccaggtcattccccctctgccagtggctgcagctgcactgagcctgccagaggtcggagtctggcagaaaccccatttgtcttgacctggaaaggatctgccctcctgtgctcacactattggctgggccagcaccacaaagcgcaagggaggaacttgagaagtcagcagcagcctttgttctcaaaatgcttatgctgtgatttcatactctttctaattttaatctaaacttaacctttgaaggcaatttaatagaaccctgctaaaacaaggataatagttaagcgtggcatgaatctcctcaggttttttaatggcaagtagccacagggattcatgctttggagagatggctggatcagatgattcctaaagccccttgtgatggttaattcatgtcaacttgactgggccataggaggcccagatagttgatcaaacattatcctgagtgtatctgtgagcttaacatttgaattagtggactgagaaaaaatagattgccctccctaacgtggctgagacttaatcaattgaaaacctgacttggcagagtcatgggggcagaactgccaccccagcaggctaagaaggtgggatatcaaactaaaaaggactattctcagaccttaagatctaataaaatttgccttgctaggttttggacttgcttgggacccatcacccctctcttctttccaatttctcctttttgtaatgtttatcctatgcctatcccaacattacattttggaagcatgtaatgtgtctgatttcacaggttcacagctgcgaaggaattttgcctcaggttgagtcacacctcaggcctcacccttacctgatatagatgatatttagatgggactttggactttagactttagaattgacactggaatgagttaagacttttagggctgttggggtggaataaatgcatattgcatgtgagaaggccatgaactttggggggccagggacagaatgcagttgactaaattgtgctcaccaattcatatgttgaaatcctaatcctcaatgtgactgtatctggagatagtgcttttaggaaataattaaggttaaatgaagtcataagagtgtagccctaatccaataggattgggggatttataacaagaggaagagagatattctctctctctctccctctccttctccctctgtctaccaagtgaggacagagccggaaggcagccatctgcacaccaggaagaaggcccccacagcaatcaaattagccggcatcttgatcttggatttcccagcttccagaactgtgaaaaataattcttttgttgttatttaagccacacaatctacaggattttgttatggcaggctgaacaggctaagactttggtgttgtgattataacaacgatacaaaaatctatcttatagttccctcacaggtcaaccctgactgtcagctaacaaaacaataaacactttctggatttcatctgtctataaggcactgtagagaatatagacatgtgtacaacatgtttctttctccaatggagaccacagtttagcagaagagatagagcttaggtgtgcacaccaactggaatctaactttaaagggcagcagaaaagcatgctgaatgttgagttcagagggaggggccataacttctggcaggacaattatcaggaaaggttttgtagagtgagaagtgatgttaataagtgtctctaggaagcaaacattttgcagagcttcccacataccaactaagttaatggggtcaaatgcttgggttaagtccacagtgccactcatgttgctattctcagcatcttccagtggctgccagtgaaagagtatcaggtctccagttccatgggcaacacaagaggcacactgactttcaagtgagacacactgccactgatacatgtgagtagttcatggaaaatgactcaggttaatgctatcctggaattgtgtacaaataatatgaccccagggtcttctgtccctgcacaagactcctttaagttgggcaaggtcacatttactgcctctttataatcaaagcaattaagtgaccccacaagtggtttagctactagctgctgtacttgtggaatgcaggggagattgtatccttaccagggtctccacccagtgaatgagcacagaggaaatctcagctctgaaaaccaaacaggacttcataacttcattgagcccagttgttttcaaatgtttcctggtggcaaggaattctttgttatgtcaactaaatcatgtgtggagcctcactatagaaaaaaaagtttaaagaaggccttctctggcttatcctggctgtgtccttcttgaccccaaagtggcccttaaggcaccctcacaaaaagctggagcagacaattctaccctttccatttgcagacatcactaccttcttaggctacaatgtcctttcatcagaatgaatgcatggcaggatttttacctgcctgaggtcacacagctaatcattggccaagctgggagtagaagctgggtttcctgactcctaacctagtgctcctcaccatctgggtagctttattcaatggtaccaaggattctgaccaccctgcattcctgttacaccaaagaatccagtgatgctggggaaatcaatgatggtgtgtcaggatctcagggcatgatcagggttaaaggcactgtgttagtctgttctcatgctgctaataaagacatacccaagactgagtaatttataaaggaaagaggtttaattgactcacagttccacatggctggggaggcctcacaatcatggtggaaggtgaatgaggagcatggtcatgtcttagattgtggcaggcaagacagagcttgtgtaggggaactcccctctataaaactatcagatatcctaagacttatttactagcacgggaaagacctacccccatgattcaattacctcccactgggtccctgccatgacaggtgggaattatgagagctacaattcaagatgagatttgggtgggtacacagccaaaccacatcaggcaccaacaagagataattgaggcctatacatgggagaacaactacaaggaccctttacttagatctgaccctttacccaaaaagagtcactggaaggaggatgacctttggaaaagggatgcagccaacccagagtggcctggtagggatggggccaaggcaataaatacccaacttcgcgtgcattaggacttctgatcctaatgcagccagagggcagggagccccttgatgctattcccactgtcagcctccaggccccaagcagagtggtgaggctagagagcaggtctggagggacacagaagcatttccaacccagctgctaagaaaggagtcacttcactgttgcactgcatcgagcttattgaaacacagtgttttggggatgagcctgctttttacagaaaggtacctatgggaagaaattaacaaggaggtcaaatacacatacttcctgctctgctgtactaaatggcacagcaacttttagattctcgcctgaaaattagagtatatgagattaaaccctgaaggtagaatgaattgcttcatgatctgctccctgttatctctctgggcccatctcttaccactccctacctcactgcccaagtgacaaccacactgaacaacagctcagggctcccagaggggccaggctctttcttctctcccacaggtttccctctctatgtggatgttccttaccccctttgccagggcttagcttctagaaggcctttccaggccctccctccagcatgaccaagctaatttcagtgtctctcttgggtgttcccacatctcccatgcactttttcactgctcagatcccattgccttataagagtatgagtgtgccaaatgttctgtgtcttccccgtgaggcagctatgacgtcaaggatggcagttaccgaccttgtttccctggtattaagacagttccaggcatagagctgctcgatgaatgtctttggagggaaagaaggatttcttgagacccagtcatctcatctttaaaaagaaagaaaacatcatggaaacctcaatgaattcttcattagtgattttgaatggatggctgtaaacaaagctgctcgctgaatggcttatgtttttcctttaaagtccaccatcagaactccattttgtgggtaactagccccagcgaaggcaagaagaccatgaaagccttgccctgcagtgaccaggggagagcatcctggtgacctgtcatttgcaaacatctgtatgttgtttcaaagtttatgaagcacacgtactacattacctagaacctcaaaacaaaactgtggaggcggggcacttagtacaagtgtcattctcattttactggtagagaaaagctgaagctcccaaagtcaactgtctcgtctcaaagccacacagccgggtagaagtcaatgtcaagctgggttccggagcacctgtcaaatgtcccttccaccccaacatggtgagtccagggatagcacaggtgacagtactggcattgcggacctgaagacagcagactcccaggccaggaggcctggaaagtactcgagaattaattctacacatccctctcatcttgagcacaaggaaccaatgcactgatggctcctctaatgttttatttgtcttttaatcccaagtacttttttaaatctctaggggaaaaccaattcaatttttgtactagttttctctttcctttactatgttccactaagtgctttcccacactctctttgactcttttcttgaagggcctaggttctattcatctctgtgatgatgttttctttcaaaaaatggtttttctgaggccctactatgtgctggacattgattttagtgctgggactacagcagtgaacaaaagagatatggttcctgacttaaggagtcttgtgttctagtggatgagacagagaagatataaagaaataagtcaagtaatttcaggtgataaaaagtgctattaaggaaataactggaggactaatttaaatgggagaagggtataaaagacttatctgagaaaggcattatatttcaggcccgaaggcaggttcttagcccttaccaggtgaggaaatatttggtgattgaatggatgtgtgcatacatttaaatgaatgaatgaatgaagggttgtctatattctctctttacacaggcattcccccaacctaccttgtcctacctgttgcctacatgccagccagtccatacctgaatcttctatgtgtcttctcagagatcccaagcgtctgtaactcctaaggccgtgatatgcaggagcagggtagccagagcggagctataaggaatgccacaatcgctcttccaaccgattgttacaaaactcttctcaatggtgtgtcttgtgccaagcattcctcttcctgtcctgagggctgtatattgacatcacttacccaaacccaactcccactaggtagtatagggacactactcatttgatgacactttggtggctctgtgcatgacagcacacaccctgtcccagaatatatgcatttttatggcttcctagtaagaatactatccaagtcctccccagcattcctctcaccctccctccctgtgctgctgcatgaactttagatcaggtgaggtcaggcagtgaaaaagtccctgggcagaggtctgaggatttaacagatttgttgagcattatgatctctcactgaatgtacgttacaaggaagcccacctcctttgttttattggcatttcattttcttccatttcccagaccttgtggccttttccctgtgcagctcataaaagtaggcaaccagccttagtaattcaccttatgcttgaatcgtttctcaccttttaccaaggcttattccatttctagatttctcattattcttttcagctcttacaaactccaaattcatgccatttagactgattcccagaaaagagataaaagtgtcagtcagtactaaaagcgaatcattgacttcttaaatgtcccttattaaaaccactcatctatgcagccatgcaatctgagacaaacagagttgacccaagtctttatctccatgtgtaaaatgtctcatgagttgcagagtcacataccacataataacgtttcagccaacgacggaccccgtagaagacggtggtcccataaaattataatactgtatttttattatgctttttctatattttgatacacaaacacttacccttgtgttacagttgcctacggtgttcaatatagcaacatgctggacaggtttatagcctaggaacaatagactacactatataacctaggtgtgtagtaggctggaactatctaggtttctgtaagtacactgtatgatgtttgctcagtgacaaaatcacctaaagatccctttctcagaatgcatccctattattaagcaattcgtgactgtataaaaaaatttataatatcatgaactcatccactgaaaggactggaaatgccttagagatgaacaagcttgattcatgaggacactgagtcccaagcaggagcagcaaggacaggccccaggtgacccaaactgataagatggagtcaggacaagaatcacagcccctgcatggttaggtgtccaaggtttgttcacctttccaaactacaggttctacagctacctcttcttacacagaaaccttcccctaaagctgagctccctcacatttcccgtttctcatattgtctttgccatcttccaacattccaagatcaaaacctcagtgtcatccttgactgtcccctatatttctttctttttttcttttttttttttgagatggagtctccctctatcacccaggctggagtacaatgctgcaatctcagctcactgcaacctctgcctcccaggttcaagagattctcctgcctcagcctcccgagtaactgggattacaggcacctgccatcatgcccggataattttttgtatttttgtagagatggggtttcatcatgttggccatgctgatcttgatcctcaggtgatccaccctccttggcctcccaaaatgctgggattattggcatgagccaccgcacctggcctgtcccctgtatttcatcagacagagagtcttcctccagagtggttcccttggtagatgcccaccaaaactgaacagcaatatgaaagtgcaaggttttcctcccacctaggcctggcccccacagaggtggtaactaagggagtccacattgtatctcattgagtatcaactgcttacagaaaaggaatgtaatatccattatggtctttgataaatatataaatcagatttgcccactgcaaagcacaagccttgagaaaccacattactttttgaggtatatttagaagctagttgtttaattttcttggaacttacatatcacttacttctggctccttatttagtttgtaaaaagttcaggatgtttcaaaatttcagaaattatataagtagatactactcatctagtaagcacgtgtaaaatgaaatagcaataagacagaaaatgaggccaggtgcggtggctcatgcctgtaattccaacactttgggaggctgaggtgggtggattgcttgagctcaggtttcaagaccagcctgggaaacatggaaaaaccacatctctacaagaaatacaaaaattagccagacctggtggtaaatattgtagtttcagctactcaggaggctgaggtgggaagatcgcttgagccctggaggttgaggctgcagtgagccgagatcacaccactgcacttcagcctgggctacagagagagatcttgtctcaaaacaaaacaaaacagaaaatgaaaataagcactaaatgaacctgtaataagggtcaatgcatgcttcaaataatgatctttgagcttctaagaaggcaaggagggaaaaaagacacaatgagttatagaattctctttttgagagtggaagaagacaatttcttggagaagatgaaattccctgtcattgaattactttgaaaaatatttttttctatttataaaagtaattagataacttctgataatgttttggtttctttctaggttttttttttttaattattggaattatacaaccgatacattttgcagcatgctctattcacaacattttatcactagcattttcccttaacattaagtattcttttctttgtggtgatagattctaaagccatctctctcctttttcaacttttatttttgttttgggggtacatgtgctggtttgttacatgggtaaattccatgtcgctgaggtttggtatataaatgatcaccgtcacccaggtagtgagcatagtacacaataggtagttttccaatgctcaccccactcccactctaccccctctagtagtccctagtgtctattattcccatctttatggccatgtgtattcaatgtttagttcccacttataagtaagaacatgcagtatttggttttatgttcctgcctttatttgctacctgaaacagcatggtactggcataaaaacagacacatagaccagtgaaacaggataaagaacccagaaataaagccccatgcctaaggccagatcttcagcaaggttgacaataacaagcaatggagaaaggactccctgttcaataaacagtgctgggataacaggctggccatatgcagaagattgaaactcaacccctacctttcaccacatacaaaaattaactcaagatggattaaagacttaactgttagacctaaaactataaaattcctagaagaaaacctaggaaatgccattctagacatcaaccttggcaaaaaaaaaaaaaaaaaaagtgactaagtctccaaaagcaattgcaacagaaataaaaaattgataaatggaacctggttaaactaaaagaacctctgcatagcaaaagaaactatcaacagagagagtaaacagacaacctacagaacgggagaaaatatttgcatactatgatgcatctcacaaaggtctaaaaggccatttctcatgtaatggtttataagtagtgtgtggggatcactcaaaaatataatgaacaatgccatcaacgttttttaaatagaaaatgcagtagaaattttgggtgattatttcatctagtaactgtaaaaactgaggccagggcattaaaatgtgattcaaggagaatgatttttcacaggtgctaatcttatgcagtaggaatatctaatcttgtcagcccaatgtgattcaggacaaggcagaaggctggaagagtgggtggagcccacatagccttagtggaccttccctaaatgtcacttcccagagacaggctcttaattcaaagctgctttaaggttttgagttaccagggaatctattcagctagttcagtctttaagatattgaacaatgccttagtgaatgaggaaagaacgtgacatgcttagagggtctcttgtctattcaaggagttactttggactggagaaaggggaggaaatgccccttcccctgaactttgaagattggtcttcagttagcacatataatacatgtgtcctgggtcttcatggcactgtgagatataaagggaagattcttattctaacatttttgaataaggaaaacaaagctcagaggaggtaaatgacttgtccaaggttatatcccagtgaataatggaaccagggctccacttagtgttgtctaacctggtccgtggctgttgtgtatcccaccctgttgtgcattttttttcaaactctggctgttgagctcctttggaaggctgatccacagctctctcataattattttctgttttttttttttttaatggagttttgctcttgttgcccaggctggagtgcaatggtgcaatcttggctcactgcaacctccgcatcctgggttcaagccattctcctacctcagcctcccaagtagctgggattaaaggcatgtgccaccatgcccggctaatgtttgtatttttagtagagatgggatttcactatgtgggtcagctggactcctgacttcaggtgatccactcgcctcagcctcccaaagtactgggattacaggcatgagccactgcgcccagcctcataattattttcaatcccaacttctagtacagatgttctccaagtgtggaccctacactagaagcctcagcatcacttgtaaaagtgttagacatgcaaattcttgggccccaccctggacctactgtgttttaacaaggctttcaaatggttctgatgcatgctaacattggagaaccactgttctagaagttcttaataaatattgttgaatacttcctagaatccccatagaccttcactgaaatatttaaaatatttaagaatccccacatatatttttattggaaagcttacgattcctgctcaggaatcactcattgttagccatccccagtcaaagagaagagtattttatcacacaatgacaaggaagcccaacactaagttctcggatatggaaagcactgaggggaaaaaaggcaccatagatgggtcagaccaggtataagatcataatgtaatgctgtttattgagcagttattttgcaccacaaactatccctaaatgctttacatggacaataaattcacaccacaactttttaagtaccacaccatatttctactttactgaggagcaaactgaagccaggaaactttcccaagattacaaccctagtaagtggcaaagcctagtcagacccaaagcccaggagcttccctgctattgtcttttgtcttcttgctctgttgcttccagagaaaaaccccaccactgcagcaagctacagggaaagacgctgagtggaaacccactgggcatcccttgcacctagaacagcaccccacacattgttgatgtttagtatttgtcaagtgaatgaatgaaatgaactatacacaacataattctaatagaagtagtctgaagaggatttccagggaagatggggtctgagttagtatttgaaagtagagacagataatgctgtccaaaagagagaaatgacatgaacaaaagtgcagacatagccaacctgagcctagtcagaggaggtgggcaagctgtttgcctagaggggaggggaggcaggggaagaggtcttgaaaggggagaatttataaccctggaaaaagaaagggtccctgagaggcagctcaaggagtttgaattttatcctattattagtgcaaagtcattggagggttctgagtatgggctcaaaagggccaaagaaataatttaggatattgtatcatatccatttttttatttttaatttacaaaagatggagggaaggtagctgggctccagatctggggggtttgttgaaatagcaactaaaagatcatctttcaaaaaaagccacataccattttgattcattacaatttgaatgtagcaagaataattacaatatgcttgtcattaaagcttgcactggaatttgataaaaagaggtttatgtttcactataaacacctgaagtggagtcataggaaaaagcatgcaaaatccaaaaggccacaaagtcaaaaataaagaatgaaaaagttactataatccttgttattcaagggtgaaataaaaataatcacccaatctgtttatttaaaataaatatttattacaaatatttattataaatcaactatatagtttaaacaccactttcttgcaaaagacaaagccctgaaaggaaataatttattcttttgatatgtgggcagatctgtatgaactacattgctcatttagcaatgaaaagtcaaccaaacatgggaagacaatatgcacattgcatacatacagcacacacgtaacatccagccctaaaaagcatcagcaatatcccttttgttgttgttagtgttattttccgacaagctgccttttgtctattctagttaatgttaggaaacctcataggtctatgccattataatgtccattacccatttgaatatttagacagagtctggagtgattattaatactgagaatcactacgtttgatccagtgaaggacaaaactgtagtacgatgaaccaaaagtactaagaaggggttatttgacatttttaactgctttgaattgaataaagtctgtctgtgcatgggcattgtatgaatgagtttgccattaaaagtaatggcaaaaacagcaattacgtttgcaccaacctttattaaatgtaagcttctatgtctaaccatgccttcaaattcttttctgaaagtagaaatgcatgtacatagagtgaccaactcatcccagttttccagggaccttcccagttttaaatcctgaaagtcctggaattcccccagtcctaggcaagctgggatgtctactcacactacacatttaacaaagaaagaaacaagcagacaaaaaacaaatctaccaagaaaataataaaaatgaaaggacacttttccgatgtcccacccagtagtaaacgctgcttcccaagacatgaaaaacatattgttgagtctcctatttaccatttattccattctgccgtatacgtaatataattattatattaaccttcatctctccataggtgactggaagctataatcacttccactgatcagagcccttctatgcacatggtctcatttgacccttgctgtcactctttgtgataggcagagaaggtgtcagaggcccagagatgagcagcccccacttcttaggggagcatcagcacaggaacccaggatttctgattcccagtctggtggttttttttccatcactgatcatttacattctctttatgacattcaggccctggtcctttacctatataacatagagaaataggctatttataatttacaacataaattaagccaaagacttttaagcactttttaattatattgtatacctttcaagtgagggtgatgaatggtactgtacccctatttcatagtaagagaaatgaaggctccagctaacttggctcaagttgtacagcagttgcaccttagagattgacaggtaacatattgtcttgttctttgtaatctgatatacttggatttaaagcacatttcaagattttttttaagattagcaacataactatatacatatatatttaaaataaatgtccatattgatagagacctagacagaaacaagcacttgcctgccccaatgagaatctgagggcaccactggttcctggcacactggactgaggatgccatctatacatgtgttggacagtcactgttggccaaagttaaaatatacattttaactttgacagaaatacttttgtttcagttgcatatcgaatgacaggagccacgtgggcatcactttaggatctggttactccttggcacctaagttactttctatttcattaaaagtctttctttcatctttatttgccattctcctgtatctgctacatggcaggctagtgggcttgaatttgctggggtttccagtccccaggtcaggccgacccctgagtgtgcctcaccaaagctacatcctgctcactctccagttctaaatcagagcctttggaggcacaagtaaagggacccaagggcagatcagaggggttttcctcttcatatattctttctttttttgtcacctcccttttagcttactttatttgttttaaaaatacaagatgactgtgacaactcaaaccttaaagaaatatataggtctacaattctttatctgtaatcctgaaattcaaaaagctctgaaaactgtaagttctttcataagtttgtggaaattcactttgaggcaaaacttccttgaactttagagatgatttgtagtccatctttgccccacttggtgctgtggagatgtgattataacagacttgattacagcagtgtggtgtcccagagcctgcagggggtggggatggggttacatatatatccacacatgttacctttctacattccaaaatattttgaattttgaaacacatctgttcccaagggtttcaaatatttctttgcttgaaaccacataaagaaaatatgaagactctcctttcacacaccccttgaatgcacccacctgaagaaactgatgttatcagtatcaggtcctgccctcaactcctctctatggcatgccctctctctctctctttctctctctctctctctctctctctctctctctctctctctctatatatatatatatatatatatatacacacacacacacagtagtaaacactgcttcccaagacatgaaaaacatattgttgagtctcctatttaccatttatttcattctgccctatatataaatataattgttatattaaccttcatctttccataggtgcctggaagctataatcacttccactggtcagagcccttatatgcacatggtctcatttgactcttgctgtcactctgactgataggcagagaaggtgtcagaggcccagagatgagcagcccccacttctcaggggagcataaggacagaaacccaggatttctgattcccagcctggtggttttatatataaaactatatatatttctcctctctctcacacgtacaatacgaacacatgcaagattttgtttttaaatacaaaaagggatcacactgttcttattactttgtcatttgcctttttctcctactgtgacactccctctagaataatacataagaatcaaactcatgcttttaaatagctgtatactattctatcatatggttatatcacattgtaatcaactattctgctttttttttttttgagatggagtcttgctctgttgccaggctggagtgcagtggcgccatctcggctcactgcaacctctgcctcctgggttcaagtgattctcctgcctcagcctcccaagtagctgagactacaggcatgtgccaccacccccagctaattttttagtagagatggggtttaaccatgttgtccaggatggtctcaatctcttgatctcatgatccgcccgcctcggcctcccaaagtgctgggattacaggcatgggccactgtgcccggccacctattctgctattgatgaacatgttttcatagtattttgcttttgaggatcaaatattagtgattatattgtaaaaggaatatatatctacagggtttaattcattttatatatattgggatgttggttggcaaaaacaaacaaacaaacaaaaacacccacaaaaaaacacatttctctctgtcatacaaatagaaaccctgagacaaagggtgttcattttaaaaaatgaaaagaaagagttagctgcaagcgagttatttttcctgcaacaggcaggctttctatgaactagaggttgcacagaggcagactgctaagccactgaactgctcagccatgggcatcaggagctctcaggacagcacctttagagagcccagtttactaacccagccatgtcatgtttccataacttaacccctggaggtagggtccgacatctgactggtcccacaggcaaagaggcaggtaacttcagggggtgcaggatggggcctgttcgagatgaacatgctcagtgactctaggtttggttggcttctaacagacaagccaagtcatggaatttcaataaataatttaacctcagctccagtttcagcttcagtgtccactttcagcacctggctgccattgttatttgcaagcaggctcctcctctgcacgaggtatggaaatttggcagagattcactgacatttttagaacccagtagggccagattactatgaacaagagtggagttttgtttttgtttttctttttgtttttcctaaccaagaattatgtgaaatctggatgtgcaaagatgcactttttaaatgaaaaagaaaagctggctatcactgacccaatgcatcggttttaaaggtcttccgattgttgctgtatgaggcctttatcttgcaaaggttctgaagaccagccttctcaaacactaagaggcataaatcacttagaggtcttactgaaaatgcaggttctgattcagtaagtatggggctggcctgagaatcttcatttctaatgagctcctaaaggatgctgatgttgctggtctgtggacctactttgagcagcaaggctgcagacaacccagaatttcctcctaacaagaaaactatccctcttagggccttttctgggagttccaggggagagataaaaagctcttaatgagacttgattgagagataaacttacaagaggaccctggagctgtaggacattgtgttctagctggaatttcaatccactaacaaagaagacaggatatggcagtggtaggttccattattgtatgtcatcctttcagagcacctttgatcctcacagagaactcgtgaagtaggtgggcagctgttattattcccaattacagggatggagacagctttgaggccaattcaagttatctttgttttttaaattattttctggttgaaaagatagagagaaaacacatcttgctgaaagctaatcacataattgcaagcgctatacagtaaaagtccttgatacccatactctacttatgttaaatttgtttctaagccttgtttctgttctgccctttggtatgtctctgagacactggtcttttcatgcaggctacattttgaacaactagagtaaatgtgtctggccctgaactgtatcataggactgagaagagaaaagtaaaacaggatctgttttacaacttagtagaagaaactcatgttacagaaaggtccataagagctaactaggaggacataggggaaaattatgcttctcattttagctttgttcttatcttttaattcttcagcaggcctcttctctgtgtagaagagtcagcagaattgcatctaaggttgactttataaataaaacatgtcatcaccaaataatgcttacattctgtcctacgaatcctagttgagacctcagaattttctatattatgtttccagcagcctccttcaataattggcagatgaagcacaagttgcaatgtttctttgccattcctgaggctccatcaaaaaacaatttgaaggggctgatcctaaacattagataggatctagaagactatctgtcattaatgctcgaagttcatcacgtagcatcatctgttctaaacatagtccaacaatagcaggcttccttccttaggtgggtcttgtacgtaaaggaaaggttgggactttggctcaccctggcttaagagggtagaaatagtttggtgggggtttgggtggagacgagatgaccataataaaatttttttaaaaacatgtacaacaaccctgttcggcaccttcaaactaaataagatataagtgatatgctttgttgattgtcaacgattacatatacttctactctagacctatggatggaacaatctctgctagaactggaaatgcattttcacatattctatataccagatggctgatttgaggaatccactctgtggatagtagtattagaatgtggtacccaaaatgtagttctttttgtgcttgtgaatttgaatgccccaagagcatcatagcaaattctaagacttacagaaaggatccagtagaggaaaaagaacaatttctgtacctcatttattttggagtccaccaatggggcagttttgtatttttataatggccactttcagttttttctcctagacataaagtggagaatttacattagagcttttcataagcagggatcacctctgactcctttgtgcccaatgaacaagtgagcataaagagaatcagagaattcagatgtaggcattgtctagttgtcccttcatttcataggtaagggtgcagaatgccagatcgagacagtgacttgctcaagggcacattcatcttgcagaacaactgggaccagtatgcaggttgtctgacttccaccagtcaggcagaaaagcagggtgggcaatctgtctcttgtaaatgcaaaggaacttgtgagagaaaatatggtagggcttggaaaaattccctttttgaaaataaccactgactccttcatctcaggttgtggcttcctgggtgagggcctggactattgtgtgtgtgtggtataattactgggtaggtttatttttttatgggagtacaataaagagaacatttcctgccttactctgccatttgaaaaagattttcatttccccttttggcctggggattacaaaagacagactcctttccaattacagctcggtctgagcttgaacatataactcagccagcagcaagttcaaattgattttttttcaaggctgagaaaacgaaattgggtcttcttgacacaaaaactggcttggttttttctgtaattgtgaggctgttttcaaagctcccttctaaagcagaagatataatcatccaggactaaccacagtcttcactgtaagttctataggggctcagaagaaattagttgggtgggcccacatgacaggggcacttggctgggagaaacatttccctgttgcacagtggcagagaaggactttctccagacctgtgacctttaatgtgctggctgggggtgaggagagggaggaaggaggaatgggcccagagggcagagtgaccttgaagatggcagatgcactgagtgctttctgccaggcactgcgcccccattttacttgtgttatctcccctaatcctcccaatcaccctaggcgggagaagaaggaacatagtgagaaaagacagctacacagcttcccttctatccttcccctgggagctcaggacctgtcgtaggagtgtggctttctgtctttaccctgagtaaatcctccacgattaaaaaaaaaaaaaaaaaaaaaaaccttgatgtgaatgtgaatccataccattcaataacaaggcaggatttttcttcctctgtcttcagcagtttactcttttaagggaataaaatgaaagataagcaagggttagcaggaacatctctcgaagatgactttccaaaggattcagttctgtttttcctgtcttccctgattatgtctaaattacatacgttcacgattttgactgagatttcagccatctccattcaatagcaaactccatccctaccgatcgtctatgtggccttggaaaagtcatctgaagtctttggatctcaactgccctagtctgaaggagttggatagagcaggagggggtgggggcggggacatggggtggggacagccttccaaaaagggtgcttcttcaactgctttttaaggtaaggtgctgagaatactatggaaagatgctacagagaagttgtgagaaggcagagcccagaagcagctagcaaaggtggtcacaggtggttcttcctttgtggcctgattttccttgcaatctacagtgctggcccctcccctgcagatccagctgcctgtgttttcagaatagaatgctagtccacaagctctttcatcctctcggcaaacatttatccagcccgtgctgtgagccatgcatggtgctgggagagaggactgtagtagcttgtggagtctctactcagccattggaatttttaggtgcaaataaaagatttagttattttcaccttctcctagccacattttaggaacagagtgtctttcaagcccatcttttctaatttattcactttaaaaataacaagattaagacccagagagggaaaattacttgccctaggtcacacaactctttgtgccaaaactaggtctggaacgcagaactcttaatcttctgctttttattacattgccccaaattgcttaaagggctacccagggaattcagttcaccagggaacatcttgcttctccaaacattcttgctaacaaacatcttactgcacaagtataggaagatgtcactattacaaattcatagcactcatattaacggcaaagctaaaacattcctatagtcacccgcctccaattaattaaaaaggaatgtgttgtttttgaagtcttgcccttccaaccagccttgaagtaattttaaatagaaaattttaaatggaaattaaggcagttttgtgataagagtgcctgccctttggtctggggcatccattgtgtgagctagtttttcagagctgcagaagtaacaagttggcaggatctcacataggagataatagataaaaacctacatgtctggtttcaggacccccaggaagctattgttgcccttcttccttctttcccagttctttaatcagtttctggcagacacctgcaaccccactattgaagcttcatctcgttgcttacatctgggccatgataaataaaagtaccccaggaggaataagtgcttagcagttaccaacaattcatacttaaatgtgaatgctttcagagttggcattgagagatacaagtggggagaggcatgctggccaagagtggctgaggggtttagagatgcatgatggtggagatagcagattgggaagacacagagacccccagaagatgagcatttgactgccttatggctttgcctgtgactaggctggggtcctcagaatggaggaagaaagggaactagagaaattctgcatgggttttcctaatagagcatgaagaagatctgcttggaattccctgcacacccactgatatggtttgaatgtgtgtccccgccaaatctcatgttgaaatgtgattcccaatattggaggcagggcctggtgggaggtgtttggatcatggggttggttccctcctgactttgtgccctccccatggtaatgagtgagttctcgctctgatagttcacaggagagctgtggtttaaaggatcctggttcctctctctctctctctcttgcccctgcttttgccatggaaagtgcctgctcccattttgctttccactatgatcataagcttcctgaggccctaaccagaagctaagcaaatgctggcatggcacttgtacagcctgcaggaccatcagccaactaaatctcttttcaatataaattacccagtctcaggtatttctttacagaacacaaaaacagcctaatacacctgcattgttcaatccagcctccaggcatgtgcttatgccatcacttctgcctggatggccttacctgccactttgtatgaataaactctcttacctttgaggctcacattaggcattgttgctgccccaaatccttccgtgaacccttaggtgggctccttcctgtccccactccacccattctctactactactgcacttcagtgatgacctggccatcatgtctttaccttttgctgcctctgttgtgtgatagcttctcaagagagggaccatgtctctttcatcaccacatcactacatccccagtctctggaaccaagctggcccttggtaaagatgcccatctggctgtgtggatccaccctgcccaagtggccaagtgcctgcatatagttgagagtggagatacagcttgctggtactccacgcagccaagaaagcccaaaacaggaccttatgaggaccctgcattttttaagaagccacatttttcaccatggctgactagaggaaggtggctggagagaacaaatgtggttgggtacatatggcctgtggttgaccacatgagaacttgagcccagtgactagggtttctgtacccggtcacagcacactctgtcaccctcagggaagacccacctggcagaacttaagagttctgtgtggagatgcaaccataaaaatatcagttggcacgtgaagttcttggcattgtttatggctgcattgacttgaggttcttcagacatcttgatccaaaatgggctctccatgccctgaacaactcaaaatggtgcacttctttcagggcctgtgcagggatggaaggtgaagaagaacagtgtagaaatggggtgggaagtaggagtggggccaggatgtgaaggagtttccagtttaggtaaggaaaaaggaaacaaaaagaggagggagaaacaacgtcctaagtgctactgtcggtggttggtccagcccgtcacacatctcctgagcccagagactctgatgctgcaagtctacagtgaggtcagggagctcatttgtttctttgtttgtttaacaagctcctttggtgattctgttggacatctcccactgtgggcaccactaggtcagaagttgtcagtcctgactgaacattagaatcacctcgagaacattgagggaaaagaattctgatgtctgagccctacccccagactaattaaatcagaatatctgagagtggggcttgggcattccagtttttaaaatgcttagttgtgtggaattttcgagctctaaaaacatactttgttgacatatcataaactagtaattttgcaaaaacttttttcataagttctcagatgtacatgaccctaattaataaacctcaggactcagatttcattttagtgtcataagctttcaatttgttatatttgagtttgggattcatgagtgattattgaagccaacagagagctaggatgacagattttgggatgtctctaaagtctttccagcccagcttatcctattaagaggctatattcaaaactcaacattcagacaaccagaacagaagggcagatgagtaataattgaggaatctcagctatgtcaggatcccaaacaccaacctttgtaggagtagcagagctcaatatcaagatatccttgtttggtatgaggattataggaattgcaggcttattccttaaatatagggggaatggattcacgatcaagagctgccattaatttccatagcatcttggataacaaataagaaaaatgtcaagagaggaaagcaaagcttttgacagtggcctcattaagtggaaaacatatttcctgtattaggatggggattctccaagggaggcttaagtgaggagacctcttcttcaaattataccaatgtggaaaggagttctgtttatttgaggctatagatttgtattgctctttggtttcctgtgttttggtacatttctgaggtggaagaattccagatttcaactttcctgaaccaagcattgagagccttaatcaggtctaaagaataggatgacagtaccttaaagagctgtgaaaatgtttccggatgttgagagaacacaaaggcttccaataaacttcaatagaaaacttccaggaatctgtcccggacctgatcccttagcttcaaccatctatattccttgggttccagcccttctcatctttgactcttgaactacttgaaaaaggtgtttggttggagggtgttgcttttcacagaaattcaatagtcttatagagaacagacatgcatgtatctatcattgtaccaatagttaaccaaacatgagtcacttttccctctctcccttcatagtaaatgcatgactgacctagtttaggaacactctcctctggccaatgaacaatagctgtagttcttcatgtattttctttctttgttgaatttattgcttcatacacaaaaccctgaacgctaggtactgttgaacttttgtgccatcaaagagaggtctattgactcttcatcaaggcataatatttcataaatagggtgtttaacaagctcttcctaaatgtttgccttctgcggccataaagacagtagctgtaaatgtataaagtaaatactatatgttttatacatattgtcatccaattatacaactctgccaccaatttgaagataaggggcctgaagctaagtgtgtatgtgagttgcctgctgagtaacaaaccagcccaaaacttagtggttttaaacaataacaacatttattttgctcaaaaacctgcatttggccaggacttggttagaatggctaattttacttcactagatgtcatttgggacaattcaaaagctgggggctggaataatctgaaatctcattcattctcttgtctggttgttgaggcaatctgtcatctgaaaacgttgctgagactattagctggaacactacagagaacctcttcatgtgctctgggcttcctcacaacatggtggctaggttccaggggcaagcatcccaaaagagacagagagagagacacaggcagaagctgtatcaccccctattacctaatctcagaagtcacacattgtgtcacttctgccatattccattcatccaggcagtcacaaaagcctgccctattttaagaagaagggaaatgtggactccacctctagctggggctgtggaaaggttatgaaggacatacgggattggaaatagtgctgcagacattttttctgctggttggtgtcaggggaggaatttgaacccaggtttgcatgagtctatacaatgcccttaatactgtaccacagtattctgtgaagctgaggactgaaatctgcctctactgcaatggaatttagctgttaaatattacacctgggctagtgagcagaaacagccaaacttggaggcagagagtgtggactttgggctctcccaaggcatggtgaaggttgataatattaacatatgagaaccattcttccttcccaagattggtggaatcacttggaagacataccaaggccatcagtcttacatttcttgagtacttacaggtttctgagagtagataaataaaacaaatcactgagtcacattcatgctaatggagcatagcaactagattattggaaggtcagatcatttagttttgaaaaatagtaataacaaggcatattgtctgacttataagaaaacctcaagtatctagtaactggcaagatatttaattgaaatgaggcaaattctagaataacatatgacattgcagtgagataggctaggaggtggaaccaacaagggagacttgagccaagcaagcctttcaacattttcccttgttttctttccttctctgactttcctttctactttttttttttaagcttagggtaagtagcatgtttataggcctagaagccagagttattgctgacttgggaaggacagtcatgttctcaaggtaagttctccaaagagcaccaagcatggaggagaagagtggtgagctgagagggcaaatgccagaaaaaggaggatgtcagcaagaaaaataaggggtccacaggcaggccagtgcataatgtgcagtgcctactgccaaatgaaaatgagggaccctatgctccaaaattattaagaatttcaggatagcaacagcagagcattaaaccaagtttaatggggccccatgcaactgcacagactgcctgcctgttaagctggctcctcccacctaagaggcaccaagtggcaagggaggctgcagatggctgagctttaagaagaaaggataatcaaaagttttagctataagacgaatatcaggtaggatgaagacacaaaggaaaaaaaaaagaattgattaacccggaaacagattgaaagacaacaatttcagaagttgttaaatagaagaaaggctggcaagaggtttaaaagaaacccattcatttattcaaatagcgggacatgaaataatagaaaagaagccatgtaggagtagaaagaaggggctgggagaagggacagtggtgatgagttggaaagggcagttctttctcagagagtgtgtgaagcacaggagggtgaacatacactcagtggcagatggacgtaaagctcaaggcaggctaaaggacagacaccccaatgggccatgaacacagtggcactgtgcaacatacaaagttgtaggcagccttgggcccaaagccaccatcagaccaggctagttatgcatcaaaggcaccactggatcctgctcacttagaggcgtaaaccaaggagcccgctaagtctggagcctacaagttcttttgggaggggacatgtacacaactatattcaattgtttacaaaaccatctggtgagctaaggtgcagatgacagctactgaattaataggttacctgaatcaagtaaaatatttaaatatgccaggtgtaatggttaactttatatatcaacttggctgggccatagtgcccagatattgaccagacattactctggatgcttctgtgaaggtgcttttttttttttttttttggatgacattaacatttaaattggtgaactttgagtaaagcagattgccctttatagtgtgggtaggcctcatagaaaaaaagactgaccccctcctctgaagaaatgggaattctgccagcaggctgcctttggactcgaactgcggctcttccccggggcttcagcctgctggcctaccctgcagattctgaacacaccaagcctccacaactgtgtgagccagttccttaaaataaatctctctctcttcacaccccaactgatatgtattatatatatgtgtatatatatatacacacacatatatataatattatgttattataatgtattatataaaaataagatgtgtatacgtttctccatatatagtagatataacaggatgtgtgtgtgtgtgtgtgtgtgtgtgtgtgtatgtacatatatgtgtatgtatatataaatacacacacacacacacatacatgttgtgctggttctgtctctggagaactctgaccaatatacctagaattcttcatatcacattgcacaggtagtggtctacatagagctaattaagcccatacattaaactttagataaatgttgaggatctctgtagcctcaaatgtatacctgttacctgtttcttgaatgaaaaatgcctgggtgaccccagtgaattaggccttttgtggcttctgagaaaggaaatgttgatttcttcaagggtagacctctctgtcctcatgtggaccacgtaccaccaagtcccatccctgctaattgaagtcttgccaaccaaattattggaaggatagactgtttggtattaaaaaaaaaatagtcacaactagaaatgttgtctgacttacactaactaattaaaaaatgggcagctggaaatattattataaagaaagcttctttgtctaaacagtttaaatgagctattatgtttaaagaaagtccttttcatgtggcctttgccactttgtcactcttttctagaggacagcagccagtgtggtctgctcagaactgagagtcaggagttagagagacctgattctgctatgggaaccagctgtgctaccatgggcaattcatttaacctttctgggtctatttctctaccagtaaaaagaaagaactggagtatagcattcctgaggtcagttacagccctactgttgcttaatttttatctgtacacttaacaaaattatttaatcacttgagtcctcagggacaagtttcatgggcgacagcaacaaaaagtggaaatgtgacgtaagtggtgacttaattatctttcttgagaaaactgaggtttctttcctaatacttcatccaggacttaaccttgccaggtttttaaagaagtcaaaggtcacaaaaatcttacattttgaaataacagacatttaagcatctgatgtagtctgggtccaatcaggagtgagaaactacatggtagcttaaacaggagaaattcaacatgaagttttaactaagataaaagagtaaccatgacatataaggaaactctctatggtaccctagggctgagggagaggagccagggaaggacaaacttagaagtggtttggaacctggcacagaaactcactggtttgatcaggccagagctggtctggagtcgctgagcaagcaatagcccactccccagagttcaggcagggagcaggcaatcagcatcggtacagcatgcagcaggatctaggtgttagtggagaagaaggccttcaggacacgtggggcttgcaaagggggtgaccaagctgtgtggacacactggccataggccggctggacataggcttaatggggactttggtttctgtgtcaagagtgctgggaaggttattgccaggctgaggctatgaggtgccaggggggttgcatgctgagcctatagctggggtggctccactgcgtgccctcacagctacactgcccacccccagcccacaccacagccagcaagaaagcctcttcctcctgcagtgcccctctagttctccctggtgagaaagcctaactttgtgctcactttaaaggagaaatgtttaaagaaattccccctgttctcacagagcatatattcaagggtgcattggagctgaaaggcaataaattgataactgactcatctatcaagcttcaatgtcatctggtcactttctataattccttcttggatcctctctgaatgattcctcccacttctggacttgggtacccgcgagtgacttttggccaattatcagcttccccttcattatctggaaaccaagtattacatatctggtgtgttcatggaatgtcttaaaacaatggttctccaatgtggttcatggacttctggggtcgctaagaggctttcaggggttttaagaggtcacaactatttttagagttatatcaatatggtatgcttctctctctgggattggtatttcgtgggtaagtttactagtgtttcagcacaaatccaagcagtggtataagtgtgactagccagtcatgcatgtgcagaaaaaaaaaatagcctcaattatgaatgtccttgatgaagcattaaaaattatataatgtgattaaatctcaacctttgcatacatgtcttctaaacattctggttgatgaaatgggaaatgcacataagctctttggctgcattccaaagtctgatggttgtggaaggaaaagcacttgtatgattgagttgccagctgaaccagctgcctccctcactaagcagtttttacctgaaagagcaactggctgacacaccatgcttactcagacttaatatttgtcagtatttgcttcagcctgggaggcagaagttgcaataagctgagatcgcgccactgcactccagcctggatgacagagcaagactctgtttcaaaaacaacaacaacaacaacaacaacaacaacaacaaaagccccatataccccaactaaataccaagagattaaatgtggaagccgacttctactaagtcagatgttaaagattttgtaaaaatataaaacattgccacttttactaaatttcttgtttttagaaaatatagttattttgtgttaagatgttgtgtatgttaatagacacatttattatagcatttttctaaatatttaaatgtttttcagctttaacttacaacacggtaaatatcaataactatcatccacataaacaaaacctttctgggatcctcaacaatctttaaaagcataaaagagttctaagactaaaaagtttgagaaccgcggtcttaaataaatctccattttccacttgaatttacaaaattgcaggaagttataggtgcagtggttgaggccaagaggaggtaacttatctaaggtcattcacatagtgaagtagaggcagagatggatctagaaccacagtctccggctagtgtgctacataactcagggtaaccatgtatgtatgtatgtagtatgtatgtatgtatgtatgtagtatgtatgcatgtattttaggatgattttcagaatgccagtgagagaattttgagatcctcaagccacaaaaagggagggacatcaccctcccctcagcatgcatccatttaaataggcactgaatataaagtaagtttcaggtgcctgtgcttgttgctgctgaagacaaagtaaataaaacttcaactatgttttgagggagccaagctcatcatatatggagagagctcacatgaaaggcaatatataatagcatataatatgaagtatccagcatataacagatgaagtgcaatcatacagcctatataattacattatgctactactactggtatcaccatatggaatattatatgtggcatgatattttataataagttgttatatacactgtatctagggaacaggaagtactttaggattatagctggcaatcatgttcaaagcagaatcatgagcttgggaagtttgccattagctgtttatatatatatatatatatatatatatatatatatatatatatatatatatataattgtctttttgacacttccctgattgcatcagtttccaagaaattgctatacatagtatagctgatagcagcagaaacggattctctcacagttctggaggccagaagttcaaaatcaaggtgtgggcagagccaggctctacttgtctcttctagcttttggtgtctgccaccaatccttggcgttcgttggcttgtagatacatcacttcaatcattgccttcatcttcacatgactttgtcctctgcatgtctgtgccgaaatttccctcttcttgtaaggacatcagtcatgtttagagcccattctaatccaatatgacctcatcttcaagttgattccacctgcaaggaccctgtttcccaataaggtcccatgcacacattccagggggacatgaatttgggggaacatgattcaacctaggacactgtttttgtgccggtccctggcccccagtgctcaaaatctctctggaacaaagtacacctgggttttccctcacacttttcaggatgtggggcccaactgagccccacctggttcttctctgttgatgtttcagatggtcgtcacagatcacgatatttaacccatgagtttaacaaacaatttcttagggccgcaaggctgttgggatttgaaggggaatagaagaagctgaaagagggacacccagacagtgaaagtaaatggtagcatcctcgcatatttctattggtctttgacaatttttgtttactaaacccagaatcatagtttaatacaagattaataagacataatgaaaatgtagggagccatgaaggataccatgccctatgctcctggcatagctgattgcacactgaccagaggatgtccatacaattcaacaccagccctccccagcacctggggaggacctgttacctggctggaccctcaggctggctccaggcatgcagctcagagcactggatctctagccagaccacctgcgttcgtcctggtttcaccacgatgataaccttaggccagttattttatctctctgtgcctccatttccacatttgtaaaagctgaaaatatcccacttcacaggcttctcaggagaaataaacaagttaataacatatgtaaatcctttagaacaatgcctgacaatatagatatgttattattaacattattattatatgaattttttatgtagttgagaagtccactattttgctagttcctccttcaattcccttatcctcccaccaccaccaccagaggaaaacagataacagtatatggatctggcttctgtttttgtttttgcttttttcttcagttctcctcttgttacttccaccataactggccctggggaaattcttcctgtgtcgggatgtcttaaaggaccgagaacctggtacctgtcaagtgcttcttgagaagttcctagggaacgtacatcataaactcaagttagcaccaagctattattaaattgatagccacctgtctgagcatgctttattggtaactttacctccgtgggaaggtgtagcgcccacactgtaccctcctacctttcccattttatataacggagtccgtgctttctcaagactcaggggtgggtctgcttccagcactgaggaaaagtgagaactgaatagggagtggggcttttggtgtagttaagagggaggtaaaataactgtaatttcatagcaattacatgcagccaacactgtcaaaagttccagttttccattataaacctgagcccctgctgggagcaatttgcaaggtagaaaaaagcacacaatgaggttctaatgtatgaaagaaggcatcgctgcctccccatctgaatgccatagcaaaacaaacctcaagggagaaaacagtgtgttgagcttcgagaacgcatttgttttctccctttcttttgaaaaaaaaaaaaaaaaaactcagtaagcccccattcctggatattggtcggattgtttacagctttgtacgagtcttcagtaccctggcccacacaggcccttcctgtcagtggaatgccctgccaggccacctgcgggggccatggtttccagggcagccaacatcagagtctggagcaaatgggttatttcttcctctaagtattatgttgggggccaataaaccaccctatggaaatgaattctacagagaccaattccccaaccttttttgtttgttcataggtttgcttgaaattaattctttatgaaattcagggatctgcagcccactcagaagtgcagtaaagatggacttgcttttcagacctaaaaaagcctactgttttgaggaagggaaatgaaatgacagaagcacagaacacccaataataattctgttatttttacatatgttcctgtcttatccccaagcccacctacagaaggccataagctccttggaggaattcaattttcaatcccctggctaattttctccagtgtcttgcacataactgatagtcaatatgtatttgttgagtaaaagtgtaacaaatgaatggattattgacagtgaaggccaagtactagccagaactaagtggtgtattgattaaagccttgagcttcctgattagcctccatatagggagatgggatcaaagtctgagatatttatattcatgacatccaaggactgaggggtgggggagggtaaactacagaggaacatattttggctaggtagccgaaggaaagcatttctaattgttagagcaatcctcagaatgaactgctttgagagatattaatacaactgactggtcagtggagatattcaagcagaaactagatgattacttgggggtgtagatgttggcattccaatatcatttgtgtcagactaagtgatgttgcaggtctatttttaccccaagggttctatgatttcataaagttatgattctgcataatcatcaagttcaattcagcaagtatttattgagcccttacatgctgccaggcattgccctgcgtggacattaaggcaaaaactaataatatcaggctaccgccctttgaagttgctgggacatggttttagtaaggtctcctcagacctgcatttgggtgttacaatcttatgttccccttgctaattgcacctgcccactcaggacactggttctcttctttccaggctggaatcgatggagaaagcatcggcaactgtcctttctctcagcgcctcttcatgatcctctggctgaaaggagtcgtgttcaatgtcaccactgtggatctgaaaaggtaacgtacgttgcataaatgaggagtatgtttagctgcatgaacagagaaccttccatgaaggagggcaaaagccttccgtggctcccagcagccccctgctcacacgtcattgtccagaactgtgtctcaggatccagtcttagctacaagagagtctgcaaaggcaagtatttcacttggtgcccagcacttcactgacccgattagcaagttacgattagcaaagaagaagcaaggaatggacaatggcattgcaactaagtttctggtgcacatatgggcacagacatctaaaaacataggattagtcatttcagtagtactaaggccatcatccgtgggaccctagcaggacttcaggtgtgagagtctgagtcttcagagagttgtgatctagaccctttcccatgctatgttcccagctttagaagtcctcagtgtgacagttctagattacaggcttggacgaaaagcaactactgttctgtttttagagtgcagtttaatgacttacaaacaccaggagccacactcttttcactcctacagaatgtattctgtttcctgtcttctacctgttgtttaaatgtggaacagctcgaggctcaccccataagtgttcatcttctgcctctaccttcatccctggtgagcttggcatattctccttgttatctttatgtgaattgttctacacccagagccctgctatcatctagatagtttcacttggatgttctcttatcatgtatgtctaacattgcatacatcaatttgtatccttttcctctgagttgagctcttcttgaactccttttttcttctattttcttttctttctttttttttttttttttttgagacagagtctcactctgttgctcaggctggagtgcagtggtacgatcttagctcactgcaacctctgcctcctgggtttaagcaattctctgcctcagcctcccgagtagctgggattacagaaacatgccaccatgacaggctaatttttgtatttttagtagagacggggtttcaccatcttggccaggctggtcttgaactcctgaccttgtgatccacccacctcgacctcccaaagtgctgggattacagacgtgagccactgctcctggtctttttcttctattttctaggcactaaacacttcctgctcctttctattgctgccttcattgttgatcagtagccaagtctagagcattctcctattgcactctctcttcctccaaactctctttttcattctcaaagcctacaactggttcaagtctcaccactgccaccctgagagtctcattgttcttcaaactggtcttcatctttccaggttcacacattctctttttctctctctctgacccatcctttatgtgattctaaggttattattcctaaaataatgctttaatcaggccactttcatgcacaggaaacctttgatgtttcccattgtccatggacttgatgcatccgaagccccgatttgtcttttccttcattcttcccaacactctttcccaacacttctcaccgtgacctgtctactctgtcaggctggcctgccttctgctgttcttcttcctttgagcctccatcccttggcagaactgcatcctctgtctaaaacaggccctctcttccttcttgtccctggccccaggctcagcttcagcccatcccctctgtaaggcctactcatacccatcccaccacactcatacaagcacacctgtcaacccaacctccctccagactcacccagcacctgttgtctatgttgccttgtgtcgtgatttagtgtttcatcaagttctgaggtctgcacccctaatgctttacaactggtaaatgctttctcattaaaaaaaaatcacataatgtataatcctgtgaaggaggtcttacttctccgtgttatttgagaaataactgagacagatatatatgagactcgcccaagatgccaactagaaattagaggggctaaacgccatctgcttggttcaaatactatgctcttcataatacctcagttatgaagtttgtttcatctttcaaatgagaccttcaatccctcaaggacagactggaatcgtgttttaagtttgtttgtatcctccatagaaactagtttttcacaggtcctcaaatactatctgtcaaataaatgaacttgcatccactatgcaattaatgtctgtgataactaaagagagcagcagacttatgaaaaagcagcttccttcagtgcagaattggaggtgtttggattaccatgtgtgagagaggacttgtatgtttgctggagaagagagtgggagagggaaccacccctgcccgcgtgcttcagatggtttggttcctccttcacatgatcacacctggtccagccaacacccctttgacgtagaccaggcatgtagcaccactccatttttacagataaggaaactttcttactgccccctctacccatgaacacacacattaatttctaagaaaactgatttattttcctggcactacactttagtgactgaataatcttgaacttttcagagcctcagtttcctcatctgtacaatggagacagtgtcttcttaatcaataggattattgtgagaatttatcgaggcaggccatgtaaaacatttgcaattggtcctgtacctgactcatagcaagaactcgttgcatgttggttattcttagaattatcactgggttcatggagctggcaatccagtaaggaaaagaagaccgatcctcattacataattcataaatcatacctggcaatacgtcatccaatgctaatgatatagtctcaactataaatactgaagcagggtcaacaaagacagagggctgcaactctagctaagcgtcggtggccataggcagtacttcccaagggcgtctgactccagtggccacaattctccagaatcccaggaaaaaacccaccaccaccaccatcaccaccaccacacattcctgtatctgtaagccacagagaggtgactgagagcacacacgttgctgccttgtgtcagctctaaaaaacaggagcaaataaagaatgtcctttcattgtctaaaatgagggacatgcacaaagtaaataaagggactaagtaaattagattttaaaaatactttccgtctcagttgtctgagttccaagtgcctcagaatgcagctggagagtgtgtgtgtttggggagggacatgggagtagcacagtaattgaaattcttctcttcccctcccaaactgattacgccaggaatttgtttcattacagactcctctactcccactgtttactttttttacagtttctgcgtttaatgttttccactcccgactcccacaagaaatgtggcattctcagagagagcatttggggtgaatcccagcaccgtcttggaagtcgccaccattttccctcctcttccctaaacatttttagtgtaaccctcccctttcccattttccccaatctgccaaaccttcttccccctcattttgctccattcttgctcttgcattctgaccagctggcgcagacacagaagcacactcctggatattaacaggacctagccgtgtcaaacacaaggccactttcctttccactgcacttggccttcctgcaggtagtcagtgtgctccccagtgcacgccagaaatgccacttagcactgctgtgggctaagtgcaggaagttcaattaattgttcagttaattaattgttcattcattcaattgggactgcgttccagaatttcacccacttctccatcatctaggcctttctttcaggataatttaggactcttgggtctcctctttcccaggggggagaaatgcactgttgctttggttatcttggatttctttaagtgtctgacccagaaactaacaggcacaccaaagagctttctgtcttcttagggagcaaatttgctgcctattacatatatatgtatgtgttacctaaaagatcctactgggcccagcaaagtttgctataagaagaaataactttcataaatcaagtgatctatttgaatcccatcacaaagcagaagttgcatttacttagaaaataaattgtttttaacttaagataacatttaagtaaccccataatttttaaaaataggcacaatttctgactcctaggagatttttgatttatgtatgttgaacagaatttttaaaatttaaagaaaaataacttctttctagtaaatctagtaaatgttctcaaaataagtcttattttgagaacagtagatgcttgaattaagttaaaatactgtgaaaggtagactatggtggagcatgaatactgtagcagtggagttgcctactggttctccccacatttaactgaaagccgaaagccttcataactggattgaagtttttaccaatttgagaccaacatttgatttctacttttgcagctaaaatcactcatttttaaatttaaaatgtatgagtttttattgctgttgttgttttgagaccgagtctcactctgtcccccagactggagggcagtggtgccatcaacggctcacaactgcctcgaactcctgggctcaagcaatcttcctgcttcagtcttccaagtagctgggactgcaagcacatgcctccatgcccagcaaatttttgtttgttttttttttttgtaaagatgggggtcttgctatgttgcccaggctggtctcgaactcctgggctcaagtgatcctcccacctcaccctcccaaagtggtgggattacaggcatgagccactgtagctgaatcaaaaatgcatgctttattcatgtagccattaaaaatatgtatctactgagggcctcctatatgccaggcatggttctgggtcctttccctcatggagcttgaatcgtaaggctttctctcaggtatcttcttactcaccagtaggaggttcttggttcagaatccttggtaatagcctacctggtgtttgtggagcaataatcttagcaataagaagacttttgaaaacatcttcatttaatagttttgttttcaatctaatagtttgtttattttcctggctacccaaagaccatatcaggggctgtttataactcaaaaagagtattctgttgagtgtgacaaaaggctgaccaatgttagacattagttattagatattaaaatataagttacacacaatagaagcatctaacttgaacaaatggcccaaactcccaattttttgtatctggagatatttattaggagaaaagtatgatctaattcattaatttttaaagtatggaattatgtgtagcgcatttttgttaggcagattggtgaaagagcttttaaaagcaaaaccccacctctcccctgggtaattaaagcttggatctgacttagatagtcacctggattctctccattttttcaattctttcattttttcaactccttcatcttgacttgttcctctctcactgactccactggacacacttcctgggtcacaccacattctttcagaactttctccaacctcccctgccctatactgcataccataaatctgtttcacctgacaggcatgttggatagcacagggcatctaagttacaatcaatcttaggtttcccagaacaggaagcaccctgctgtaagccaacacctgaatcttgctctctctacagaaagccagctgacctgcacaacctagcccccggcacgcacccgcccttcctgaccttcaacggggacgtgaagacagacgtcaataagatcgaggagttcctggaggagaccttgacccctgaaaagtaaggatctgtttctttctggggctgttgaatgggaagggttcatgctggatctataaagtcctggtgttaacttcgggcagatgcatttccaaaggaacctcaccagtccagagaacaggaccctttcttcaaagagagagcctaggacccccaaagggctgccaatctcaaaaccactccacaaaatccactcaagagtagatatggcctatgaacaagagccagtcactcctacctacacagagtgattttaggagccctaggataccaggcctccctcgccccagtatgttccttctctccagctcactttgcttggaagacgttgaagtgaggacaaagtttccttcatttcagaaccagagccgaaagcctgacagaatgaaaataagtcaggaaagggtaacccagtgacttaaaacaacatccagggtcttaaacctgaccaaatctggtctgagtccacaattaaacagatgaaaaaaatcaactaaaagcagcagctcctcttctgcaaacaggttcagggagagtatagaccgtagagctataagttcttgttgggtgacacattgctactgatggaaaagagcagtaaaaagaagacagatggcttctaaaatttacccaagctagacttgttcattaaagaatactattatcaaggattaaaacaatcacaatttttgaaaaaactagaaaaataatattacatatagagtgaggcatgaactttatcctgtagggtattatcctgtagtgagtcctgtgggatattctgaaagggattaagcacaggaggtggggagtccgttttaagacctactttagaggttgagggaagtcggtatcctagaggaccatgaagctggagatagaggaattaattctggggagccattggtgactgtccaggcaggacgaatgaagggctaagccaagacagggcaggaaaatcgggggagaggagtaggaagggttcaggacatactgagtaagtaaagttagtgagatttgactactaaaaaccaccatcctgcatttattttaaagttttatttattcatcaacacttttatagccttcattttgtgtcaggcaccattcacaacacttagctaatatgattcatttcatccttctagcatcctaggtactatcattatcctcatttcacagtcaggacagggagagagtaagtcacttacccaaggttgcacatctagtgaattgctgttaaaaaattaaaactgccagtcatgctccaaataagccttaaacaatcatatattcttccttaaaaatattctttgtcatccatattcagtcagcttatttgcacactgagagtgaaaaagccacctcaagcccattggaagcagctgagtatagactctaaataagtgcattaattaaatcaataggacagccccacatacacacacacatctctgaagaggacaccagccagccacttcactggaattgccctgagggagcccagactccatccccctccccgggactcaacctcattgctagcactgatttgaaatcccacatgaaaaaaaatgctgttttcaataactagagtttagactttgcctgggagacccatagaggaaagttcatgacgcagttaacattttccctcttagaagtaacactggcactcaggagtgggggcttccgtcatgatcattaggaagtggaaagtggaagcagtgaggagcagaggggcccatttggtctgttgccaggcagtggatggaggggtgaggggctggggtacaatcctagtctgctagtgatgtgctgtgacctcttgagccagtcccttcacctcttgaaccagtctcttctctgctctaggactcagttcccttctctgtgacaggatatctcccagagcccttcttgctctctgattcttcacatgccctttagccaggttccctcaccactaccacaccacccccagtgcaactgtgcctttcctgggctgcttctctaactcaggggtctccaatctgcaaccacggtgggaccacaaggtggacagagatcactggaattgtatgccccatgcgtccttgaacattcttccagaggcgagtcatcatctgacttcgtcatcatttcatcagattctaagtttccatgatccaaatagagctgggcagggctggatgtggaccctccctccactccctcctctccacctaccttccctgtcctgagctctgctcccgctggtccaggtccttctctggactgcagttgtgtataggaggttttatgaagtgcattcctgccatgttagtgacctaacaatccactactctcaggtagcagaacgcttgatgctgttaaaatgcatatctccagaagcctaccaaggtgggggcgccaagggtgaggccatcaagtattccagagcatcccaggattataccttagatgcctttgcacccatcagactgaggcaggtgccacaattacctcccagtaaatgtcaccaagccagtgcctcagccccatagagacctgctggtctgcccagaacaaaccaccagcctcaccagcttccccagcgactcaggctgggagatggagtggctgggaggttgtcaggcctctggagcaggacagcctggccttctggttctctagggggcagcaaaaccctcataaccattcaccaagcgctggtcggccatgtgtttctcatcataccactatttgtaaaagctgccaaaagccaacacattatgggaggctttttcccttagctttattttttaaaggagaaaaccacatacaaacactccaaccatttttttcaaatcacatttgatcccagggagcatttggtgtcaaaatgaggaatccaggaagtctcaagttgtttctaaatgagactaacatccatccctctccttagattgatctagtgaacactcgacaaggaagtgttgtgattaatgctgggattactgttgagacattctggcccttgcctttcatctcctgaagtggccaaagtttctaggattcagcactgagagtcaggagccctgcctctggccacctctctatgagtgtttgtcatatgaccttggacaagcctctctcccgctcagaccctccttgccttctcatctctaaaatgagggggtgaaactacatagtctccaagatgtcttttgttgcatgttccacaattccatgagtttctcaaagtactcttccagagctggttattgtctcaaataatcctagcacatagatgctgtaataaaaattcaggagggtaaactgatacagtctatttacacagcatgtcatttagtcagtcatctagcaagaatgatttaagtatcaacagggttcagaacactgacagaattggaagacaacttgaattcattattttacaaaatgtatagcgataactcaccacagtaaaaaacaagaaagttctgaccctctgggaggtagagaaacagcctccagacctcccacaggatggcatggtagctgggggcaggaggtttggagtcagagtgactcgggttcaaatccataccactaggttgtgctatgttgcagtaacaaagcggccataaaattccagttgcttaacagaacacaggtttatttctcacttgagcaaattctgagagggtagggtggccctcttccatcctgtagtttttggaatacatgccctccaaggctccttcagggagagagagaagaaagatctcccaaagtgttttgcagggccaggcctgcaaaaaaaatgtcatggtgacattactttccttcctatgccattggtcagaatccacacgtgatcccaacttaggtgagagagaagctgggaaacagaattacatggctatttagtgagtatgcatattctccgctacaggcaaatgacctgaattctctagaatctttaattctcacatctttaaaacaagaaccatactgttgatcttatagggctattgtaaaaaataatactaatgagcctagagcctgatatgaagtaagagctcattaaatggaagctcaaggagttagaaagagtggccagtgcctgttttgggtctgtctcccaggtgcaattgtacagacaattggtgaccttaggtcttaaatccccagatcctaggggatatcttttaatgaataagccaggcctcttccacctccagagatcttttgcttacacagcagacatgagtcaaacaagcacacagtcaaggattagaaaagtcagatgcattaacgtccttcacgtgtgaggggttgatgaagtaaggaagtgggaacaatggagaagggagagagagaggaagtctttccacttttcagctcgtgagaaaaaggagggaaaacacttaagctgccatcagcaaggccattccatcaggaccgtctttctttttctccagggtatctatccccaaaaccaatctcagggcctagtcctcagtaggtgtttcatgcacattggtttaattgcatggtgggtatccttttgttcagtgtcttggttggctgtggctagtcagtgagaagtcagctgggactctaaaccagatagggcacttaccatctgcaatggttttctctttttttgctactattttctacttttgaaaaatttttttttttttttttttttttttggtgagaagccaactgttttacttcccagaatgaaagttaagtgcatgcatttgaaataagatatcctaaaaaccgggtggagagaaattttcatcagttagatcaggagttagcagctttatctgtaaaaggtcagatagtcatgtatttttggctttgtgggcccttcagtgtctgtcacaattccacagtgacactgtgaaagaagccataaactagtatgtaaatgaatgggcattgctgtttcaataatattttacttatgaacactgaaatttgaatttcatattattttcacgtatcacaaaacagtatcctccttttgatttttttcaagcatttaaaaatgtgaaaaccattgttagcttgagaacctcagacaaataggggtcatgggtcacagtttgctgactcctgagttagaaaaaattatcatctctttgattatcatcagatcacatccaatgttatttcaaagctgtttctgtgagtgaaacactcttccttagccttttagagaaacagaatgtactttgtagcccgcttatttgcatatttaaaacacgccataaatatggaggtaaaatgaatgcacttatcctatatagtatcctcccccagtgtagttactgaaagttgcgagattaacatcttagagacgcacttcccacaagaacaaagctcaaatggaacactgcactacacagtaaaatcacaacgagtcctagtgcttgggaaacaggatgacaccaccacagccccctgaatacacgatcctctgtcatcatcttggatttggtaccacacatccctgtttggcccaacctgattgtgaagaaatgatcagatgactgaaagtctgaccaattgatgagatacagcaaaacaaagcaagaaacccaaacaagctgtccactgaggtgcattttctaggcctttctgtctttacattatcaaggagaaacaaagaacacttggcatttgttaatagcaatttaagtctatcgattctaatagcatgctggattctatgtgagaaggccaaaatagaaagagatgacactgaattcctgtgtcttggtagattacctagtatcttgcaggaagccctgctgtgtgcccccagccacagcagatgaatgtggtgattctcagtatacccaggaagacatgtgtgtggagcatcggtgcaaagcaccccctcctgatggatggagacagctcctccaaggtgggcagctcagcctttaaggttctggggctttgagaatcaacagcggagtttatgagaagccacacaatgtggaatttaaaacctagtcttccacagtgaaactgcctgggttgggatcctggctctgccaggcagccatgtgacctcaggcaaattgcttaacctctctatgccaccgtttcctcatgtaggaaattaggctaataatagtaccaatagagttgttctgaggagtaaatggtgaatacgtgtaaagggaatagaacagtgcctgcctgctgcacagtaggtgctcaatgcaaattacctttcactgtttccagagaagcagtggagggggaaggacactgctgtagggccaggaaaccaggttctcatcgtccctccaccatttattagccatcaacatttatcttctcaggtatccagttcccttccatgtaaaaggaggacaataatgccttccttatctgcctcacagcagagagctggactcttccaatggcagtatctctgaaattacacagccacctaacatggccccaaaaggggccccaaaaggaatcctagctcatgggccagttgagtaacaaaaaagcattaaagaacaacaaatattttttaaagtcttgtttggttcgaactatcaaaaacatcaaaacaaacaaaaaggattttgctttttaaacgtaaggcaacccaccagcccacagtcaaaaacgattcacccagagatcacagaggtgcacattcattgaaaataatgatagcctggcgactgtctcccatctcttcccaccactacctggccatacccataaaatgcttatgaaataatatttatttgagttgatttttttcattttgatggggctaatgagtccaagccctgggttcccacatgagcaagtttacctccttcagtctcaaggccaatcgttctaactccagcctgcctcttgtattattgtggcttcaaaatgaaagactctacgaaagagagagagaggggggctggatcattgcaaatgtatctccaaataaaataaaataaaacaattgaaaacacatgtccttttttggagcttggtagtttctgcatgttattactgcacacaaataataagcatgtaagggcatttcagaagaggaccgtgggtattcttcctttggagaaatggtttaatgctaacatacctggcttctccttgctcccagaattagctctgtgtagctaggattataatcacaggactggcagtagatggttattttagcgggtaagggaagtgttgagaaccctaccagatagagaggcaagctcagagggaactttgattgcgccatcccactggcacatccttattggtggtcccaagaaaaggacacatcctgagacccctgaatggcattctggttctttgcctagcagactgtgtcaccctaggcagatctcagcacctcactggcctctggtttcttctatggatgccctagggctgagaatgcccaccctccctatagtatgaggataaagacccccaaaacattttgtagatgcagctggaaagggaagtattgcttatcatgatagggataggctcacccttaaaggagctccaagtctactgattcacagaacactgcatcctccattccaggtaccccaaactggctgcaaaacaccgggaatccaacacagcgggcatcgacatcttttccaagttttctgcctacatcaaaaataccaagcagcagaacaatgctggtgagtgactcccttccaccaagaacccttggcagtggtctatctgctgcccaaggcatcttcaatttgcccataggcatgtcaaatacttgggccagagaagcatctggaaccaatactgcttattatttgcccccaccccccgccaccaccatcttgtcccccttgacacaggggaggaggtggtggatgctgctgcctagctggtgcaggaggaaaggcttggggctttactgccaagctggagagagggatgctctttgtcatctgagcctgccttattgcacagcatagtgcactgcacggaacggtcctcactgcccatttgtcccaagttcccaaccctgcctgtgatcacattagagcaacatattcccgcttccttctggtccctacaaggtttctccagggatttttccagaggccaagggagaggcagcacagtcactactgtggcaaatgtggaaggcagacctgggctgtgttctccccttctgcaggacagtgggccctggaaagccactcctcaaagcctggcccatcctacatcaggcccttcatttctgacattggctacagaattcaggacttggttctcttgcggggccttctgaaagggagctgagtcccccccagttatgctcacagcactttcagtccttcatttggcattgccctttaagaattacctaaagccatttgaatggaaccgtccaattaagcaggtataacacttgaagaacggtgttaggcccaggaggaacaggctagccactgcagtgccaacctggggggcttggatttttatcctatgggcaatggcagccattcccttgccctcagaatgggatgacaggacagcctcacaggctggatgactggagtccagcacaaagccaagcaacttaagtgctccatgaatctttgtgaatgaacaagtgactgatgcacaatggaccaaaacaagggaatagatgctagatgccccagaagctccaaggagaatagcatctctttggatcaaggcgaccagcatatgcagctatgcatggtaaaagagacgaaatcatggcaggaacagagttggtgtatcgggaagtaaataattcaggaagctactcaggacccagattgtgacaagtgcaaaacttggttctggaggtccaaagaagaaacaaacacttcctcagtcttcaatgcctggcagatgcagaaggacaggcttcaagtcagtttgatccaagagggtctggagagctgattaactgcaggtaaaagaacaaaataatttctgtcgaaggtattcagaaccagaagcatttaccatgggggtaaatgcatgagactccttttctgggagtttcaactgggtcataaagattaagaaggaagcagttggctgagatcattgagcagaagatgcggggaagttgagaaaaagtcagggacagagactggaaaaagtgactgaagcccacagtgccagcttggagggcttgggtttttatcttgtgggcaatgacatccattagaggtgtgtgtcaagaaactagaaagagagtggcttctgggaaataagaagaagcatgtggaaagtactttcaatctacttggtgctcttgcttcattgctgcttgaaccctatagtgtgttgagtagtgtccccccagaattcatgtctagcctgggcaacatagtaagaccctgtctttacaaaaaaaaaaaaaacttgtttttaattagctgagcaaggtgatgtatgcctgtagtcccagctattcaggaagccatgacaagaggattgcttgaacctgggaggtcgaagctgcagtgagctatgattatgccactgtactccaacctgggtgaaagagcaaggtcctgtctctaaaaaaatttttttaaatgtatgtccacctgggatctcagaacgtgacctcatttggaaatagggtctttgcagctgtaattagttaaggatttggcgatgagatcatcttgcatttagtgtagtccctaaatccaatgactgttgttcttataagaataggagaggggccaggtgtggtggctcttgactacatcccagcactgtaggaggccaaggtgggtggatcacctgaggtcaggagtctgagacccccgtctccactaaaaatacaaaaattagccagatgtgatggcacatgcctgtagtcccagcttcttgggaggctgaggcaggagaatgacttgaacccaggaggcgaaggttgcaatgagccgagatcacactgttgcctgggcaacagagcgacactccaactcaaaaaaaaaaaaaaaaaaaaaagaggagaggagaggacacagacatgtagaggagagaaggccatgtgaagacagtcagagactggggtgatgctgtcacaagccagggaactcttagctttccggaagctggaagaggcaaggaaggacacctactaataccttgatattggaactgtaaggggaaaagtctctgttgtgttaagccacccagcttgtggtactttgttgtaacagtcctaggaaatgaatatggcccctcagagccattgtgggaaagaagagtcattgctgctttcccggctgaggacagagaaccaaacgagaagacccatgacttgtctacccccaaggcagagctggctctcgaaccctcgttttcagactccacacccagtatcctttcctcttagccacaaatatcttctttcatacttgtcaaagtgccctcagaaagattatctcatttgagccctccagatttttaaaattataaatggtgtttacatattatccatatttacagttctcctattcccaagtccaaagccagtttccaccaaatgccgcatatccatttcttataaactcagtactctccaattttcattgtttccccttcttctgtttcaccctgttttcttctgtaatgagacttgcccttgtgactcctgcttcccctaactcatttgcacatttcaaagctccaacattgctgctttcccaaagagcctgtccccagatgtgctattccaccttctgtttaacaagacaccacacattccttccctggaactataacttgcccacacccctcccttcctctttacttgtccttcctcccacccaatacccccgagttgtggtcaactgggtccaaaattcttaggcttagcaagccagaggtgaaggctcctgtaaggcttgccctcctgtagagagcagcatggctcctgtgttacggtcccagagccccacagcccctgacccgggagatggtccatcccctttctgctctgtgtgagctccatggctgtggcctctccccaagagcatcagcattcaggcccaggcctccttccacatgccgccctacattactttgccatttttttccctctggatcttcagctctgcacctagttctccaactttctttctttagagggtttctcttgtattttcatttactttctcttgagcagagccctccctcccctctacctggtcactaatgccccagcccccatacacacactggcccaggtcatgatccttttctgccctctcaaaatgaaagcatgagaaaagccaacactgttacatggttctccatggtgggtcacctctccactccactcctgtggtggctacaggaaccaccaagtaaaatttccctgttgttccccaaagccttgtaagtccccagctaccacaaccgagaccccatccgtgggagccatcccagcagtactggagtaatggagagaatcatccattagtttgtacattcagtcattcactgattcattcaaaaaaccacaagttatataaagtgactacaagtccgagctaatatttaaagggcactgcttatgtgccaggtactgtgctaggttctggagttgccaaggcaacgagacaaagtcattgccctccatgaactaacaatctacagggagctgtaaaacaagtacatgtgcaattcccggcctgggtttgaatcccagcacttctagctgcacaactttacccaagaggcttattctttctgagcctctggctctgcatctgtaaaatggactttacattcagtttctttatctggcaataaggtaattaataatatcaccaaggtttgtaatgcaggttcatctattttataactcagcgcatgtaaaacccttagcgcagtgtctggcctcgtaactgttaaatttgattattctgattattgctattagcacaaaaatgggactaagatgaataatgacatcagaaactgctgcttcagctcttgcttccccctcagttagctcttccaaatctcccacccattcagtctattttctactttttaaactttgttggtgcatggtcctcctctccaaagtgtcatcaaggagcgtcagtggcctggcccaactctcatacctcagcagccttgcatttttttttgttccctgagggacgattctgtgctccgtgtttaggcctatcactgtactcacccctcctctgtaatttctagatccaggtccccttggtctgcagtaaccagatactgcctccatgccccctcctctcactctttccaacctgctcttcacttcacttaaatgtagactggattttctcatgactcggtggcaagatcccacattaagtcaggtgctacttggggaagttgcttcgttttcttgtgctctaagatctctcacccacacgcctggttttggggagaaggataaggacggtgtttctaaacatgctgtgtttcctatgcagagaggcaggtgactgtgtatggctcaacttgcagactctaaagccaactactttagagttcagagttcagacaccagctttgcctcttgtccttgtaacatggcacaggttacttcaactctgtaatgcctcagtttcctcatctgtgaaatgggggtaataactgtgtatacctcataagtgtgcttggaataatgcccactaccacgttcaaagtcagctgctggggccaggcatggtgtctgacccctgtaatcccagcactttgggaggccaaggcaggcagatgaccggaggttgggagttcgagaccagcctgaccaacatgacaaaaccccatctctactaaaaatacaaaaattagcagggtatggtgacaagcacctgtaatcccagctactcaggaggccgaggcaggagaatcacttgaacccgggaggcggaggttgcagtgagccgagatcacgtcattgcactccagcatgggcaacaagagtgaaactccatctcaaaaaaaaaaaaaaaaaaaaaaaaagtcagccgttgttctgagcagttatctcgggtagacaattgtaccttagcagagagttctggtataaaaatgcagtttgaggggttatacatctttagatgattaagacgatgcccaaggatcaatcacatagatgggatgacagagggagaggagtcaaggaggaagagaaagaaggactagccagggaggatggaggaaatcgggggtagtggggagggcataaagatgggaaagcaagctttattgttgttgttgttgttttaaaagagtgatctgtgttataaaatgctgcagagaaggtcctgggagacttttgcctgctatgtgcagctccctgaaagtgttcttggatatccttttctgtctgcttttctcatgtggaatccacccattactcagattctacacaaccagagagagctcagtctgatggaggaagcacaaaccctgctcccttagaaaggggaggaccagtgggtgatgatagggaactggatcaggaacccacatgggaagagtgctcgtggtcctgcgaaagagcatctttgagatgggagaaagcagcactgcatttagatttggctggaggggttcctcctctgagccccacattcactttttcaatcttgcagggagaagttatgccctgggtttagacctggaggttcatagagtgctgaagtagaaggcttgagggagggcacagtgtcatccatgcccctttggcacatcctgcagcatccctgtaattagcaagcagttaggtctgtcctcccccttaatcatgctctctacccagcctgcctggcacatggtggagttcagcaagggcccaggcctccaccttctgcaagccagtgcctccacctctagcaagcgtcgctgtgaaacacccctccccgcctgccactggaacacccctttggctccttgggtttgtctcttccctaaaggggtttctttgacacctactttaacatgtcccccactctctgtcattcctaagaggatgtggacttctccctctgaatatctgtcttacattttgcatttcttaccctcaatctgccatttgaacagactctaaaaatccctgcaaatctcttggttttcaagaaattcattttagttacttatcataatctaggcagaaagtgctatatttcactttattttccacaatctctctttccttatgcttcaatcctagcaatacacatgatttatttcatgttctgtccccatcgcatatggcaggtaattaacaaatggatctaatgtgcatcttgaatgctctattttgattaactaatttgaaaagtctcctacccctttttaaaatttcttccaggtctatcatgtttccctcagatacagttaatgtcctaccaagaattaccatccttgtttttggtgccagtgtcatattctcatgtgcttttgccccttttctttttagctggagaggaagtaggcatgcctatgcctgtagcctaagacaaaaattcagtatttctcctgctctattcacgctgaccaccttccatccaacctccttttgcgcagcccacttccacaggactccctttcccctagtgagaggtctgaaaagccccaggggcaatagtatctcatctgtatcacatgcagtcttggggcttaagctctctcaggcctcccaggcgacctgcactaagtggtgttttgcccaatctggatggttttagtctttcaaggcttcctttgaattccctcttttcttcccccttcaagtccacttttctctcttatttccacctctgtattcctctgtcttggggggccttctttctattttaaaatttatactccacttgttccagaaaggctttatagctactcccagggatgcataaagcacggcaaaccaacaaaggccaagaggaggtgagaaagaaaaacaaggagacaaccatcaaatggagccctgggtgagctaaaacagtcagggcagccccggggccttcgtgcgccacacagaaggtagaccacaaatttggctctaaacttgtgagcagacaaagcaaaacagggcccctggtcagctgcagctcggtcctcctagaagataaaaacaaaccagcctcccagaagaataacaaatattcctgctgtgagccgcaggcacggaggagctgtggtttccattttctttggctctcccctcctgtgacttctctttcaggctgctgtagactccaggccctgctgacttcctgctgctctgactcctctccatcttcccccacctgtgagctgtgctcctcccgatctcacaatccctgtgttctctcttcacctgaaactcactttcttcctttctctccatcttctctggaagactcaggagacctccctgcagcctcaggcgtgtgtcgccaacctccctgcccctctctgtccacccagcacatgggacacagaacagcctgtctgggcttatctattttcatcaagatgaatgggctcctgcactagatgtgcaaagatgtacccctttcactcgcaaggctgcacctagttctctttttatggaagactctgagatgtcctaacatactcttcctaaaatacttgtcctaataaggtgcttctaacttccgaaagaaagccctaaaaaccttccttggtatctgtgacgtgctgggcatgtgctcagattgcattgcccttcatcagttgtaactgcagtggccatgttttccaaactgaaaatcagatgcctaacaaattgccttcattgaaaataatcaaattataagaaattggtactgtcccaggaaatccaggacacatgtccccagatgaaaagcacctggttagggctaagccctctgcttctcctttctctccaatccaagctcaaacgtggttaccagagggcgagggagtgtaccctagttcccaccacctcctggttcccaatttgttgctggaacaaaaaagtggccattagccacacaggtccctgagcagtcttggttctgtttccaaataaaggccaaggtttccacctccctaaggctcacatcagaggctcctctttctggaacctggaagctccctgggcttattctggaaaaattgattgtccctgccacatagaatggaagaagactctcgggttattctaggaacctcagtgagtttatctcagaatttggatgatcattcccactgaatgggaacgtgattgaaggaggacattgtggttcttattaacacaatatcaatgactgtcatcctgcctctctcatttcccttcctcatctcctagagccctcatataaggcagcaggggcaagccagccacaggtgcattcctcgctctttccttgtcttcttgttccattcaggcccgaatcttcaaattgctcctgtcttctccttctaagaggtgccacctgcagtgggtcatgctcctggctgatgctgctagaaaaagaactcatctgtatcactggcggtctttcttttccttccaggttttcatggtttgtgtccccaacaactcatccctgtcctcccatcttgcagactgcctggtgtgaccacaccgacagactgattcctgcagccggctctggtcctccctaccccgggggtcacagtgcttccttcccttcgctcccttttaataagatcttaagactcttaaagtaaacgtattaagcaagatcatcctcatttgatgtatagaaaatttaggcttacacacttcagctcaacattagaaagtttacaattaggccgggcatggtggctcacgcctgtaatcccagcactttgggaggccaaggcaggccgatcacgaggtcacgagtttgagaccgtcctggccaacatggtgaaaccccgtctctactaaaaatacaaaaattagctggtcgtgggggcatgtgcctatatcccatctacttgagaggttgaggcaggagaattacttgaaccagggagttgtaggttgcagtgaaccgagatggtgccactgcactccagcctggcgacagaatgagactccgtctaaaaagaaaaaagaaaagaaactttaaaattaaatctgtagaatggactgccagcaaaagaagtgagtatcccatcaacagaaaggaccaaaaagaggctggatctttggaggcaggaactgcctaatctaaggtgtcattgattgtacgacactattattttaaatactggctgggcacagtggcacacacctataatcccagcactttgggaggccgaggtgggcagatcacttgaggtcaggagtttgagatcagcctggccaaatggcaaaacccagtctctactaaaactacaaaaaaattagccgagcatggtggcgcacacctgtaattccagctagttgggaggctgaggcaggagaaccacttaaacccgggaggcagaggtcgcagtgagccaagatcatgccactgcactttagcctgggtgacagagcaagattccatctcaaaaacaaacaaacaaacaaacctctaagaaacaacaacaaaatgctatcacttaaacaaagtgttttcacttaacctctcatattttgattgtaagacattgcctgatttcacagatgttaaagagtgaaaaaaatgtgcaccttagacttgagacataatagtggactttcacagtcctttccagatctaaccttttattacttccttgaggctattcagtgacatgtcagaccctccttttgcttgaccttgagctgccctgttggaaaaaaagtgaatcaagttcaacattgcttctaaattgccctgggatagcgatactagctccatttccagtaaatagcaactctgttctctgtccctcttgcctggaaacaggtagctcttcctcataagtcagggcttggcaaactttctctatatagggtcagatagtaaatagtttaggctttgcaagctacatagcctctaccagactctgctcaattctgctgcaggaatcataaagcagccacagataatatgtaaacaaataaatagggctgtgttccaataaaacatcattcgtggacactgaaatttgaatttcacatcattctcacttcatgaaatattattcttcttttgacttttttccaaccatgcaaaaatgtaaaacacaaaacaatacttagcttgagggcagcatgaaagtaggcagtgaactggatttagtccttggactgtaatttgctgacctcaatcttaggcagtccgtggctacaatagcaagttctgttaatttcagtatgcctcagcctcctcaacggtaatatggagattgtaatagcaccctctcttgaagatttgtcatgttaattagatgaattaatgcatataaatcacttaggacagttcctggcacacagtaggcaccaatatgtgatagctattgctgctgctgttgctgctgctgctattaatttcacagtgctccccccgcctccatacctagtgtccaccctttggactgggcagcccagctttccctgtaatgaggaagcatgtgctgccctcttctggcaggcagaggaatcgtcgccagagccagctgatgtgatttattcaaggcctgtggattcgaaagggtcttcctatacaaagattcagttttatctaagccaaagcttagacggttcaaacaaggctaggtcttcttcaaggctcaaagccaccttccattatctgtcccccacaccaagggaagggcatgtccaccaggcctgacggatctaccataggaggtccctggctgcccctcccaatgacaactacccccaaatgcttctttctccctttcctcttctccttctacaatctcgagtctttacatttacgaacttccttgacctaaaataaaaaagtgcttgaaaggattcagagcggcctgggagggctgttagcctagaactaacaagccccttattatcaaaggccctgtgctttcccccaggcgtcatgaaagccactgctgctggggggtaggtggggaggagggtgagggacagtgaagtggggcattttttccagattcccaggatgtggtgagccacgtttaaaaaagagtgtgtatatttattattccaagccacttcaatcataaggcgcttcatgccttctccccttcctccctcccagcccccagcccccgtgtcacagtggccctgtctggagggcctggccatccaggggatggatgcggcaccccccttctcattctgccttgtgctctgccacaggcctgatgagaaagctaaggccgtgtgtaaaaagcagcaggaatgtgaaacctaattaccctgtagcatgctcagaaacagagtcacttaggtggccgtggggctccatgtctactctgttggaagcagttcttttggaggacagttgggtcccaggaagaccgctgcagaggcctgggagccccacggtgggctgttatcaggccatcttggtgaaggctcctgggtggtcaggccgacctccacagcaatgcggataacatgtgaccgtctcaccacttcctcataaagcagccattgctgtctcctttcaaaaacgcctctggtcacaaagggacccttcaggctgccttccttggcaacccctgtgtgcaaatagccaactaggggtattttgtttgttggtttgttgggttaaagttttgctttgactagcattcttgtaaggaaaaacaaataacctaggctcggtgggacccacctcggaggtctggtgggctctgcacttgcatgtcctcgtctcctccctcatggagggtccttggggctgagggcaggagggagaggagtgggcaaatgcttcctctggtccctcccatgagctgcctgagggattcctccagagggtctttgatttggttcattattgaggtggatgcttccaatttataatttaacaaatcttgctcctgaaacgaatccttgggcagttgtaaggaaggcggttggtggtggcgtggcctgttgaatggggcaggcatggggagaagggggtggggagagctgggccctgcgtgggtgggcgcattcattagtggaattttgctgtgtgggctcctggactggagtagagcggagaccaccaacaccattccatgtggtggaatttcccgctgtctgaccagaatgagttctcctggcctggcctggatgcagatcaagacctggggaataaaggaacgttaaataactgatttgcacatgagttaaatgttctttcacctcttcctaccgttacctcatcctatgcaaccaacacctcttgtctttgtgcagtctacacataggaaccaaatacgtttctcaatctctctctctctacacacacacacacacacacacacacacttatgcacttcgtgtgtgttctgatgttcttatgtactggcaaaggccatcacatacctccttagacaggctcatttcaattaatctaaaagaaagtgcttacatgcaaaattatattcatgatgggacacaatatattcatgatgggacacaatatcccactaagcacaggatatgcagaccacagaagtacaatagtgtgtccatgggtgtgtgtgtctacatttcattgtgtgtgtgtaggttgaaagtatcacagttggtttatacaattactacattcataaccccttgtctgtggttaggacgtagctttgaggaaactttttccaagtttctgctgacctttaggggagaatatctctggataagttaacctgtagaacagattccctcatttttggtagagctggggctgaaaatgacaagatgtgaaatccaggtggtgcactgaaccttctagcaaaagcttcagcatttctcagcttttaaacatcttttgctaccaactagtgttgcaaagacataagaactaaaaccagggattaaatctagtctggtattctgactttatcagcagtttagagagggtaatttgttgggaaaaagttgctacatggaactttggctttaaaaccccaggctttctttcaaatcctgctccagcgccgtcttgcaggaaggcactccaccccatctcaagcttgtttccaggctgagccggagtagcctcatgagttaagacaggcacagacttaaggcttaagcataaagcagcacttcttttcattcctcttgttagccagaccattttctaccttgcgaatacatttgaatcccgtgggggttttagaggaagaataacccccataggttcttagttggaagggacccctgtaacaaaagacagattaacaagagaaaaacaagcagaagtttattaacatgtatattttctataatgaggagttctcaaagagatggctttgaattctagtttcacagcatcctcatcaaaggacagtaaacttttagagatgtgacaagggaaaaaacactttgagtctctaggggcagcaacttcgggggatagcaaatgaatggcagataaaggccagttagcaaagcttgttcaatgtagattcctgcagggccatctccaggagcataagcgtcttaagttgttttcagtggttctccctggtagaaggggggaggcaagatacgttttgtctttgtaaatctacgtcctgcttttagacaaatagagggagggcagagagctttactgcctctgtttcttctgaattgtcttcatctcaacaatccttcctattttgggggtggcatatcctggtttcccacagggtcttgttacgaagcagatattgaggtagtggatctggggcaaggcctgagagctcccaggcgattcggacactgttggtccagggctgtgctgtgagaaacagggttctgagcagctgtctctgtgaggaagcatgctgggtgtgcctccttcatcattgtcaccccagaccccagctcagcatctgacccagggcagatggtccatcaatatttgttaaatgagagaaaaaaaagtatacaaacacttcaacacacctctaccttgtctatgcctttgcttgggagatgatgacggggcctcatcagagccacgggcacgtcctccagccacttcctgtccccgctgtggaacctcaccttttaaatctgtccccatgttgcagactcccctatgctctgactgtatttatttaaaacttcccagtccccatttaaatcctatgatgttctgtgactagcattgtctttgacgtgagaacatacaatgcttttgtagcctctgttatatgatatcaagcttcatggtgaataatctcacttagaaccaatcaataaaagaatgcaagaacctgagcagctctcctcactaggatggccagtgtgctggcgggcttcgctgaagtgggatttttcttttcaccattatttttataaccacattcaagggaaattctatttggtgttaaaagtgatacttcaccaagagtcaaaagagaaaacacagaaggctaaattctagacttttttcagctagcagccagaggtcaaattatttttctaagacccctggtggacaaagcatttaatgatctggatcaaggtaaataaaatacgtttctctggccgggcgcggtggctcatgcctataatcccagcactttgggaagccgaggggggcggatcacaaggtcaggagttcaagaccagcctggccaatatggtgaaaccccatctctactaaaaatacaaaaaaaaaaaaaatttagccgggtgtggtggcgggtgcctgtagtcccagctactcgggaggctgaggcaggagaatgccatgaacccaggaggtggagcttgcagtgagccgagatcacaccactgcactccagcctgggtgacagagcgagactccatttcaaaaaaaataaaaaaaataaaatatatatatatatatgtatatgtatgtatatatgtgtgtgtgtgtgtgtatgtgtgtgtgtgtatatatgtttctctgtgctagtgtctagaacctcttcccttccagaacattctggggaggggagggttgagccacgtgatttctcagacctcctgcactcagctctaactctgatggtctcatgcccactgatgtttgcaatgatagttatccatgttctgtttccattgtggggaccctaagatgagttttactcaacattttgcccaggtctgaaactgcctcagtcctacctgagtcgtttggcagagaggttgatgctaacctatgcttctctcttggctctgataacaaagtggctgggactctgtgggagggtatctcaggccaaactaattgaatcccttcatctatcctcaaaagaccaagggctactattatacaaagaaagggaactgttgttcctctacagagttaaagcttattacataagtatataaatagagtcacatgattttagggtccttcatctttcctcaaaccccactgaacggcttattctttcaacaaatacttattcagtaccatacgctgtgcaaggtgctagaataaaagtgaaataatgaggctgagcgcgacggctcatgcctgtaatctcagcactttgggaggccagggcaggcggatcacgaggtcaggagttcaagaccagcctggccaatatggtgaaacccagtctctactaaaaatacaaaaattagccaggcgtggtggcacgcgcctgtagtcccagctacttgggaggctgaggcagaagaattgcttgagccagggagatggagtttgcagtgagctgagatcgcaccattgcattccagcctgggtgacagagcgagactctatctcaaaaaaaaaaaaaaaaagcggaataatgacatgttggcatgttggcaatacctatgtatattggcaaatgttgtgtttggctgtttgtaatagaagcctgactacagtggctaaagcaaacatgtattttattagcaaaacctatatagcattttactatgaaccatgccctgttctaagcactcttgataaatgtttacttcttaagaggaatttgcttttctcacatgacaagaagtccagagagtagagagttccaggcaaatgtagttgctgaaagaagtcgagaattgagctgctgcttagagctcctaattctccatctttcgtgtgtgactttcattcttgtttcacaggatggttgctccacccccaaacatcacatccgcattccagacaatgccagccgcatctatcttatctttcccagaagcccattgattaatttctaccgatatctctttagccagaacttggttatttggccttctgtagctgaaattctgggaatctaggaagatgagtatttttgatagggcacattgctaccctgaaaatatatatatatatgggctctgtcttctactagtaacaaataaaaggagactgaattcttgtatattcaattcttatatattcactttcaagttaaggtgatattttttctctctctggtgaaaatacctgtcctagccattgccaaaaaggacacactattttaaattctcctttggtgctggaaaaatctgagtcatttaccccctactagatttcaggaaacagaagtataaaattgcacatttaatttgctacacacttcaaactttaggagatgcaagactcatgtagtaaaagctgtgcaactcaaacatccaatgggtagcttctccccacaaactgtaatttttgctggggcacattagggtatccagggaactgctctgagcaagggggagggaggtccaggtgtacttgtagcatatctggggaattctgtgtaagtatcagtcacccccaacctttaaggttgccccatttcacatctgttatgatgaaggctttcggctgggggactgtggttctggctgtagagtcagaatgaaaggaacagctgaatatccctgttcatgtcagcatttcagggcagaggatgagtcaagcacgatgtttactgagcagagccagaggcaagagccacttttttcttgcagctctaagaattttttgttgctttttttgtatgctttgtttctcatacatcagcatcatcatgcgttgcacatacacattgtacataacaactgcttacagcatgccgggcactgtactaagccctctgcaggtgatgactcaattattgctcccagcaaccctctaaggtatgccatgttatgatctccactttgcagagaaggaaacaagcaccggttaagcaacctgcccaagctagtatgtgtcagggtcaggaccccagcccaggcagctggtcccatgatctgtgctcttgacttgcgtatattaacatttaatataatccactatttaatatgtatgtagtgctgaattaaacaagagtgtgtcatttaggaaatggtgatcaaatcagttcacgatccgatgaatactcaatgaatgactaccatgtgtatttccttaaatatactcaacacttcccaccttccccatcagggtcctcacccagcaatccatgtggggaaaggggcacaaagttggcccacagtgggcaccgaatagatgcctgtttaacaaataaaagaatgggcaactggaagagaatttgtaggatattcacagaatcaccaaatccagtaattatttcagtctagcattgcagtggcacagaggcagtttttaagtttgtgaatggctcttatgtaaaagatgtggctatttgaggatgaaacaagacaaaatgtggtgaatgtacttcagcctaagtgttttgggggagggagaattgagaaaaatctctaggtctaaacgctggaacggatgactgataaagttagaatctctcttaaccagctcattctaagtgtgtgagcatccgcattaaacctaatctatggcctgatacttaaaaataacctgttataaagtaaccataaaaaaactcacagatttcagcctgattcatttggccacataaactacaatcagcattaatagcttccgtcagcatttatgccgtactttctattagcacgatgggttctacaatcatttatgagtttctggaaagtctaatagaaaacacacgtacatgttctctgtggaaaatacacaataggtttttggggagttttttgtttgtttgtttgtttgctcagggataagccagaaggtgtcgccactgccccatggctaaagtctgggccgggttccctaaccagaacttctcccctgatcactcctgagctcgctagctctgcagcttcctcccacattcagtcagtctctctctctctctctctctctatctctctctctttctctctctctctcttcctcccttctcctgttgataaataaacattcaggcagcttacatgctacagatgagtacacaaaaggaaacttaattcgaagacctaagtgataatctttctcttcaaatctactgtggcttttaagaggtttagaaaattatttggatctggagtccctacctcccttcatactttaagaaaatattatactaaaggcatgctaaagttgtcctaaatgtttaccatgctggtgttttaaacatagccaaatactggccaaagtctcttgcctttaaaaaaaatatgcattttgttgttgtactaatacttctgaacatacgccaaatataagggtgatttgtggagctgtattaaataaaaagatgcttctttataagaatcccctatagagcttggggaagcagctatgtggagaatctgtgtcttccttaagaaagtttctgaattccttggaaatacatcagaaaacaccccattctccccaccacagaggagggtgggcaaccaacagtgtcctatatcccaacccaccataattgtaagacttaaacgctatctttcaaataaagaatcatttactggcttcttactggaaagaactataggagcttgtcatttaattcatcctcccctctgaggctgaaattctttctagaacaaacaaataatacccatggcaccacgtgctgcacactctctgtagcccagctgacgccacacgagggaacagtggggaatctgttgaagttgccattgcattttgctttctcataaaccgctgtttgtctttctgcctttcctgtttttagcagtgcctagaaacggaggcctgggaattgcctcccccatgtgagcccctgggttgttcacacccagggccaatttgacaacatcctcctctctggctatgaggccaagtccagtgttcttggttcagtgccaaaggtggacatgaactctctaaactgtcaaactaagaaaatgtgacacacccatgtggcctggagagagcaaagccaaacccaaagagatgcttccaggcaactttagatccctaacatgttaggaaagtcaagagcaagcttcatcctgcaagctctccaggattctccttggacctggaacatgctaggatgttcagataaacttcacttcagacactgaatttctgccttgagctatctcttctctcatctttctctcggtgtcttcttccccttcatcctctcataaacccaagttctatagctgtaataataataatagcagttaactttaatcaagtctcactctgcaccagacactagatgatgtgaacctgtgaacaagcataactgaggattcaaacccaaatctcttatggcagagtgaatgtgctgctctgctactgtgtttgttatcagaagccatggctccccgacatactcgacccagattctctgtttcttccttgatgaaaccagtgacatgcaaacatagccagagggcccaggcacagcagagagcgtcccatcagacctgatagaaagtccccttcccatcttctaaaaccttgctgccatttctgacttcatgtggtctaagaatctggtgtagacattatttaaaagacaaagggacctgaaaatcagcccccccttacctgccatgagtcctagaaaggtcactgcggatgagaaaaccccagtttccacctgctttataattttgcctttgtgtggtcattcatactcatataacctaactgtaactgggctactgttctctttctttaaggactttggcaactgagaaaaaagctacatgactcatttctaaaacctgaaagatgaatgcagatctttatgtaaagttttctggtgggggaggggattggttacactgcccatcacagagctgaacatcctcaaaatccccttagaatatctttgcctctcctcaaaattgagctcgttatagcagcatctacatttctgcctgcttggcctgcacctgcccttttcctcaccctcccaatcctcctgggccctgctggggctcctacatcccgcttgctcctggatctttggcctagtccatctgatctctctcagtgtctcttcctcttgtcctagctgcctgtggaaagaaaggcttcttcttccaacagatgagtaagtggtgatattcttcttattattattttttgtttccatcacgttaccattcacgttttaaactatcaaatgtcaacaagtgtggccatctttgtattttctcttcaaaaatatgtgatggccagagacatctccgtctgccatggtctttctcaaaccaccactgtactttttttgcaccctttggttatatcaacatgatctcaaatgagaagatgaaaagtaaaaacttcattcagtgctccaggtatttctcaatatctagatatttctttcctcctaggaaaaatccaaatggatttctcactttttgaccagatgtttcattgtcacacagcccgtgtgacagcactggcccctagtacaggcagagttgaaaagtgatgtgatgggtcatggttgcccctctactcagagaaaactccttcttgacctcatcacggtcgctgaaagtactaagaattatatctgaaatcaagcactggtagcagaacacaaatatgttaccaaattagttggaaggtaaggcatgggggagtcatgaggggaaccccatcctcttttgtcaggggaatgagaacattttgcagcacctgtcaggccacgtgaatacccaaggagtgatgggacagtccttgcacccagaagtggccttgcagagtagaaggagtttatgttttagaatctaatagccctgcgcttaaatcctgggctttgcacctaaattataatagagctaatcgattgaacatttttttctctctgtcactctgagtacgtgattctaatctgccctaggcattcattgacctcagagagattaggatttctgtaaaaggaactctaagacagaaaaaagaattcaatattcagcttttgatcttcaaaatagcattttcaacaagacagtagacttttacccaacctattgtctaagatgttctaaactcttttatttctcaatttttacccatcaaaaaccctgcctggaggcctcgactcacagagtagaaacagttgtactggctatgcagcaaggccgcgaggctttctgctcaatgattggtgggccatttgacctgggaaaactaaaagaaaagcccacccttcctagcacaggggagttggggatgaagaagaaaggagaggtggtgggggggagggtcagggaactagagcatgttaagagctccgtgtggtgctttgcttgggtatccttccagattgtggagggaggcaagcagcccacctgtaacccccacccagcatccccatggttactctggaaggaagcaaacagaagaaatgcagaacctgtattcgctttccaaagccttccacccatagattccagaaaccccatctccccagtgctgtgaggtcacaggggcctagtccccaattcccagtgccactgactcaggaaggagagcaaggaggggcaggttctctgggaaactgagcatatcaatgcaaagagacagaattctctagggggactatttagatgattacatcagactaggttataatccaaaatggacgaaattaaagttgttgttgtttttccaccacccagaggttaggagcttgtaaggaagaccatagcagttgaaaacaaagcaaggcacatttccattgtacgtcccaggagtagtttgaatggtttaaggaccagctatgtgtgtgcttgcataagcgtatgtgccctgggtaagtctaagactcagtttcttcatctgttgaatgacgatgaataatattttccatctcaatagcctcattgtgtgtttaaatggtagttgcataaacatccctagctcactgcgggaattcagtgagtgtatttccttgctggtgctaaggtatgggactagggcaataaaaggaacaagatagggcagagggtactcggcccaggccagtgcccaataaccacaacctccttctccatggagagttgaacagacacccatccaatctacagacaacggtcacaggtgggttcctggtttttattttgctgcaacacacatacaagagaaaaaccatatatgagaagttgagcgtgcagccacctgggcccacagagctgttctcattctttcaaagaccacctttgatatctgctcctctccatgtgaattttgagccccaggagtctgctttgccttatgctcatcaggacctgtgctgcactgagtttgccagcaaaccagggctgagctgttcttgcaagaacttgttggaggctgggttagagtcttggctccccagtccccattcagcctccatgccctggtaagaatatattattttcttagctcaaattgctgtttccaagtcattatttctctacgacgagaaaacaatattgggtcttatgtaatatcaacctcaatgaatctggaagtgatcatggaatgggtggattttttttcctccttaaaaaagagaaaaataaatctaagattgtttgcatatggctcagaatatttatgaactattccccttgtttcctcatcacatattttacccagtgcatttgtgtgtggtacagaataaatctgtatggggagcagaggcggagaggggaagaaagcagttaaaacactgggtatctatcaagtccctgggatgttagtgatcctgcgtcttgggtgccccaaccctaggctcacttgctgtagttggagggatacccccatctaactactcagagtaattatgtggagtgaggatatcaaatatttacgaggaattaaacacaaagaattaacatctttttgttgctctagtttctttcacatcccccttgttcctaccagagcagaaagttcaaatagtttcatgacctgtgtaccatcagtcaaaagagatcattaaattctatggatggcagattgagccagggtcagaggaatgagttggcaggtgggaggaaaagaattggcagagcgtatagtgggtactgccatttgctatccgataatatggtagtgtttcagcacacaggcatgttgtgtctattttgctatgggtgtgcctttcaacacagcttatcaccaaggagcatcccaagggagtataaggaacagggctttggctgtatactaaataagtaagggaagcaaatctccaggctattgattttcctctccagggagttggccacaaatttggagcttcttaaaatcacccattctccactgcaccttgggatattcaggaatatattgaccaagagtatggggcaaggaacagagaacaggaggaccccacgtttggtaaggcaatagcaacaactaccattaattgatgtcctcgtattggccaggcactgtattaggtgctttccctgcattatctgagttaaccccagcagtggtcttaacagggtgaaggatccttagtcccgttattgagatgagaaagcagaaactcagtgaagtagaggaacttgtccaaggtcacatgtaagtgccaggatcaacgacatttgtgggatttatgaagccttaaggcaatacaataagtaccaatacagaattcttgaaatcagatccaagcgcttggaagggacccaggaaagcaagacaccttgaagcttaaggctcagcagcttcccagtgaattcaccctgggcggccttgagatttaaacacagtttagtcccaggccttgcagtcctttccctgttgccttgtctcctcttcctctaccacggctgttaccaactgcagccctcacattcctggtcaaaaatacacaaacccaagtgaggagactgatacacagagggtgccttccagaatgtgctgacttggaaagctccatggaatgtcacagttgcaacatgaatcaacaatgattcctgtcaccagacttgatgccttccatctcgaggaattaccggagggatataaagaactatcttcccaaggaacttcaatcactgctctaggcttttcaccaaatttcatgatatttcccagacctggtgacatgggcacagacttgtgcaacagcccactcaggtctccagggccatttgagattagaacctgcaatgtctcatctcctatcgtatgactctttccctcagatgatattagttggtcaaattttgacaggcccagtatttgattcttcctttcttcattataatcaagattttgctgtaatctccaggaatgaaaggggtagagggattgagcaagcaaacaaataaatcacaagtgcttcagggagaaaagcataataagcattgtttagtacccaccctctgccattgcctttgaatagccttgcaatcccatcacagtctagacaattattaaggaatatactgcattttcccagccctgcttactctgttctcccaaactggaaacacaaagcagatgatgaagtagttcaaatgccacaccagggagaagaaagtattgagaaactatgcccaacctccaggcagttttcaaacattccagtaagtgttcaattgatttatcttgggctggtgtctttccattgtctcaaacaaaaggccttctatgaaaagacaaaaagtgggttatgagaggagtggctaacaaggcacacttgggaaaatctgaacaagagtacagccctcttggctttgcctccagaaggcagtgtccgccttgtatctactggaatgaacagcaggatcgacttccattatctcagtgtcaggctctaaaccagagtctggggatggggctgatgacacaggtgcagtgactgatgccctggtcagccatctcctccatgtttgtcctttgagctcaagtagaaagtttctatggtagtgttctctgattagaaaggactacgagattctgggcaaaacgattttcagtgatgatggcttcccacagttgttcttttgggtattttgtctgcttttgtgtctaaataaattatgtgacagataattatttgaccaagactgtaaaagccttctcccatgttatgttcctttgggtgttcattccttgagtcataatcatgacagctttctgtgcagctgggggttgcacatttgtggtggagcccttccatttgagacagcagtgatttttagaacaagcttccctagagtaacccaagtgttcttccctggtacccatcacttctctgggggtgacatcaaaaagggctgttctattccccctgtcaagtccccctgaaggccttgtccccaactcttcttgggttgggttagctatagttaatacttccacaatatctgatgcatatctttgtcttggaacttctatatagtttatatttacccatttaatagccttttcttcctaaaaatgtaatatgtaggttgatgtggaatattagcaaattatagataaccaaaactttttaaaaaaatggctagtattggccaggcatggtggctctcacctgtaatcccagcactttgggaggccaaggcgggccgatcatgaggtcaggagatcgagaccatattggccaatatggtgaaactccgtctctactaaaaatacaaaaattagctgggtgtggtggcttgtgcctgtaatcccagctactcgagaggctgaggcaggaaaatcgtttgaaccagggagtcggaggttgcagtgagcccagatcacgccactgcactccagcttagtgacagagtgagactctgtctcaaaaataaataaacaaacaaataaataaataaattggctagtattatttcacttactgcaacctctgcctcctgggttcaagcgattctcttgcctcagcctcccgagtagctgggactacaggcgcgtgccaccatgcccagctaatttttgtagttttagtagagacggagtttcaccatattggctagggtggtttcgatctcttaacgtcatgatctgcccgcctcggcctcccaaagtgctggggttacaggtgtgagccaccacacccagactgtgtttctatatttatgtatttttttcaaagcaaaagattagctagtgtttattgtttggttagagtttgccttttcagcctatttagtacacttctactgcattgtgttaatggtttccaggtattctgcagtgtgtggggagctggcagtgtgatgaaggggacaggattctagatgagctactccactctgaagaccctatgactgtatccactggcaagaagtttgaataaaggcccttttactctttcatgccagctcttgaaagaggcctaaccaaggctctaaagaaattggatgactacctgaacacccctctaccagaggagattgacgccaacacttgtggggaagacaaggggtcccggcgcaagttcctggatggggatgagctgaccctggctgactgcaatctgttgcccaagctccatgtggtcaaggtaagagagctctacccacaggggcctgcaagatccagctccatcttaggcccaggtcacctgtgtggatgagtcaaggacagtaccacctgttggtcaagaacctggaccctgaagtcaggtaataaggacccaaggtcaccctctgctgcttgttggctgtgtggcctccttgagcttcagttttcatttataaaataggcatatattgcttacttcaagtgttggtggaagagtaaatacagcgtgaaagtgcttggcatattgtgggggcttaatatgtgtaatagtcgcaattatcgttgttgtatacagtcatatcactccaaaggcctcttcctcataggatttccctggctacacccctacagctctattaaatgtgccctcatatgcattttttctttgtgcacagacccaccttctcacttcctccagcaacttcctaaggtgagcccacattattttcctcatctatcaaatgaagaggtggaggttgcaagaagtgatgtcactttcttgctatcattgcacttactaaccatttgcagcatgtagtgtcatcctctcctatataacaaaccctgggaatctgagagttggaaaggacatttagaggtcatccaaaacaatctcccacttcaacctggaccactttctgctgtttctgtgacaggcttctgtgaagctgtgactgcagcctctgagaacgaggagccctctgcttaatgagccagccctaccatgttagatagctctgattattaaatcattgttctttacaatgagcccaagcatgcctccctgctatccattttttctctagagtaacagagaacagctttgcttgccttcacctcatttgaagacagtagttgtatccccctaagctctgtcaatgagcacttcttcccccattctttcctgaccctcgtcagcctagtatcagatagccatactgtgctctattttacgcatgcttatatcttactgtctcagccagacagcaaactctgtgaggaaaggaactttttaaagtgtgatggtgggcacacagtggccattcaataaatactcattgattgatcatttgatcacctggtgtaagtctttacgatatccagtttatttctatgcttcactgagaagactcagattcaatcatctgtcagctgagtatatgcctattatttttcagctcaagtcccgagtcaaaaatgctatctcctctccaaccagagcatgtaccagcttgagctgaagtcactcagttgtgtgtacactggtgtttccgtatgccttagagctgaagactgagagggaatcatgcataaaaatggagtgggcaaatacaacctatttagaaaagaacattttggatttggggccaagccaatagtcacttgtaggtccagccaatctatgtctctttgaagttattaactactgcatgccccacccatcatcctttattcttcttctccttaggaacaagtaccactgaaagggatgatataattccagctcagtcacactgtgtcagagtgatacaatgcaaagatcaggagacccgagttccggtcctgtatttgctgccaactagcagcatgagctgaggcacatcatttaatctttttggaattcatttttctcatgcctagaagaacagaagtggattgtattccttcttgccttcttttcctttcttctttccctccttctttccttttctcttgctcaaacatgtattcactaccactcaaaaaccatttgttgaacaaagcaaacaaatgaatctcccaagccttgggcttcatcctgtgatttcctcaattcccacctgccttaaattactcagtgaagccctgtccttggagaaaattcagtgggtggttaacccagagaagctggagatcaaaaagaagatggccaatgaaagaacaaaggccagcccttggcccctatctctttggatttctgctgatccagcttatcagatcccagaaacctggcaaacctctaaagttcacaaagagcgaaggggaagccaagtcaggcctccagtttggcttcggatgccaaaacttaatctgggctgtgggagctaactgttttcatatgaaagagcaaattcagaacatgagcatggaagtccctgcgaacgtcagatctccgtgtgcatccttacccccttgctgctttcatgctcactctcctcttgcgtggctcgctttcaggtttatctccatccctggaagcagagttgctctggcccaggctctccatgagagtttggcttgaacattcattgtctggccccctcctagttctcatctcccaaagtcaagccaatgtgtgaagaaatgaccagctcagcagccaaggcccagggtgcacaggtcttcgttgggagaggcatctgcaggcctttccttgctcactgggatccttgcctagcatagtgacgatgttcagccctggagacaaacaagaaggggaacaccaacatcaatagaagtatatatttacaaattgcatttctgctgtattgaaactaacattctgccctttaaaatcctgaaaataaaatttcagtatgaaatgacttgaggctactctatgaatcagtgtgtcactgtgaaaaatacttttggatccctttatcttattggagacccttttcatccactctgataaattccagccagttctcttggtcaggccaccactcctgcatgaatttgctcttagccaagacagcctcttctcaaaggaacttggcccaacccaagggatcatcatctttcagtgaacagaaagggactggggagatatcgtggtggcatctctcattgtgagagctttatcaaaggactcggacttcatcacccttgcttgtagttacctaagccagacagaacagtgtgggggtggcttctttggtgcccacaccaaaccagttattttaacagagagaatttaaggaagtactatgtagtaaagaactggaaaggcaaaatatactaggaggttctaccttcaagaggcagctactactcctagggcaggaggaacaaagggaagaggttggaattattaaaacttacaaacttaggggctctgtagatgagggaccctgcagagctgaatgtcggtgaaagtgatgctcagctggtgccagggtccaagctcaggttggctgggatccagcctctaaagcagagttcctgctatgtgctggcctctctgcgtgggtatgatgaagtggtcctgtgagtattgacaaaatagcaaactggattcagctgctgctcccagaaataaatggagactctgacagaaagaggaagctgaaaagcatgggcttctccctcccttctcctcctccaaccttgctggctctctccagtaactcctcttggcagaacctaacaggattcactggcaaagaagagatgtgatctgctcagtcctagccccagcatcacaaaaaatagtaaatagaagagtaggtttggagacaagcaacagtaaattaatggctggaacatgagggattctgagtagaccgacccattgctttatcagctatgtagggctgagtagtaaagtagaaagaactgtggattataaagcaaggactgtaataaatattaatggtaactcaatagatattggttaaattaattaatttatcatgtaacattaagtcacataatctcttgtagcttcagtttgctcattgctagggatcttcagtctttaaaattattttattacacttgacactagagaaccttgtctgatgtacagataagattgtaaactttgaatcccaacctatttaatctccctttgtcttgcttttctcatctgtaaatgggaatataatagattcttccttataggattatttagagatttaagtaccttgcaaagtacttaaagcagtccctggaacagagcacacagtgaataaatgtttgttattatcattcctctgatcaacatcattattgagattatcaaggagtacagaagtgaagaacctgtgattgctatccttacactgcccacaagttagaaaaaaaaagggtactgaaacagtaatcatgattcagaatagattatagctcagtgttataacagaagttcaacactggcctaggagcatagaggggaaaaaatgttcccagatgtctgtgaacatgtctgcaacagtgagtttttcatccatcaagtcatcatcatccttcacttcagcataactttctgggaaactctgcatattaccagcaccaaaatggagacaaaagcccagagtgactgatctggggcttctctgaatgggaggatcccagggtcaatggtctagggccctctctgaaaatgaaagcaaggtagaaggtggatatacagatacaagaaatccagagaacacctgtgagataccatacaaaatgaacttcaccaaggtatatagtcaccaaactgtccaaggtcaatgccaaagaaaaaagtcttaaaggcagctagagaaaaaggtcagaacacatacaaatggaaccccatcaggctaacagcagacttctcagcagaaatattgcaagccagaagagattgagggcctattttcagcattcttaaagaaagaaattccaaccaagagcttcatatcccaccaaactaagctttgtaaacaaaggagaaataaaatcttttccagacaagcaagtgctaagggaatttattaccattagaccatacttacaagagatccttaagggactctaaacatggaaacaaaagaatgatacctgctaccacaaaaacacacttgtaaatagccaacagaccctataaagcaagcacacaatagaaactacaaagtaaccagctaacagcttcacgaaaagatcaaaacctcacatatcaatattaaccttgaatgtaaatgatctaagtgccccacttgaaagacatagagtggcaatttggataaaaaataagagccactcatctgctgtcttcaagagacccctctcatatgtaacaacacccataggctcaaagtaaagggctgaagaaagatctattacacaaatggaacataaaaaagagcaggggtcactattctcatatcaggtaaaacataccacaaaccaacaatagtgaaaaaaaaaaaaagaacaaagaagggcattacataatagtaaaggggtgactacaacaagaagacttaaccattctaaatatatacacacccaacactggagcacccaggttcacaaaacaagtacttctagacctatgaaaagacttagcaacaacacacaataataatgggggacttcaacaactcactaacaacgttagacagatcttcgaggcagaaaactaacaaagatattctggactcaaattcaacacttgacaattggacataacagacatctactgaatactccacccattgaccatagaatatacattcctttcatctgcacacagaacatactccaagatcaaccacatgctcagtcataaagcaaatctcaataaattaaaaaaaatagaaattatatcaatcatactcttggaccacagtggaacaaaaatagaaatcaacaccaagaagatgtctcaaaatcacacaattacatgaaattaaacaactcactcctgaattacttttgggtaaacaacaaaattacggcaaaagtaaaaacattctttgaaataaatgaaaacaaagacacaacataccaaaatctctaggatgtagcaaaagcaatattacaaggaaagtttatagcacgaaatgcctacctcaaaaagttagaaagatctcaaattgacaaagtaacatcacacctagaggaactagaaaaacaggaacaaactaacctcaaagctagtatagtaaaagaaataactaaaatcagagcagaactgaatgaaattgagacccaaaaattcatacaaagaatcaatgaaaccaaaagttggttttttgaaaggataaagaagatccataaaccattagctagattaacaacaacaacaacaaaaaagaaaatccaaataagcacaatcagaaatgacaaagaagacattacaattgagctcacagaaatacagaagatccttaaagactattatgaacatccctatgcacacaaactagaaaatctagaggaaatggataaattcctagaaatacacttttcaattgccttgaaaactgtaacaagacaaggatgcccactcaccgctcctattcaacatcatagtggaagtccagagcaattgggcaagagaaagaaataaaaggcctacaagtaggaaaagaagaagttaaattctctctttactgattatgattctatttcttgaaaaccctacagacttcaccaaaaggctcctggaactgatcaacaacttcagtaaaggttcagtatacaaagtcaatattccaagattgaattgggaagaaattgaaaccctgaacatactaattgagttatgaaattgaatcagtaatttaaaaaaacctaccaaccagtaaaagccccagactaggtggattcacagctgaattttacctgacataaaaagaagaaccagtaccaatcgtacttaaactattccaaaatatcaaggaaggactccttcctaactcattctatgaagctagcaccaccctgataccaaaacctgacaaagacacaatgaaaaaagaaaacttcaagccaatatccctgatgaacatagacacaaaaaattcacaacaaaatactagcaaaccaaatccagcagcacatcaaatagttaattcacattgatcaaataggcttcttcttaggatgcatggttggttcaacatacacaaatcaataaatgttattcgccacataaacagaattaaaaacaaaaatgaaatgatcatctcaatagacacagaaaacctttggataaaattcaacatcccttcatgacaaaaaccttcaataaattaggcattaaaggaacacccctcaaaataataagagccatctatctatgacaaatctgcagccaacatcttactgaatgggcaaaaactgggataattccccttgaaaactgcaacaagacaaggatgcccactctcaccactcctattcaatgtagtagtggaagtccttgccagagcaatcaggcaagataaagaaataaaaggcatacaaataggaaaagaagaagtcacattctctctctttactggtgatgtgattctattcctcaaaaaccctaaagacttcaccagaaggcttctggaactgataaacaacttcagtaaagtctcagtataaaaagtcaatgtggccgggcacagtggctcatgcctgtaatcccagcactttgggaggctgaggcaggcggatcgactgaggtcgggagttcgagaccagcctgaccaacatggagaaactctgtctctactaaaaacacaaaattagctgggcatggtggcgcatgcctgtaatcccagctactcaggaggttgaggcaggagaatcgcttgaatccaggaagcagaggttgcagtgagcagagattgcaccattgcactccagcctgggcaacaagagcgaaactccatctcaaaaaaaaaaaaaaagtcaatgtacaaaaatcagtagcatttctgtatgctaacaatattaaagttgagagccaaatcaagaacatactccaatttataatagctgcaaaaataaaataaaataaaatatctaggactacatctaaccagggagttaaaatctctacaaggggagctataaaacactacttaaggaaattgcagctgacacaaacaaatggaaaaacattccatgctcataaattggaagaaataatattgataaaatggccatactgtccaaagcaatatgcagattcaatgccattcctatcaatctaccaatgtcatttttcacataactagaaaaaactattctaaaaattcgtgtggaaccaaaaatgagccggaatagccaaagccaccctacgcaaaaagaacaaagctggaggtgtcacattacctgacttcaaactgcactataaggctacagtaaccaaaacaacatggtacttgtacaaaaacagacacatagatgaatggaacagaaaagagaacccagaaataaagccacacacctacggtcatctgatcttccacaaaattgacaaaaataagcaatggggaaatgacttcctattcaataaatggttttggaatagctgactatccctatgcagaagaatgaaattggacccctacctttcatcatatacaaaaagtaactcaatatggattaaagatttacctcaacttgtaagaatcttagaagaaaaccaggaaacattctgtacatcagttttgggaagtaatttatgatgaagttacaaaagcaattgcaacaaaaataaaaattgacaagtgggacttaattatactaaagagcttctgcacatagaaactatcaacagagtgaacagttagcccacagaatgggaggaagtatttgcaaactatgcatctgacaaaggtctaatatccagaatctataaggaacttaaacaattgaataagaaaaaaacaaataataccattaaaaagtgggcaaaagacatgaacagacacttctcaaaaaaagacataataagtggccaacaaacattaaaaaaaaaaaaaaaaagctcagtatcaccagtcaccagagaaacgcaaattaaaagcacaaggagacacctccctcacaccagtcaggatggctattgtgaaaaagtcaaaaagcaacagatgttggttagtctgtggagaaaagggaacacttatacagtgttaatgggaatgtaaattagttcagtcactctggagatttctcaaagaactaaaagcagaactatcatttgaccaagcaatcccattactggttatatatccaaaggaaaataaactgttttaccaaaaaaatttcatatgcattcatatatttatgacagctctcttcacaatagcaaagacatgaaatcaacctgggtgcccatcaacagtgtactgaataaacaaaacatggtacatatacatcatggaatactacatagccatgtaaagaaacaaagtcatgtcctttttagcaacatggatgcagctggaggccattatcctaagcaaactaatgcaagaacagaaaacatgaaactacatgttctcacttataagtaggagctaagcaataggtactcacggacataaagatggcaacaatagacactggggactacttggcagagggatggagggggcaagtgtagaaaaactatgctcattatttaggtgacaggaccaatcataccccaaacctcagcatcatgcgttatacccaggtaacaagcctgcacatgtacccccttgtatccccccaaaaaaaagagggaaggaaggaagagaaggagagagagagtgagagaaagagagaggaaggatggaaggaaggaaggaaggaagggagtagggagggaaggaaagggacagaaaagagggagggaggggagtcagaagtgatactactctcctgttacccctaccctagcctagcctggaagggctagaggaggaccagctaatgtgcaggccctagtgcacagtgaaaacaggggggccctgtttaaaaattattaagaatttccacacattgaccccagagcattaaatcaacagcagggctcttctgagtgcaaggtgagactgcacaggtcacaggtccatgaagctgccgcagctagagagacctcattaaagaaaccatcctgctgtccccattaagaaaatgcatgcaaatgggtacaagctaggtctcaatgaattataataatacttgatgtttattgagtatttactatttgccaggcactcctctaagcatttgatgtgtattaactaatttattactccaaagtaggttttattattatatccattttagagataaagaaattggagctcagaaaggttaagtaacctgcccaatgtcacacagctgctaagtggagccatgattgcaaatccagtcagttggtatccagagcccatgcttttaatcactttgctcttgtttctctcaacataaataccacttctccagaactctccagtccacatcccccctgactgtggcaaaccagggcgagaacagaaatcagtatttgcttacttttatgtcatagtctaaacctacatatacattccaatatctaacttgcttttcatggttttttttcccttctataaataaagaagggaaaaactggcctgtgtaaaacaaagtgaataagagaaagaagaaaagaaaaattgttggtaattctatcaatcagacataaccactggtaatatataggtatatagacatctagccatcatacatgtttctccaaatgcattatacttgaactttaaatgtaatagtctatcttggagagttttccagatcactagattttcttagcagcatcatttttaatgtccctccactatgacattttatttgtgtaagataatgtatgtattcatatattgttggactttggcgctgtgcaccatttttgttattcaaaatagctctgggatcataattgtgtaggtaaatctttatatccatccatgattatttcctgagaaaaaattcctagaatttgacacactaggtcaaagggcaaattatgtttacttaagaaattaaattaaaacaaaacaaaaagaagacagcactgccaccttgcatttcaaacatatcactgatggcccgtggtgatgcacggaggtttcctgcagtgcacacacactgggacggccactaacactttctaatgatttgtttcatgccttcacaccacctctgtcctgccatctctgttttagattgtggccaagaaataccgcaactatgatatcccggctgagatgacaggcctgtggcggtacctcaagaacgcctatgcccgtgatgagttcaccaacacctgtgcagctgacagtgagatcgagttggcctacgctgatgtcgccaaacgcctcagccgatcctgagcacagccattttgccccatccccgctgcagaaggactcaaccactcccctaagactccagcttcatagactcctctgtatcactgccttgaggcgcactttttataatcaagcctcatcttgctggtatcatgggaactccagcctgctatctttcatgaaggtcagcaccatccctggcctcctcacataggaatctagcagaaatgatagacacagtccacctttcggccggccagcctgatctgggctcagcatgtttggggtcagtcagtgttggagagcccacatatgggattgccactagcttcttctgccaatatcaaaataccttctcagatgctttagaaacatgcaacaccaactccttttctaccctcctctccgtccatacctacaaggccaaggacaaacgccatcttcatccttcttagaaagagatctattaccccattaggggagacagagagagtgaatggaggagtaccgagctggctatggacttgggtgtctggcaaacacagcttcagtctcactacttctgacactctggttattgggcactaagggccagactggaaagtcacttgagacacattctcagtttgttgcagtgccaggaatgctgcgctgctgctgctgcgcacctggcccatgctgtccctggcttccatgccgtccaggccctgccagaaaaggaaattggcatgcaattctaaactgcagtgactgggatgggaggggaggggagcagtgttgatgccaaaatacccacggggtctaccagccatggggtttgcttgcttaggagtagttgtttcagaggtgattacaggcctgggtttgactgtgcttaccaatgagtggtttttgagctatgagaaagtggatgggagtgggaggaggagagatgggtgaagacaaaagagttctttatgagcctcgatgttccctggtaaacttttaaaaaggccttctctcatgatctaagtcttggactggtggcatcatgtaactgctaaccttacagtaaaaacccaagaatgggtcaaaaatgtcttcccagtttctccaagctgcttctggaatgcaggtctgtcggctgggtgctctccagcagctgctcctgcctgattcaactgtagcctgtaatgggtaaaagccacatttaggaggtggtctgatcatagaacaccttaggaagaaagtccatgagactttctgactaggaaaccatgtggtttgaacttgaagaaaaatgtagacccatctgggttaattttcctacaatctgactcaactgccaggtgaaaaaaaaaaggaaaaatttttaagctaatatttcactcttttgtcattctccttaagtttcatctcctaaaaagcttacccagcctgagcttggggacctgtgcagaggaaactaagaaaaatgcactcatcaactccttctcccagtgaacgcccggtgagaaaatccatttgccacaggcccttaccttcaacaatcccccttctatagtgttcgctggtaaagggtgaggctcccaagtgctggaaagcccctggacttggctcatttctcagcaagggcaggatagcacgggtcctttccatagaaatatcaacaaattctaacccaagcaatccctggacctacctgcctccagggatctctgaagaaaaaaagtaacccattgatcaaatcagaggagaggaagcaggaggtctcctagagcccattgaggaagaggaactttctcagtaggacactttataagcctgagaaagctttgaaaaggcggaatgagttgattcatttccacctcaaaaggaacctttccaggtccccctggaaattgtgccctggagatgtttaacaaggagaactggtgaggaaagagtccttttttactgtagggaaaagccccaaactggcctcctgggggatgagggctgaaatgatcccgaaggccttttaattagtgtgaaatcctgctgtactcagaaatccttccccgaatttacagcacaggcaggatgacctaagaggcagtttacttccctgagacccacagttgggctgttctggaaacacatctgtgaatcatagccaattgccacagagaaaacagaaccaagcctccggtgaggccactccaccccagagaagtctgcagaattccaaggactcggattggatgttcagaattcagcaactggaaagtccttaaaaacaaacaggccaaaccaaatcaatattgctgtttctagatgtcccttctgtggttgagctagttttacagagataaatatattaagacaaggaggtgggggtgttatatgatcaatgatagccatttgaaagagagggaggagtacagaaggaaggcacttctgggtacttaattcagaaatttctttatatttcagcactggattatcatataatgcaagtgactatggactaagagttagttatggtgtcttatgactagatttattatggtatattaaagtaacaataatattaatattaccttcctttttttttttgtttcaaaagagatctttctccagatgcttcagcctgtctggccttcttatcatatgtgcagcacatcatgtctcagcaacagtgtggtgaggtccttaggtgtcccaagaacaactcagggagcacgggagggtctgcagttgggaccccacaactatacagctatagggtaggaggcttccttttcattggtcctgaatgaatacaaatcgctcagaaagca

SEQ ID NO: 469 - DNA, 5982 bp, Homo sapiens
gttcccgccctgtgctgaggctgcgcagtcggtgccatcttctacgcccctgggagcgttgtggctgctgtttccttcggctttcctcctcctgctccaccatgtggagccgacggcagggccgcctcaggcccacggtctgcggggtggaggagctacggcgccgccggcgggagcgggaggcaggtgtgggcggccgagggagcgcgggggtatatggcggtcggggataagttgagaccccaggctcggagccgcgggttctgggttgtggtcgtccttcccacgctcagccggctcctctgcccccagcactgcggaaggcgcggagggagcagcagctggtcagcaagaggctgctgagaaacgacgccccagaggaagctggagagggatgtgtggctgcgatcctcggggaaaccgaggtgagggggcaaggtagggtgcgctggagtccacgcccgctggcgccagactcccgggagtactcgaggtctgccccaaacctgaacgcaatccactctacacttccacgcatccagtgggtcaagccagaaacaggggaatcatcctgcacaactctttgacccacaaccccatatcgatccatcatcaagtcctagttgtttacctcctgaagagctttggagtctttacatgcctcaccatcgaagctgccaccaccacctcctctctggatactactgcagtctcctaaaaggtcaccctgcatctatgcttgtcaccgtcactacgtcctttaaaaacacgtggagaccaaaatctttcctgtgccttgcaaagcatagcatggtctagcctcttcctaactcaaattttatcagttttctcatcctacccaccgtcctctttttagttcctgcaacgatatatcggatttgtgtctcaagcccttggcattcgctacgtctaacgttcgtttcttttggtattctgtcttgagagcctattttttttcttttcttttctttttttttttttgagactctcgctctgtcgccaggctggagtgcagtggcatgatctcggctcactgcaacatccgcctcccgggttcaagcgattctcctgcctcagcctcccgagtagcagggattacaggcgcgcgccaccactaatttttgtattttaagtagaggcggggtttcatcatgtttgtcaggctggtctggaacacctggcctcatgatccacccgccttggcctcccaaagtgctgggattacaggcgtgagccactgtgcccggccacctacttgtttcttgtagaatattaatcattatctaatggtttgtctattgttatttctccaactagactttaattgcaggaaaacctagatcctgtgttgtcattgaaaacccggttgcctgcacattatctggcatatagttaagtactcagtgtttattgaatgagtgaatgaaaggatttattcagtaagcattgagtatcccctgtatttgtattatgtttacgtacatagtttaccgtacataccatgttgacatatatattatcaacttattcctaggtcatactattccattgtatgcttactttatgccaggacactgtgctggtcactgaggtacacaaagatgaaaggatagagtccttttctttgaggtgctcacagcccggtgaagaagacagatgtcacaagggaaggaaacatgaggaacaagagaaactcctaagtctctcaaaaagagctaacttcccagaggaaatgaggagcagaaacctgaagagagtgggaagctggagagggtatccaggcagaagaaatagcatgtgcaaaagctcggaaatgtaaaaaaaagaaaaagaaaaagctcatgttaggctggttgttgttagagtgtaggttgcatggggagaatggctagaggagtaggttttgccaggctgagaggtttaaatatccttgaaagaaccctgtatgaaggcaggatagatattgttattctcattttcaggtgaggaaacttaggttcaggtcccatatggagtaagtggcaggtatggtattagaactcagttctgattctctgtccactccactgcaaggtagatgcttattagttgcattagtgtgaatgacaagttctgaaggtgtgatattggaaggctcacaggtgaagtgggcagagagagacttaggacttgctttctgtgaaccgtgtgttctcctttccctgccctgaactccaggtgcagcagttcctgcggcaagcccagcgggggacagaggaaaaggagagagagggggctctggtcagccttcgtcgaggcttgcagcaccctgaaacacagcaaaccttcatccggtcagtgtggatggtgtggtggagggaggagttggggctctgagggatggaccacaagctaagcagggctctggtactcactcacataggctggagggcagcatgcggaccctggtcgggctcctgaccagcaaccaggccctgctgcagcttgaggcggctcggtgcctgcatgagctctctcactccgagcagtccactgttgctgaggcctgcctgccagccacttcttacctcctcacctacctctccagtcacagctcagacttcatagtaagccctgtcccttcctatcttgttcttggtttagattttaaaattgtgcttttgggaccagtttgagctggcaggtaggaggaagaaaacatgtttgcccttatgcctacagccatggctacacccatcatctccccaccctcttgtgagccgcaaggatagctgctccagcgtccccatcacctcccctccccatctccccacacgcagcctggcatgaaacaggccaagcccagtgcttttgttgcctgttctcaggagctgtgtctgtatacactgggtaacctgatcgtggagagtgaggctgtgagaaggcagctcctgccacagggcattgttccagccttggctgcctgcatccaggtgactcctttcttcctccctgggcaacccttcctttgctcctccccacatgctccatctactttggttaggtagctccagcctctgccctgtgccaaggggctgaaagtctctgaagacctgatgacccagcttccagtcagatccttaccctgtctacttccagtccccccatgtggctgtgctggaagctctcggatatgccttgtcccagcttctacaggctgaggaagctccagagaagatcattccgtgagtaaaattgtctttagatgtgcagccagaggtgacccactcagtagtatagctcccggatgcctgaatgatttccaaagctgttgcacattttaaattcatgtgtctggctaggaagggctttgggtttggacactttcccatctgggcagggctttgggtttggacactctcccacctgctatcagggtttggtaagaaccactggcatcttcgtggttcctacttacagccctgcttctgccagcagctccatcttggcctccactctccctcagcacatgctacaaatgttgcaacctggcccaaagctcaaccctggggtcgctgtggagtttgcctggtgccttcattacatcatctgcaggtaacagggcaattgggaaagtaccacagatcttccctggggctcccttccatgacattcaactctttgaacttgtgtctggaattgctatagtgagttttcctccctccactgtcttctctttttggagcccaggagacccacagaccttagctgtttctctttttttttgagacagtctcactctgtcacccaggctggatggagtacagtggtgcgatctcagctcactgcaacctctgcctcccgggttcaagcgattctcctgcctcagcctcctgagtagctgagactacagatgcgtgccactatgcccggctaatttttgtatttctaatagagacggagtttcgccatgttggccaggctggtctcaaactcctgacctcaggtgatccacccacctcagcctcccaaagtgctgggattacaggcataagccaccacgcctaggcaactgcttctcttcttaaaggtggaattgactatatacctagggactgcttgcttcctgttgcccagccaggtcagcaatcctctgctcattggccatggggctctgtctactctggggttgctgctgttggacttggctggggctgtccagaaaaccgaggatgcaggactggagctggtaggtgaagatgtcaggtgaaattctgggagatgtttcttgatactctggaatgcaggtaacctcttccttcttacacctgaccccccaatttgtctttgcagctggcatgccccgtgcttcgatgtctaagcaacctgctaactgaggcagcagtggagactgtgggagggcaaatgcagctcagagatgagcgtgttgtggcagccttatttatccttctgcagttctttttccagaaacagcccagtctgctccctgagggcctttggctcctcaacaacctcactggtacgcaccataatctgcccaggcctggacatttggataatggggatatttcctcatggcctaggctgaggtgggtagtattgacaggggtggtgggggaaagcagtttttcaccctggtacttctcttccagcaaacagtcctagtttctgtacctccttgctctccctggatctgattgagcctctcttacagctgttgccagtatctaacgtggtgagcgtaatggtatgtattggggttacttgaatccaagatctggtagtcggattgtatgggacagcagtcctgagccctcagatgtacccttagttgagagccagcaggtggtggtgtgtggcctcagggcccaaccaatctaggtgtgtgtcccttaaactggattatttatccttggacaaatcaactaaccaccttaagcttcagtctcctcacttataactgaggataatcttgcatcatagggtagttgtaggagtatgagaacatgtatgtagaagagcttggcatggtgcctgggcatgtggtcaccatgtcatatattttagctattgttatgatctttgtgtttcattctttgtagactatatatgtgtctatctgcaggtgctcacagttctgtgcaatgttgcagaaaagggtcctgcttactgccagcggctgtggccagggcccctgcttcccgccttgctgcacacactagccttttctgacactgaagtagtaggccagagtttggagctgctgcatctgctgttcctgtatcagccagaggtataggtttctggcccacatcctcagtcacccctgttctgaagccacacagtggctcccttcccatccagtcctaactatagttgtttctctgggcctggctaacctatataggttccatgtcagaaacttcatcctcttgttggggaatgcaccctctggagtaggctgacccatgaggctgtgggaattgagtcttaggacacagagaccaggtgtgttgaattttcttccctgcccctaggctgttcaggtcttcctgcagcagtcagggctgcaagccctggaaaggcatcaggaagaggcccagctccaggatcgtgtgtatgctctccagcagacagctcttcaagggtgatcttgtttctcaatgtcactcattcccctctctcttaacatcaagcttgtttgtccagtagagcctttggagatttaggaccataatgaggtctcatgttctctgctcccacacctaagccaagacctttgggtcccagctcctccccttccactcagcactatccaggcaggaggaccaaaagggactcagtgtggtctacttactctggggccctagaatccctgcccccccgccacccttcatgtttgcttcagcagctggtagcttttgatgagacagaataaagttttatttttatattaagcta

SEQ ID NO: 470 - DNA, 96332 bp, Homo sapiens
gctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcgggtaaatgcaaagcttcatttcaggatatgacaaaaagtcaagccataaatgaaatgtgaatatagagggtagagtgatggttaggatagcatgtgtgtttgtttgagcttgcgcgtggttagtgtcatgaattaaataacaaaggctgttgttgagatgtgcgtgcttctctaagctgttcccagtatgagttcaacttgctctgtgtggttgtggtgacagttgtgttggccctgggtgctctctcgccaaaggagaagtcactgcagaagtgtcaacaaagaacgtgtgtccttgtccttttaatctgtgggcagaactcaagagaaatgtctttattcaccaaacggttgcctgttttcaatgtcctatcacctaaggagatactggagatagatggtttctcgaagggctgaagttaaagcttagaaagcaggaaataggtatactctgtttctctactttttttttttctatttgacgttggatagattaatgtgttataatttgaattagaaactccagtaccactaaggatacttccttatttgttcttctacggctaaaacgcatgggcgtcatggttacagttttagaaagaaactgggtactgtagcttcacacagactatatttctgctattttttttagtttgtctagatgagttcagactctcccccgccccactaagttctctaaatatcacacttccttccacccgctggcctctgtgtctttgaagtttacccaggaggtggtgcaactttgtgttgctgacatagcttggaaggctttttctgaggatgtgaacctgattgtcaactctattcaaagtcctgtttcggaaatcctccctgttccggtttggaggcgtcctctatcagaaactacacaccagcagagatgcctgcccagtttatatttttctctgacattgattaaaacaaagaaaacagcccttgcgtgtgtgtgtatgtgtgtgtgagagagagagagatgggactgctaacacacacacatgctcttaaacttcctgcactccatttcttaatattcctgctccctaggtaataagcatttatttaagcgagcaagatgcaggttgatccttacagaaggacttgctattctgtagaaaaccaggaaaacagtagcacagtcaaagcggactggaagagaatgaaaaagctagcaaggaatgggctggaatggtcgtcatgcatcaacgaatctatacatggtctattctgagggggtaaaaaagaccggtatgaggtcgtttacacaagactgggtggcttgaaaatccaatctagctcagttgttagaaaagcaggactttgggcaggggcgtgggcatcccttgcagacctgtgcttgccaggcagacaaaggggtctttagaaaggtgatgaatgggcgcatggggctccgatgagaggcagaggctagagcttgagggtcgaggctctttgttccctcccgggccgtgggctaggaggataagcctgatcccagacaaagcggccaaggctcactaggactccgagggttcgggcccttggctgggaccctggagagcaggagtgggcggagcgagtgagaagagggtcgccagatactgccgaggtgtccatctccgagcctccctaaaccgtggccaggaaaaggagcgcacctcgagtccctgcggggaagcggagccgggacactccgcattgcacgggtgtcatttctcctgtggccctttcctggacgttgccggctggtgggcgcagccctaggcgttaaggaagaggaggcgggcactggcgcggcggttgagctagtcgggctgggcttttgcccgcatccttttcaagctgaagcagtttcctcccagcttgactgagaaggcgttggggcaggcgcttgagtaaaccaaacaggaagagaggcgcgcaccggggttatcccctgctgccagagcgccggcggcgagggggaaagaatgagtgagaagatagggggaaacctttattgcaggactcaggctcttttggtccctcccctccttccacccccaccccacccccaccccccacccaaagtcactttcaaagctcagtcggcaactggctcctccttcttaatcaaaacccgcaattacagtggggcaaggcagagggctggccgcgaacgtcgcgcttacacccgtgccctgtagcgtcctgactgccttggtctcctgagagaccaagactgtgcaaggagttggagctgccaggaacaatgcgagggcagctaggctccctgagcactttcctttttctccaggatgaaaggttcgtggaaaagcttgtgacccgagctcattatttcgtttcaactcccaaacagcgcttctggtggaggagttgactcataaaaccatcaaatcatctcattgactgtctttctacccaagccacgtggagaggccagttttgagttttgagtaaactggaatggaggttcggctccagatcccggtccagtattcaagtgaggtaaccaaggcagtctctggcctttggggggcactgcgagccttgtggcttggcagcagtttcaaagaagggccttccatagtccttgaatcttgcatcactaccccagattcatatttagcttttctgctaccaattttgcaatacaaggcagttcctttatcccttcgacccttcccccccgcaaatgggggtcccatctatagttactcttacagtatgccacaatactgagcagtcataccacgcagatggaaaaatagaaaaccagcacaaccttctcaccaaccatccacattctcatatctccaaaggaatacctgcgacatgtttttttaaatacataaggaattgttccagcataggtcaagtaatgattattgaacatctaaaattcatatttccttccataaaagcctattagttaataaagtttaagttgaagagcagtgaaggcattaagtggtgtgttcttgactaactttactttcttagtagacctcacagttggcttatgacttaattagctctttgtgcacttttgggtataactggaaatgtgttaatgtaaggctcccacaagtaaaatatgtaagcatcctcatttaatgagataatatatttgaaagtgtaacataaactttaatgtcatataaatatttgttttgttagtccttaaatcttgctacacactatttttctggttgactacaaatgagactaacttacttttcttattatccaaagatctctcttataatttgactatgtactttaggttgtattactaaataatcaacaatattagttctaaaacctatgataaaattgaaagtggaaataaatatttttacttagagtattaccattgacagcaaagttagtcccagtttgttctaggatgaaacacaacctcgtgagtgcagaaatctagaatttgcactttacttcacatttcacatttcacaattctactaaaactcataaattaaggtagaaactatcatctttatttttagttgtttgacacttaggtaatgaaaatacaaaatggcctgctgtgtgtattcaggcttagtttcatgcaagttctttatttaaatttttatattaaagaggaagtttaacctagttaaaagggaacaaatacattcaaaagccaagtcatgaagagtttcagtagggtggaatacggggcttttgagacctaataccatgaagtgaaattaatcatatgtcttacgtactgcaaaactaatgaagtaaattgtggtgaagcctggaaatatttgtagacactaggttacctaaaaaatgattaattcctgccactggtatcacatagatgaccatcttagtgaatttttctttgatccaaataagcagggatcctttgtattatattgatttatgtggagtgatttcgttgatgtgtttcgctattttccttttaaaagtacatattgaatcttcttgtagatgatcctatgcaataaatgttttcagtgcagctgttcaaaagtcatgtctgatctggaatgagagacaagtaggggggtggcaacatccttcaagcttcgcattcatgggaaggaagagccttttctgagacagaatgctaccaaggtcatgagtgaaacatcccatgggacccatttaactttatacagagaaatttactctagagcttcagattgtactaagtttgaccttctcccacactgactataaaaagtgtgactagttgtagatattttcattcaaaattctttccagtgatgaaagtctgaaatttggcttatcaccagctcaatgaaagcaattcaaacagcggagtaaaatggtagcattttattcatagaacactgatttaaactttttaaatcttggatattctgaaaaggcttggcacaactgaaaacatcatatcaaacattctgccatgtaaaaatgtatctgtatttctaggtcaatgaagcaatcatctatagattatttatgtagttaattatttagtttttagagacagggacttgtgatgttacccaggctggtctctaactcctaggatcaagtaatccccccacctcagcctcctgagtaggcactgccaaccatacccagctcttccacacatcttaaagagtgcaagcccatgcatatttttatttctcctatgaaagtttattggtggtgaaaataattattataatgatatcaatctgtggttagaaaaagatgacactgatacatcaattaataaggtgatgattagaaatataccttatccacagaaatagtgatagtttgcacctgaaatcatgtagtcatatctcccaaagtgtgaacgttagcttctgtgtataaccacatttttattcataagtagctattatcattatgaatataatataaaaattgacttctgggccgatggtcagtaaagcacaccccgtgttttctggcatcctaaatgctccctgtaaggcaatcattatttgccatgcataggcatgcaaacgtatcattttcatcagtaggatagtttaagatattaatttttatagaattatgaatttcacagggagtagcagcctatgatgatgctttgagctgcttcagatttaagctaacatgtttaaaaaagaatgcaaaccaaaataccaaactataaggcttcaattacagaattcatcgaatagctgttacacaggcaatgtttccattgatactaggagaggattgcctgcattaaaaaaacacagttttagactttgttatggagcaaatagtcatgttattttttaactatatttttgactttctaagaagtaaaaggcgatgtaaagaaataaatacaaatattcaaagggctatggttactattcgtataccataagaagtagctttttgattttctgagtctgggtttacatttataaagtacaagaaaatggtctattgaataatgaatttattcagatataaatgttttaatggcatgcatgctattacaggtatctgccagcatcatcactcccaccagcacctcagctagtaccatgccacatgatatactagcttgacactattggttgcagggaggtagtttttttaatgtaagagaaaatactactaataatgactacttaatgagttttctctctactataatctctgtctctccaccaactgtcagggaagtgactcgttgagatgttttgaaatcaatgcaatttttgaaaaattacttttacatgcagagccttacttgatcctcacaaagccattgtatattacataaagttattgtaattttcaaggtaaggtaagactactgtggcttagaaagagaatagagtctaggaactcaagcaagtcatagaatcacaaacatgcccagatcacctgatattccaagttattcttgcttcaaaacagaatccccttctattatgcatatatgccttctgtaaaaatgaaattacaatcttaggaatcacaattatacagatggaggagcacttacaaaacattctgtctctgttgtctaaacagagctagtgaggaaacagagcttatttgttttatcttattttagttgccaaacaataattgtatatatttacgggatacaatgtgaagtttctacacaagtatacactttgtaatgataagatcaggctaattagcatatccatcacctcaaaagcatgtcacttctttgtagtgtgaacatttaaaatctcttggagctacttaaaaatatacaatattattaactatagtcactgtgttgtgcaacagaacttattcctcccgtctaagtgtgaaattttgtacctattgaccaatttctccccattccccattcactctttcttcccaatattctgttctctacttctatgatttccactgttttagaatcaatatataagtgcgattataaggtatttatctctatgttttacacttattcacttaccttaaggtcctctaggttcattcatgttagcacaaatggcaggattttgctctttttaagggctgaatagtactccattggtatatataccacattttcgttatctattcctctgttaatggacagttatattatttctatatcttagctattgtgaataatggtacaatgaacttgggactgcaagcatctctttgacatcctgatttcaattcctttgtgtatatgcccagaggagagattgctgaattatgtaattctgtctttatatttggtgattttttttctttaagtaccatagagatctttttttattcagaaattgtttaatttcaaaaatattacgtgtagattcttgtcctgatagtcatattcacttaatcctcataacacctttcatcatgcttgcgtatttccttctaacttgtaggggaaaaagtatctaaaattcatcaccagtaattaattcaaattatgtactgtgctgtatacacaaaatgtttcttactttcacaaagctggcaattttgttttgtttcagagatggtgaattgtctttgagtcggtcacttgtcaatagctctgataaaatcattcgaaaggctggctcttcaatcttccagcacaatgtagaaggttggaaaatcaattcctctttggtcctagagataaggtgagtttctttactaaggcataataaatttcacatcatgttctcaaatacgttgggcttggcaaacttgtattcaacactggatttatggtttaagtatgaatacttaaataaaagaatgaaccagctctatttaatgttgctcactgaagaatatgaaaccataaaactgaaatcattatatagtcagagatttaaggatgaatatgtgagttttgaatatattgtctttatactaatggaataaaatattcagcagagtactgatatttaacatacttcactcaattactcaggatggacatatattttaagaattatctttaacttccctattgagtcttcattctgcttttgggttttctcaactagctgaaaattagagcctattacactctattgtgctgacgattataaataaattagtcttatcctgtgaatgagtatttctgtgtgggctcatgttttaaaaattggataaaaatcagaaaataagctttctagattactgacttcttctttgtaagactagtcattttagctgaaacccactcttgaactcatactccatgcctacgtttatccagtatgtaattttcttctgatataaacctgttactaataagaaagctagagtcataccttcttaattatggaggaaacaggaagattgttttttctttatagttacattgcattactgtattggttggtatatttgaatcacagcatttcagtaaacaagaactcactaaaagtgtgaaagaatacattcgttatataataaaataatccaaaagtcaattaatagttagcattaacacacagattttataggtgtagcttagtgactaagatataaggggctaattaattttcctgggtttctacctactcacttcttgtattatacctacctttaatgtagattataagaaatttgaaggaagagtctattagtctattacactcatctttagagtatgcacagaaatttcacacaatgttttggagcaaagataattacagcatgttgaaatttacttgaacgaatgtctggaaattttaaaaatatgggcatcagggcgatgtaggaatagtattactactttggtttaaaggtttgaaattgactgggaagggaaacaggaatcaaatcatggcaatgtcaagtggtgtgtgtttgtttgcttttagtttggtgggagctttctatattcatgtgcctcctacaagaatgaatagatgagtagagtctgatgacagagctcataaatcaatgacttctgggtagaatatggccagcaagaaaaatttatttccactggataaataaaaaagaaaccttaaagccaatattaaaaaccaggaggctttaaaataaaagtacagatttccataaactcttgagaaattgaatgatttgacaactctgaatctgtactcttcctaaggtttagctggttaaagctgacactagtcatggtctctcaagtttgacattttcatacctggagctcacatctttcatgatacctgtcaagtgcattcttctctgtcgcatatccccatccttatatttgaatttagaaaccctgtgagagatgagataattatgaggaaaaagtcacaagatgtgagttgatgtggggttataaacacagatatactttggtttagaatggagtaaagattcatatttcttgaaggtatattggaaagagagagagataggtgattaaatagcaaaaatttgatctgtaagcagaaaaataactttcaaattggatggcttagcaagaaaggagccaattaaggctatagagatctggtaaagaaacctgatggaagaaagtaaaataaaatgttgtaatagtttaactagtatatctagccatgctaaataatgtgtcagatagcaaaaaatctaataagtaaattaaataagtaattgacactagttcaagtattatatctggtcatgcctttcctaatagctatataaaaatcaaatactataaataggctatatacattttgctattaataacatattcaagtgaagggtagtaaacctaacttgacccaaaagattcgtattacaattttacaaatcaatgagcattacattcatgtatttgagggtgatctattttcaattataatagctgatagtatgaatgaaatgttagtactatttttgtatggttctccttaacagattaaagaaataaacaataaaacaatgaacaaatgttgaataatacatacaaagttgtcacttccttgaaaggaaaggataatttgtaaaaccattattgtacaatgtgcaaagagttcataaaaattagaattggctatagcagaaatgactagtgagtattaatcagtttgatacctgtaataaaaaaatttagaatatgaaaatatctgactgttggcttagcttttgcaaatatttttgaaaagatattagaaactaattatggatcatttattattattgttattattttctttcttcctcacttttctggcatttaagaatttccatatcactttgggtcagtgattgggtgtgggtaaattttaaaagtgttttcaaaattctacttttaagtttttgtttatttttatttttatttattttttattttactttaagttccaggatgtgtgcagagcatgcaggtttgttacacaggtacatatgtgccatggtggtttgctgcacctatcaacccctcatctaggttttaagccctgcatgcataaagtatttgtcctaatgctctcctccccttgtccatcacctcccgacaggcccgggtgtgtgatggtcccctccctgtgtccatgtgttctcattgttcaactctcacttgtgattgagaacattaagacattatttccaaccatttttttatcttactgattcaactatcattataaatctttgaaatttaaaaatcttattaaacttataatgttcttattatattcctaataattgtccgcataataaaatgtgaaaacagttcctgagataatttttttttacatttgtggatatgattttcaaccctattactaatccctttgttcccatatgccttattttattttcataagcacaccaagaatcggttcatatgtattcatcaaacaactgtacttctatgcaattgtctatgagagatggttctgttacttcactgtactttgaggattcacgatatatggagtttatgcattctacagctaactttgcactcaaaataattatcttagttttaagccttaatattgttgataaaagtttgttctttattattataagctaagaaataacacatttaagatgcattaaatgttgtgaataaatctgtgaacatcgtacgggagattatgtagttatgtccaatacttgcaacttgactttttttccatatttggattatttattttctttttttgttattgttttttacatgttgactagaaaccccgaaaagtgcaaacatcaattatagatgtatagaaatgtacaaatgtacacatcaggatagctttatcacatcataattagaaaaaatatttcagctcttagtgtcatgatatatcaataatctgaaatacataaaacctgcaggttaactaaacataattgcaaatttatatatgcttaactgacaagaaaaatttcctattgcatacatagatttactttacaaaaacttctacatacaatgtttatactatcttctacttgctttgatcaataagttaccgatagagctaatcttgggtcacaaagcttattagtggcagtgtcaagattcaaacccagacctcctgactgaggaaccaggaccttataaaataattttgttaagaatatattttagtacccaaatgtatattattaaaatttatcattatggaataaatgattctctttgctctaaaataacaaaagtcatttttcattcaacattaccaaattctggaccaaatatcaaatggcactctagggtgtaaattaaactaaaaatgctcttcatcaaatattgtgggacaattttgccttttcatttgttgtgtttaagattttttttgacactaagatgtctttcccataactgctaggacttagaaatcctaaataaggtacagttaaacgttttattcttccagagctttaagacaagttgccttgcaaaaataatctttcaaaacaaacaaataaaaaatgtgtgttctctctgtttttttgtaggcataatgaaacactgggcattttttagttttactttttattttcttttagtgaactgggtcagtactaacttaatttacagtgatttttttttgtagtcagtgtctaaagtttgcaaaaactgattcctaacatatgtatcatagcctaatttgcttctcaacttgtgatacattccacctataagattcgtcacacagtattttctgatggagttaacaatgtcatttagattaaattttagttgcaactgtgtgcttattattgccaagaaacccacagagaagagtggcacttggtgataacttagttatatttaacatttcacgagtgaaaacttgttactaaacaatgtttagtaaattaattttctgggattctgcagttgctatttcaagtgataggtgacgttgaaagggaagttctagttgaaaattcagttaaaagtttctgggtagaactctacttgttgtcagttcaacagtccaaaccaacctttcagtttaaggctgatattgcctaacaaaaaaaatagtttttatgactaagatatttagtttcactgaaaatgaaacagattttcagattccttcagttatctttaatgttaaaatagttgctcaatttaggtgtttgcttatctaatgaggattcaaaagttgaattaggatcacaaaatgacagttaaagacctgtgaagggtctttttttgtttgttcttttgagtcatgcacagaaaacacaaccccttgctttgaatattgggtaataacttgaccacgtactaggaaaacttgtactggtaaagcatgcatattaagcattagcttttgttgattcatgtgtctctagatagagcgcagatattaaagccagttttctttctacctctctcatttctgaaataattttgtttgacctgctgttaaacaaaaatttctatcaattgtcttcttagcaaaagcatatatgttctccttggtgacatgttgttgtttcagttcagtttaagtacaggagttttctatgcttccaatgacatttagctaattatacttgaattttttttcatatttatagtctgaacaacaactagacttagcaaattcacaaagcttttaattcgccattacatctacaatctaaaaactgtttgcactaggagataaaaaactaaccttttcttactgtttccaaaaattatgaagcacttaagtcataatattattcactcatagtaattactttcagtctttcttggatcctataaatggaatcttaactcagataattttccatacgtagaagacctaaaacagaaactgaaagtttggttcaggaataagaaaaaacaaacaaacaaacaaacccagagtcactcaagtttacctctttttctttttactttgtaaaatatcgaattccaagttttgcctaagttttttgtgtttttatattttgattagtctatgtgagttggtagtcttttctgttttgaaatcacttttactattttcactgcttcagttgaaaaaatactgctgagcctataacaacattggaaaaacacataattacaatctgcatttagtaattatttatcttattaagcattagtttctcctaagagttagacaatatgatgtcttttaaaactgtgcttaactcttatagttccctttttaaatcatttttccctaagagtaaataaaataaagaggtttacttataatcaggaacttaaaagacatgttttacattatttttgcaactaactgtctataacacagcaaaggtgctgttattggaaagtccattttgacgttagttgactagcatgtgttaacttttttgaccaaataaaatagattttcccttttggatttccaagctacagagtcttttttcaaatcaggaccactagtttactcactgcagcttgcaaacatgccacttcttgggagtgtacatcttcaaatagatctacagcaacccatttaaattatattcaaagaaaaacgataacaccatctagcctgatgatttaaccacatccgtgtagtctctattttagagccagccttgtcgttttcacaggaaatgagaaatttctgttgaagtacaggtgtcagatattaattattcaccagacaaataagtggtactcaataaatatatacaaaaaattctgtatattgccacttttgatgctagttgttaacttttgtgaaaaatcattaagtgcttgacataaacacttttccagtttctataatgcataagccctagggttgcttatttaaaatataattatcttcttatataacctggactttgttaagataaactgttatggtgtgtcagtggtatttctatcaatttttgtgatttcatttgtagagcatttgtataggattttctgtacaaattctactggttttgaacctgatattcagaatatttggggaaaaagatcataacattattttttcaactagctggtggacatatttcttgtttataaaattagagcagagtttttcaatcacttggttttctaattagaacaaatattaaactggaaaatatttagagcaaatcaaaataaagacaacaaaagaaaagatatgagttactttcctcccttctttgctaatcatgcttatgccttctgagttagagaattactcttttgatggagtcaagggatgaggttatattctgctctcactaataaaatttaccaattgtgatgagcttaaaaaataagagcactagaggaaaaatgtttccatcatatcttaaatgttataataatgacattgtttttattactttgaaaatacaagcttgcactaagagcactttagtaaataatatccaatttccaaactaggtgtagcgttttctcaaattgctttttgctggtattatgttgtatatcccctattatgttggatacccctagaatcaaacaattccagacttttgtaggccaggttcatagtttgagtcaaacacaaccccctgctttgaatatcaggtaataacttgaccacatactaggaaaacttgtactggtaaagcatgcatattaagcattagattttgttgattcgtgtttctccagagctcagatattaaagccatatatatatatgtttttttttttttccttaaaatctactagggtcccggactcttcccttcttgttagttccaggtgtaaataacctcatccagtgatttcttctgctcactgttcttaacccttggaactctcctctaattactctgacctatcctttcctcctctcaatttaatggcagctacccttaagtcattttaatctatggacttatatgggaaggcaatatcccttttgctgcctggatggctccaatttatagtggtatctcttgctgattggggttacaggaacatttaaaaggtcccaatcaatagactctcacacagtttagattacaggcactgccagatatgtattccctttcatctcagcatgcaagttagttggctattttatgcctgacttcacctcttctagtgccttactaaaaggagaaactaacataaacgaacatacagacacattttaaacaattattcaagaacaacatatttattagatgcatggcacaacttccaaattattgaagacagcaactgtatcaggtgcttctctatatcatgccaaggatcatcagttttccagccagctatatatatatattataatcattttccatcatctacctacttagcatatgcatatatttacgttcatgtagcctctcaatctgttatcaatttatatattaggtatgggctaggctaagtattgaccaaaaaagtaaccttaaaatttagtggccaaacaagtaggaaatttctttatttctcacttaaactcacatgatccactcatatactatttaattaagaaaactaacttgcatgacccaactgagctctacttgggttttgagacttgcaaatattctagctgagcatccatgtgcccaagtaaaacttagaaggttcaaatattagaaggaagaagagaaaaaaggaaactaaggaacaattagctacctctgccacacagagtccaatgttctatctattcattttgtctttgatgtatccatcttacttccaggactcttgatcttagagaaaaagttgcatatacatctattgctatagttttaattcttctttagataattataatatacatatcatatgtataaatgtatataagtttgagaagttcattccttttaatagcattaactatgatacaatcaaaaacaatctcaaattatttctctccaccttaactagatgatattaaacaacacttatgactatcaaaatacgctgaagctagcagaataactattcaaagtcaagtcatggccactgtgttttacttaataaaccaatttttctatatattttgataattggagtgctttttataactccacaaatagatgtttatactatatctatgtatacagtcattaagaatctgtgcaaatgatttttaaaattttgtttcttatagaatcgacttaattcattggtttaatcaccacctaagattcatagcttaccaatttggtaatctaagattaatagtttgccaatttgtattttgtcttaagttactttgtaaatgacaccatcagttcttggatatgctgatggtaatgtaaaactttgcttgtatttcaaatacaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgagctttcttctgctttttgagattgtaagtttttcaaagatattttacttgggggtggaaaactgttagaaaattttaaagtattactaaaacctcaaacaaatatttgtctatgatatccttttctgtgcaacatttaaattacatttaccctggaatagaatattataattattgcgtagttgaaagaaaaagtgatcctgtcatagcaacaagattcacacagctttttttggtgaggtgaggggggaggcaaatggcaattttattaaatttaatattccacacaaacttttttcttagtatctcttcttcatactcattagttttgtgtgattttatttgttgtataaagattatgaatattactatggaatgatgtaatagatttatgttaatgttactttttattaataattatctaggagatagtaagaacatagtttagcaagtttatatttgatatcctgagccatatttctttaatttctctttatatgtggtatttgtgtatgttagtatatttgaattttatgtttttttaacataattaagcgtgcatgtttgtttttcattaacggttaaaagatatttgatgaattgtgtgtttgattaacctattaactgaaaaaaactcaacagtagaaatggaattataatcacatcataaatataagcagtttttaatgatcaatttttatatctgtacagtttttttggattgttttagttccttagaaaaattagctaaatgacagaaacatggatattgaaatatgaaatagtacaatataaagatagatagaaaagtatgctgagttgacatgttgaaaaacacagtctcttgaagatatactggaatacattatttttgaatattttgaatattttttgaatatttttaaataaagtcttaaaagcataaataggtaactacttttaaaaaaaaagtcatgagaaatcacactcaagcattatcaagtgaagaaaattcataatagcaaataaaactgcaaacattttaccttattatctttccttttctctcttgggtgaagggtcagagattaatgtgaaatcaatttagctttttaaaacttgaactgttaaactaattagactataagagaaaccttgtgaacaagtagatacaaacaaagacaattgtatagaaagaagatgtaaaaaatttgatgagggaatggcaatggaagtggaaatcaggagcttcaaatgtcgaagtctatgcgaagtatagctgtgaaaaaatgtaaggcctctagaatttctgatgtgactaaatcataagtcaggtaaaacaaagaagtaacgatgtcaaggcataatcaaaattgttgcaatgtaaggatttcaacaatcgcaatagggaattttaaaaggtgataatactggaggaaaatagagtctaaatgacttcttatttctgtgtccctctaaactttgacactgggggccaagttgttagatttagccccacctgtgactctgaaatgaagactgcttttacatgtgggtaatgagagaggcctgatggcagtagtcctcaaagtttgtatcatttccttattgcttcctgatctggctttgttactccagtttctattgactgggattttgcattatttcaattcctaaactactgagttcttatctcacatggaattgtgtgtccaataagtaggttcctacactctttctctgtcttaagagtggctggtggccaaccttgcttcatattaccacctctcactttcacttttcctgccttcaatttctagaagttatatagcctgcatatatctcacttccctgcaattggctatggcaagcctataggtttccagatttctgggatgtagtcaacctgtgaataaaattctgatcccaaaaaatctttctgtccacctctcttattctaaaattgaagcctattttctctttcactggccaagcagcaactggccacttgatggtattgccttcacagctctactatggactactgggcatttagaccactactaagctactctggtgctactccagcaaaatgcctagaagttgatattgtacatatattttctcttccttttatgttttaggcacctaatttcatgcctactttttagatttaaaaccctataatctgccgtatattaatgcactccaatttcaatttggaatattgatcattcctgtagtaacccaactccagtgatgttcagtaaactggtttaactgtttttactccatattttgtggctcctagattctttatctaccttattgctaactatcagatggatttgaatgtctattcttagtttcttgtccactattgtcaatcaacagatctaattttttagcagaatagccttagcacttccttaagtggtgtattagtccattttcatgctgctgataagggcgtacctgagactggaaagaaaaagaggtttaattggacttacagttccacatggctggaaggtttcagaattatggcgggaggtgaaaagcccttcttacatggcagcagctagagaaaatgagggagatgcaaaagcagaaacccctgataaaaccatcagatctcgtaagacttattcactaccacgagaacagtataggggaaactgctcccatgattcaaattatctcccactggtccctcccacaacacatgggaattataagagtacaatttgagacgagatttaggtgaggacacagccaaaccatatcattccaccctggcccctccaaatatcatgtcctcacatttcaaaaccagtcatgccttcccaacagtcccccaaagtcttgactcatttcagaattaacccaaaagtccacagttcaaagttccgtctgagacaaggcaagtcccttccgcctatgagcctgtaaaatcaaaagcaagctagttactgcttagatacaatgggagtacagttattgggtaaatacagccgttccaaatgggagaaattggccaaaacaaaaaggttacagggcctgtgctagtctaaaatccagtgaggcagtcaaattttaaagctccaaaatgatctcctttgatgccaggtctcacgtgtaggtcacgctgatgcaagaggtgggttcccatggtcttgggcagctccgcctctgtggctttgcaggatacagtcttccatccagtttctttcacgcactagcattgagtgcggcttttccaggcaaacggtgcaagctgtctgtgcatctaccattctggggtctgaaggatggtggccctcttctcacagctccgctaggcggtgccctagtagggattgtgggaggggtggggggctccaacctcacatttcccttccacactgcccttgcagaggttatccgtgagcaccccgcccctgcagcgaacttctgcctaggcatccaggcatttccatacatcttcagaagtctaggcagaggttcccaaaccccatttcttgagttctgtgcactcacaggctcaacaccttatgggagctgcaaaggcttcgggcttacaccctctgaagccacagcctgagttctacattggcccctttcagccatggctggagcagctgggatgcagtgcaccaagtccctaggctgcacacagggatcctgggcccagcccgtgaaaccattttctcctaggtctccaggtctgtgatgggagaggctgccataaagacctctgacatgccttggagacattttccccattgtcttagggattaacattctgctccttgttacttatgaaaaattctgcagccagcttgaatttctccccagaaaataggtttttattttctatcacattgtcaggctgcaaattttccaaacttttattttattcagtttctcttctaaaactgagtgcctttaacagcacccaagtcacctcttgaatgctttactgcttagaaatttcttctgccagatgccctaaatcatctctctcaagttcaaagttccaccaatctctagggcaggggcaaaatgccactagtctttttgctaaaacataaaaagagtcacctttgctccagttcccaacaagttcctcatctccatctgagaccacctcagcctgaaccttattatccatattgcgatcaggcttttggtcaatgccattcaacaagtctctaggaagttccaaactttcccacattttcctgtcttgttctgagccctccaaactgttgcaacctctgcctgttacacggttccaaagtcgctttcacatttttgagtatcttttcagcaacaccccactctacgggtactaatttactgtattagtttgtattcagctgctgataaagacatgcctgagactgggaagaaaaagaggtttaattggacttacaattccacatggctggagaggcctcagaattatggtgggaggcgaaaggcccttcttacatggcggtggcaagagaaactggggaagatgcaaaagcggaaaccctagataaaaccatcagatctcatgagacttattcactaccctgagaacactatgggtgaaaccacccccatgattcaaattctctaccaccagggccctccaacaatatgtgggaattatgggaatacaatgcaagatgagatttgggtggggacccagctaaactatatcaagtgagaacctcattgagtcaacagttgtattttgaccttatactttttctgtgtgcaatgtgtgctttactttcttttagatttcatgagtattctataatatatatatatttacatccaaactttaaaagataaaattccttgcctagataactagtaatattaagtagtgtgaaaaaaatacttttaaaactttgagaataatgttgacatagttaacaaactagaattttctctcattggtatttcccaggcgctttctcttctcagagaacggatgacctcagatgaactaaaatgagagttattatataagaatatatgccacacaaaatactaactttctcaattcaaaatagacttatctctatactttgtaatacaagagttctttgacaattcaaacagagtttataaacttaaaaacaagataggcttgctggagttttaatttatatttttgactttggaacatcaccgtggatttttcaaacacatttctgtaaatctacaacctacttcagtctacctcccactgttggtgaatttcctacatgagtcttacctgcatacaaaatcagaaattttagagtggagaaagaatctgcatctttgaaaagcacatatatggggagttgacacttaattcactataatgtagaaatttagtgaatgtagatatatgtgttttatgtatatctaactcagataactatgtcttagagtgtcagattcatatacacacccacaggcacatacaaatatcttatttaattattttatggtaaatatgaatgagaaaaattgaaattgccataaaagtgccttgacccctttttcttcttagcattatatcaccaattaatcagcaaattctatagatattaccttcaaaaaatatcaggagtcaaatgatttctcatgacatccactgctgtcaccctggtaaaagccaacatcatctcttgattagaactctacaatagttccttaactgatgtgacgggttgcattcttgctccctgttcccaaagccaaagtctctcttcatcataaagcagcttcttaccacactctataaaatactaatatcttgccagtaacaataaatgaggtaatctgaagcttcagggacagacgatgtgcctgccagtcattttccctgaaaccctcttacccacatacctatgggtggttttaccccttatttgggggaaaggatgagggtctatgcttgtacagaatatcctctgcaagtcttctctgactgtaatatcagaaacaccccctaccactgtcaccatctgtcactatctctttacccttccatttatgtatttatttttgcattgtatgtttatttatttattgtttatctttacaactagaatatgcaaggcaagctttgcctgcatttatcccttttttaatctcagaccctagtaaagagtctgacatatttatatattctataaatatttgctagaggtaagcaagaaggcatgtagtaagaaagaaaagaagaaagggagggaaagaggaaggaagtaaaggagagagggagggagaggagggagaaaagtgttctatcatggtcttccgtcatccatcccaccttgcatgaatgataatcccttatacaaacttcaatattaccataataatgtacttggttgtctgggatgagtggctgtcacatcatctcctccaaaactacagctcatctagtcatcatctcctctaaaaccttaggtgaccaagtttcagagcaggatgcaaattcttcctacagtaaatgcagaagctgtcttactctgtctttcatggagaaacatatatttggcatctgttgtttgccttttagcccaccatctcaccaagcaaaacatgaggatctctgctttgcgtgcctctttgttttctcgtattaacatatttttaaacttacagtatatagtctataattccaaatttatagaatgtatcttatgaaacaatttgcatgaagttgaatttacataaactcagtgtcttacaacctagagaaatgttgtaaggtagaggctactttacatgtgcacatctgaaatcttttgataactagattttttttctaaactatcgtcatctctattatattattcctttaaagacacaacatctctattatttctttagaggtaaaacattcctttatattatatttaaagatgataaaattaaaagcaaatatattgggctctacaaattcaaatttttatgagcttaactttcaagaacaatttctaaacctttctctataaatttgcaatgtagaaatgagttgaatagccacagaatttactgatttgtgcttgaaaatttgtaaatggcagagtacacttaggactaggagtttaggagtctcttgatattttagcagctgtgattgtttaaaaagattacttaataagaactaaatagtgaccaattgaagttcataatgtattctggacttaccaagaagtatagaaaggtaaagataagcatcttagtgaaggcacaaaaattatcaccatgatcatttttgatttgttctatatttttactactttccaaaaatagaagttagaatgttgtagattaaattatttgctagggctctactgtctttcatgcggtacgggattatagatttggcatctgttgtttgcattttgtctcaccctctcaccaagcgaaacatgtggtactgcctaccacataatataatctacaacattctacaacaaaatttctgatttaccacaaaaaatcagattttctaatgaacactttagaaagtatctacattttagaaacaatatctacagaaaaaccatcttttgttacttaatagctagttgagaaattcattcctttgagtttaattttatcattttattatgaaattgtacgtgatcacttactgtattctacagtgtttaattgtggagatacttgaaaacttttctcagtacctatgagctgaaaaatatactcttttattgtaggaagcaataagcaaaacactgatagttggttattattaagtagttgatggttgtatcaaggttcaattagcacttaagagtcatcattacaaacaaaaaaatgagcaaaagtaatgcctgggaataaaaactttgcagcccagcacagtggctcatgcttgtaatcccagcactttgataggctgaggcagttggatcacctgaggtcgggagttcgagaccagcctgaccaacatggagaaaccccatctctactgaaaatacaaaattagccaggcctggtggtgcatgcctgtaatcctagctactcaggaagctgaggcaggagaatctcttgaacctgggaggccgaggttgcagtgatcagagatcgctccattgcactccagcctaggcaacaagaacgaaactccattaaaaaaaaaaatctttgtcacttctgaataaagactgtcacttcttgtgaagaggcatgtgacctcattcttctcatttgattaattaggccactcctaagaatatatccttcaaaccatcaagccgaaaaatgaggtgctatgtctggcaatattaatgatgaaccaaactctcccagtgcctaaactccctataagttagatccttttcaaaggttaattaatagccatttgaatttctgaaatcaaatcattatttgaggggtagtaaagacggaggagtaaaacagaatccaatgccaacccattttcccaaagacaaaagttaatttcagctcacaaataccaatttgtaattgataggtggagagtgtgaccataatttaaatatagagtatatgaaacaaaaatcaaagacaattttgataataattttaataatagaagctctccataatcacgtgtaagtgttcaaccaatagactttggattatttcttctggtactacgttttcccttaggatgatatctattttctgttttgagggtcatattgtgctacctcttaacattcttagatttgtaacaacccttgaaaatacaaaattctaatctgaattatgaacataaaccagtcacttcattgtggacacgagatcttcaatgacctattgtcataccagactttctttcttccttacaactcttgttcttcttgttgccttctgactcattatttgtgtaacaaacacatttccttcctcaagtgtatgcgtagccctttgttattgccaatgtgtctcctctactttagaaggtccagagaatttttgcttcaaatttaatcaatcctcattattctttcttgaaatagtttcctagccacattgaactggttaaaattattacaaaatttcagtaataatttttagaatccctagaattttttattatcctggagatgtgtatatatctgcatagctgtagatatgattgatttgttggatggttggttttacagtctgtgtttccacttttttgtttctcacttttcatttaacacagtaaatttgttgagagagagagggagagataaattatacctggtttacttgcagtgggcactaattagtacagtaactccttaaggataagatttacccaagtattatactcaagttgacctctaactttataaaccaaggtactctcttagtggctgtttgtatcattcattaatcaattacgttaaataatgcttttaatggggtatttcaaaaaatgagagtcctggtcaatatcattacatgatgcttaaagttaaaaaaagaaacagaaaaaaataggaaaataaattaaagctcaattttcatttcctaccgagtgactcaatatcaaactgatttctaaaatttaggtctcatgtacatatatccctaaataacagaaaaataatcataagagtaaaattcttatttcttaacaaaaatgtctaaaactctaatttaagtaagaattttaaatacactgtgatcaatgtttttatatgtggaactctaaaaatgcctagtatttttacgagattccttaaatagcaaataccatgtttcaaagaaagaagattggctaagatagaaaaacaaaggaagccagtcattggctaggttaaagatatcttacttcttgtccggcagtaccctctgataagaaaggtttataaaaaaagataatgtccttgtaatactaagattttgtcatatgattacagacaagcaaaattttgacaaatttggttaggcattgatgtgccatttatgtaccatttctcacctgcttgaggaaaaaaagcaaatgggagcataaaagaaaatattgttttggtattattccttagacgtatctcttcaaagattgataggaattctgaatactcttgatgaactaccttaaaactgcagaaaatgatgattttcccctatgagattctgtatgaaagaatgttcagttacatatataattcgatctctcatattctctttttcatctctgggataatttcttttatccttcagataacatctgtatttctggtattattaaatacagaggagtatagttttaggctttatgtctttgttttattaactaataaaagagaaattccaaatattcagttgactaatgctacacttctaacatcaatagtaatattgtgtgcagaagaaggtataatatatgtgattttaaaattgtaaaacactaaaacactacttgataccactacttttaacattagtaaatttgggaacctctagaactagttccctaaaatttgtctcaacaagagtccacattaatgaaaattctatcaactgaaatacattggttttatatttttcttgtaaacatttaaagagaaaattagctgttaaaagataaacgtcaagtttattttatcaaaaacactaacacttgttacattattttatttatacaataaactttcaagaggaccaaccaagagccagtcatgaacagtgcccaattacagaaatgaacatctacattcattcttaaaggacaacctgtgctgtgtggggtgaggaataatcactacaattcagagtctccaaagacacataccacatttaaaatatttgtctacggccaggtttattatttccaataatgcagagggactaatagaatgtttgaaagagaaattaaggtatgcttccaatgctgaatgaggtgttcccactcagaactttatctgaagtctttgagatatgtcaggataactaattaggttactaatctttagatatcacacataataaattttaagaagatatcattggtcacgttaaagttttatttaagtgccataagctatcagcattctactctacaccaaccagaacactgccaacatctacacaccttatataattaactattaacagattcagtcaccatcataaggggctgaaaaatattcaactgactaaaaccctggtggtctctacctacctgtactgtagaatactttgacccacttttagactttacatacagttcaggggattgtctagtacatatctgagctgaatttaacttacataacacttctttaatgccacataaaatggaataatgatagaatctttattaagttaaataaaagctagtaagcattagaaaaattgtccaattgatattattttttaaattttgcacttggattgtttgatgtgctaaatatcatgtaaacatagagatagatagatgataaacagagatgacagatagaagctgagcacagtggctcatacctgttatcccagcactttgtcaggcctaggtgggaagattgcttgattccaggagtttgagaccagcctgggcaacatgataaaactccttctctaaaaaaattaaaaaattagacaggtttagtgatgtgtgcctgtagtcccagctactcaggagactgaggtgagaggatcacttgaccccgggaggttgaggctgcagtgagccatgatggtatcactagactcgagcctgcataaaagagcaagaacaagagcaagaccctgtctcaaaaaaaggaagaaaaaagagatgacaggcagagaaatatagagaggggagaggggaaaaggagagggagagagaggaaaaggcacagagagaggacataaaaatatgaatcaaattgatgctgtgctgcactgaaaagcatcacttcagatatagtccaagagtccaatcagagtttattgtaggtgatattggatgaagtttttagcttttctatatttagttttctaatttacaaactgagattaatatatgtactctttctgtctacctggagttttacaacttacctattatagagaccacagagtgatagaattgctcctacaaaatccttgcctcaagtgtacccccaccatgtatgcttatttgtcaaaaagtgtgttgtaaaatttcaagaattgagagtttgaaagattgcatatatcatttatatatcaccataggtaaaggaaaacaggtttagaaagattccctcatacaatctgtataaagtgtctttcaaaacctttcttaggttctttctctttgagtacttttgaaattaatgtaatagtgtatatattacattaaggaatttaatttgttggttgtgaaaattgttttgaattttgcaaagcaatgcttaaagtgcttttacattttttctgtagttatctttcaagtttttacataatctactctcataagtatctacataaaagcatattctaatatttgtactagctatactcaataatttcacaacagtggttttcaataaaaaatattcatatatttcctaatagtgattttgagtgatggcagagagcaaagtctcattccatcgctcctagtctcctcttccccacctttgttggaaaagtggtggtaaattctttcctttctctgggatggctggagattgtagaaactctcaagcagcacttaagtactggttcctcatagaaaagaaaccttgtttccccttggtaacaagaaaatctggccctgcactgtctttggtgttatatggtggactctgagggaggcaatgattaacaattacaattggcacctaatattctttaaccatcaaataccactccttactttgtttaaacaaagctactagagatagtgagtcttctagagatagtgagtcagaaatcaactaagagctacataacatttttttttgtcacttttggctaattagttggaatttctaacttaagtttgtttatttacttatttctttctacttacctttcctccattctatcttctcctcatcttccctctagcttaaatcactatcttctatttactcctttttaatttcttaaccaacatcttcattccctgccctgcagctttttctctccttgactactttcctcctaatttcctcttggtgcatatgtttttccttataaatcaaaaacagcaataagatatcaattaagagggccacttaaatgtgtacttatttatgtaagtaaatccttgctactcaaagtgtggtcttggatgaccagcattatcacctggaagcttgttagaactacagaatgtcagaacttgcacctggtctgctgagtcagaatgttcatttgattacagtgtccaggtgattcttatgtgcattaaggcttgagatgtgctggcctagacaatatgccctaggcacgctggagctcccactatgtttgattttttttttttttttttttagcccatatctttaggacctagcaccaagattggtacactgaggttggtcaataggtacaaaattacagttagacagtttagtcaattctcacattgctaataaataaatatccaagactgggtaatttataaagaaaagaggcttgactcacaattccatatggctgggtaggcctcaggaaacttacaataatggtggaaagcacctcttcacagggtggcaggaaagagaatgagtgcccagcaaaggggaagccccttatgaaaccatcagctctcttgagaagtcactcactatcacaagaacaggacggaggaaactccctccatgaatcaattatctctatctggtccctctcatgatacttgagggttatgagaactacaattcaagatgagatttgggttgggacacagctaaatcctatcagacaaaaaggataaattctggtgtctatgacacaataggctgactatagaaagttacaatgtattgtatatttcaagatacatacaagaaaaaaattttcaatgttatcaccagaaagaaatgaaaaaaatgttaaagtgatgaatatggtaattaccttgatttgatcattatataatctatacgtgctgtaccccataaatatataggattattatgtgtcaattataaacacaaaataataaagagtgaataagattttttaaaaagaatataacttccaagaaaaacctgatacattgaggtatatataatttatttattgaatggataaattaatgagaaaattaatgtaggagttgagaaaattttggtttgtattcacgtatctgctgtcagaatttttaaaacactgaatttcaaaattagtacataagaggagtcatatataaagagaatttaaacctttacaagaaaatacagaactaagaagagtgatacagtgaaatgttctaaagattagggatcagaaaatctgggttcctattaattactataaatgtaatattagacaaccatcactattttcactgttcagtgaggtcaataataataggcctattaacagcagagtgattttctcatttatcagatgagaacatagtaaagaaaagcacaaactgtaaaacaaaactcataatgagtgatgctaaaggacatcttgtttgagttcatcgtcataggtaaaacttaaaattggcactgcattttctaacagccatggctaaaaggaaagcctgttgactagagacacaaattattattgtctgatatgaataagaagatgaactttccccaaatttatcaaacatatgtaaagttgacactaaataactggataaaactgacactgaataatatgttacacaatgtgatataaaaaacaaagcaatatcactcagataggagtgtctacaaaatctgagtatgtaaaattagatataaatgtagtgaagatatatatgtcttcagaaaactaaggtaatatggtaaagatatattatttaatgataatctatattcctaaaagtagggatgatatttttcccaaagaaaaaggatggaggaattgactggctggtacaatgcattttataattcaatcgattttttattctccactggtagataatttacagaaagctttaaatcaccttcttgacctccttgaatgctaactcttttatgacaaaatagacttttctggaacagaaaaaaaatatcttatttttctacatgttcacaatgaatggccttaagactttatccttctactctcacagaggatatgtattcccttaactcaaacagcaaatagcaaacagctaagttcatgatagacagccaagtctagggcactagaatgatgtttttaaaattactactaaaacgaataaccacttatagtttaggaatagtaacattgcttatctaatatttgctacacacattttctccagtaattttgcttaataccttattcatgattttgatctatgaaattttataatttgtataaaactaattaaattgtgatttttgtttattgattttaaatgcaaaatttatgttatatgtagaaatatgatttatatgttgttctaattatgatgtttaaaatttaacttaaaactacacatgaaatatgaaatataagttgtgatgagaggtacagctctttatttctaattatgtcactcctcacacagaaattattttatctacaagtaaaaattttaaaaaatggaaatgatgacaatatctaaaattttaaatgttttaaatgttttcacccattttctgaaacaaagattgtaaacgatttttcatatatcagtctaacaaagatttttaaaatgtttactagtcagtaaaaagttacattgatgttggcactctcgtaaaatgcatttggaaatgtaaactgataacagcttttccaaaaatcaagttaatgatgtcttccaaagccttacaaattaaattaaatcactgtacatctgaatgattattcaacatgtgacgaagaggaatctgaagcaatgggaccagtaagcacacagacaaatactttccatgatcttaagataagactattcacaatagcaaagacttggaaccaacccaaatgttcatcaatgatagactggattaagaaaatgtggcatatatacaccacgcaatactatgcagccataaaaaaggatgagttcctgtcctttgtagggacatggatgaagctggaaaccatcattctgagtaaactatcgcaaggacagaaaaccaaactccgcatgttctcactcatacgtgggaattgaacaatgagatcacttggacacagggtggggaacatcacacaccagggcctgtcgtggggtgggggaggtgggagagatagcattaggagatatacctaatgtaaatgatgagttaatgggtgcagcacaccaacatggcacatgtatacatatgtaacaaacctgcacgttgtgcacatgtaccctagaacttaaagtataataataacaaaaaagataagacagaatttgagaccaccctattgttaggttcgtaataaagaacattcaaggggaaaagccaagatatgctgaatttaaatgatgaaggatcatgacatcatgttaagaatttgcatggaatcttatagtccaagaaggacccttggagtttgttagcatgttggtctgctttttgtttgtttgtttgagttttgttgttattgttataaacagaagagaaacatactgagaagtacagaaacatgagcatattcacacttggaaagaccataataataaacagataaataaaatatatgaaagagaaggcaccctaagtgaggaagatattagaggaggaaaaaagtgatgacattcagatcatagcagaaagtaagatgataacacctagtgtcgatggtatgattcatattaatgtgaaatgttatcattgttatctgtctttgacatgaaatggacattagcaaatggtcggtagatctatccttctatagatttccaaaatatggctagagtttttgatttaaagtacttgttatttttcaactatcatacttatctgtaaataagacataggttaaaaatgtactccaaagccaaacacaaatacacttgtcagtgcctattgtttcaagttatatgtaattataactttcatctttcttataattgttcttcacttcttcattcagtgctttatcagaaagttcagatacaaatataaagagcaagtttcgacttttgaggtgatcacactctaatgaaggaaataaattgatacactaacggtgtccaaattgctttattaaaggtactcacagaactaggcactgataatgaggcaaaaggaggacataagctctcattattattatgtgtagctttactaacttattaaagatgtcaatccctatacaagtaacaaaatatgccagagtttaatatatagtagaatacagataagagtaagtacttttacaccagagcagtggaaacaattttgcctgggaaattatgtaaagcattgaaatggatattaatcattgatttttaagaacaaatatgactttttcaggtttagggctagggtgtctgaggaaaagaggcagtttcaggtagagacatcagcataaataaaggaatacagataaacaaagacataggtagtctgataatatttgaatctaagatatgcaataggatgtataaaacaaaaattctgggtaggggagggaatagttatgaaagacccaattaggaatcttgactgaaactactgaagatgtttggttaggttcataacatgattaaacgtacattttaaacaacaaaacaccatctctgaaacagagaattgataaagttgacagtccctgtggcaagcaactggttagagcagtgtcttttaatatcttttcacaaagatgattagtaatagaatagattttatatcatggtttactccttgtattatttccctggctactacacatgcacacaaatatggaagtcttcaacaaattttcttaaaattatgttcaaggaacactgtcattttctgttataatccgctctatccttttttattctttcaaaattggttatcaatgagcacacaattaattcatgatctaccaatgagtctagttaattgtttgaaaaataataaggacattattacaatactagttcaaagaaacatggtggtacctcagctgagaatgtatcaataagaacatacaagaggaaatatattcaggggaaattctgagaggaatttttagggctttgtaatgaatcagatacagaggataagaacattatggggatcaggcattacagctaggtcaaagtatgaatctgttaaaatagagcttgagaatgatccccttagaataagtatggtgtaataaatgtgaaattgccttggcctaccttatgatatcagaaattgaaactcatttttgtacactcatgatatttttcccaatgcttgattggtattagaatgcctacatcttttgagcatcaaaccaactgtctttctgggactcagtattgaataaataatatatactaagttaaaaatcattttcaaccttgggttatactttcaaaaaggtatttctaagaatgacaagtgaatatggtattaagtttttttgtttatttaagcaagaaagttaaatgtcaaagcgacatttctgtggcaatttgatggtataatcactaagagttagatatttttcctacaacccctctaatgtacccattgtacataccttattaacagcataaattgcaaagggaacaattatagtttttctaccttagttttctatcatgggtgattacagtatcagccataataaatgttgtttcgttctttttagtgcacaacataatttttaaggacttaagtactatgctgaatcagttctttcttctgttaaacagtagtaactgctcagcaaccacagaccaatggagtagtcagtttccctgatgattttggcaagaatgtgtcaggatacatacatcttgagaattctcacttggttctccaatctctaattttaaatatcccaattacaaacttgtactcaaagttttatttcgcaatacacagggcatttttcaacaactcatattttttccctgcattcctcaggcaaataaaaattacacttctttttaattacaaaggcagaattttgagggtatacctagtatcgattctatgtgcaattttaagaaacatatttatgattcaaatatctattagttgactaccataaatatatccacattcacttttgtgaaaaaaggaaaacaatcacatgctaattcttaatggtctgtgataaatggtgaaattaatatgtcatatttaaattatcttgacaattcatgtagtgtaacagcaagttcctaacaatgctcatgaagtttaatgacgtatttttcacatctatgtgtatgtttatttagcccaggtattaaaaaaaagtttgagtgtagaatcagatgtagactgcttggttttgaaccccagctctagcacttacaaatcaatgaccttgggctggtcacccatcctctgtgtttgtgcttcagtttactcatctgtaaagtacatatgattgtagtactacttcattgtgttgttatgaggcttaaatgttaagtttatgtatatgtgtgtgtaaacatatatataatatgtatttgtgtgtgtgtgtgtgtgtgtgtgtgtgtgtgtgaaatttagaagaggtcctggcattcttgaagtcctttacaagtgttaaaataaacaaagatgtctttgtaacatttcattgaagtaaatttttcacatagtcattatttttacttatacaaacatcttttagtttactctttgaaagaaaatatgtgtgttatatgtgaaggaaaaatgtgatcattaaattaaacaattaatcaagatatagcacttttaacttcaaatatttccattcattttggcaaatattttacatatcttatttctcctatattttgggctttgactgataggccctggaaacataaagagaaaatagatatgtttaaggaatccatagtctggtagaagaaactaacataactatgtaattaatccacagtgtgataaattcattgagagacagacactatgttaacattgtgtcaatgaatacaagacagcacttagtaaaaccagtgttaaaatgacataatctaaggtttggttcttaattctgaaggcactgagaattactattggccaggcccatgtgtcctcaagcttaaggggcaagcttatgctttctaaagcagactgacattccagaacactacattttaaatttcattcacaggaagtctcatcaaacagaattctcataattagtaaatgtgcatggatgattggaggagtatgagactaaagattgtaagaccatttaaattataaaaaaaatctaagcaaggcgtaactaaaattggacagtggcaagaagagtaaataggaagggtcacattttggtggtaaaaggagtatatatgaggcagaatttgatgaccaagaagatatggggaatacaatagggagtgtgagaagtctctgagatgcttgtattttggtgacactagaagtaatagtgacatagtattagaaaataaagaaaaaaacaagaagtttatggaagagaaaagagaacactacaggtaatggttttcaatttgaacatgctgatttgaaatatcattgggatagtcactgaggagttcagtaactgattgaaactcaggtaggagttagagttgaagataaagatttccttaaccatgctaactgaagagttagagtagttgatctcctgcaagaagtgaggtgtgaattgagagagaatatgtctagtaacaaaaatctagaaaatgccaacaaggaaaaattaataatacggagtgatcaattggactatttttttgcctttttaaaaaactattcagtatctgacaatttcttgttatttaaggctaatctttaaaaatgtagaaaggggccctgttgtccactacagaagcaaaaattgatcaatattttcatttctctctgcctagcagcaaagggacagaaatgtggtcaaaactagtttaaccacattttcctaattatgactttggctagtgaaatatggggtaagaaaactgggtaaactggaagttcagagttccctgatagtgagaaatgctgaggtatccctgacagggacataaccattgttcggggactatgatttttttagtgatttctgtggtccagccagctttccaataaatcactttttctaagttaagccagagtcggtttctgggagttaggtatggacaagataagaacagaaacaaaggaaatagacttcactgaaatttaagaaacactatgcaaatgtcacaagtagtcaaattaaataataaacattataataattggttgttttgtgggatacaattttgaaaatatagtattcagttatgtgtatgttatgtctcactgatattgctatgtgctttgtactgaatttaataaatgagagaactttacaaaatgattaccggacacctactatgagatactttggcagtgggaataagtaatgaacgagacaagatacctccccgcattagtagaacctgaagtttgttgccatttcagaatttgctgttggctttttttttttttttttttttttttttttgagccggagtcttgctctgtcacccaggctggagtccagtggcgtaatctcggctcactgcaagctccaactcccaggttcacgccattctcctgcctcagcctcccaagtggctgggactgcaggcgcccgccaccatgcccagctaatttttttgtgtttttagtagaggcggggtttcaccatgttagccaggatagtctcgatctcctgacctcgtgatccagccacctcggcctcccaaagtgctgggattacaggcgtgagccaccgcacccggcccgcttttataaatatattgtgaagtcccagataaagaacagcagttaacgctttaccctccgtattacttattacaagcaactatacattgacaaccagatgctgttagaatttctttttaattgataaaagtatttacaaattgttgtctttatgatgtcttatcattttaatttattcattttttggttccttttacaatatgctctattttttatcctttcttgaaaaaacaagtgctaacttgtaattagtcataccattcaagtctccaaggagaaagctgataaatgtgaagttttagtttgatttaaaatgtggattcacaagtaagcactctgactaaaagcacctttcctgattttacagattcttttctgttgatatgctgaagtgaataaagacagtgtaagacagagccgtccttaccacttgtccgtagctgaagtcctgggataactctctaattttatgtcttattttaatccattgctttatatcagaaaagataattgtattttagattacatttaaataaattaaagatattaatagcattttagcgacctcataatattttgagataatgctttcagtatcctcttattatttatttcaagacttgagttccaatgctaaagaagatttttttatttcagcaataacatttgtttatgtgtagttgttcatactgggtacatttcttatatgatataaatcttttgaagagaaagaagataaaaatttacacatttcaatatatttattttaaaattaaactccatgagtggattttacttctcattttcacctagaacaactttttattttagggaagagaatatgggccactggttttattgtaaagagtcttgatttgaattcatgtgttctgaattttagtactgtacttttaaatggcatctcagaagtgggtcatttttcttctttcttccttgcttccttcttccctccctcctttagtgtgtgtgcatctactattaattacctaactttttcccacacttccatcataggaaatctcagaatcaaccttttattttccttcacattctttcctatgtctgttttctttggtggcttttcagaggagcacaaccttctgtatattcctacctgggagtgactttctgcatgctgggattatccacccaagaccctacctttggggaggaggatttacagaagactgagaaaagatgaaaccttcactttagccaatcagactttcagaccaaacatgaggttcaacaaggtgatagaagtcacagccatatcacttgcacatatgcaactgaacttttgaccaagttctttgtatttattttttgcttcctttccattcttagggattaagtggtacataatatttaagagcatgagcttaaaatctgcctctattacttaaaactatgtactcttggacaaatttcttgcaactcagtttccttatcattggaaaacagcaatagtgactgtctcattggcttattgtgagaatcacatatattacatgcaaagcacagagaatgctccctggcacataacaaatgttcaataaaaggtattcggccaggtgcggtggctcatgcctgtaatcccagctacttgggaggcagaggcgggtggatcacctgaagacaggagtttaagacgagcatgacaaacatagtgaaaccccgtctctactaaaaatacaaaaaaaaaatggctggggtggtggggggcgcctgtaatcccagctacttaggaggctgaggcaggagaatcagttgaacccaggaggcggagataggagggagccgatatcccgccactgcactccagccagggcgacagtgtgagactccatctcaaaataaataaagaaataaagaaataaatattttaaaaatttaagtattcttcttagagcaacaataaaatatttttcttatcttctatgtgaattatgttattatgaaattgtaactgggaggccttattctcctgaacagttgagtcatattcctctttttaagtacaattgaccatgtctatgagttttaaagtttccacactgcctatggagtcaaatttgtttcatctaatatttaaaatatttgcaatctggccccatcagtcattcaagtctcaattcctaggggatcaaaagtaaatttcagccacaatggcttactaaatgtgttataaataaagtttgggcttccttacgctgttgctcagagatcttatttgacatgcctttaacttacctgcatgcatttcaaaagatttattatcataatagattgtaaaaggaaagagcatgtaaaaggaattagcataatctaatatgttttatccacccagggcaaggaattttgagaggcattccaaatattttgtttcatttaattttcccagtacagttcccatcagtgttagcctgatttatagaaaaatttgaatctctgaaatatttttatttgtcacttatacttcaataaaggaagaagtaaaaaaagagttataagcttggacaagttaagtaacttgattgatgtgaactccattgcccacatggttactgatgatcaaatagctaagaatagaaatgaagctaaatatcttttatttcttaaagtttaagccaaatttggataaatatgaggtatatatttaacatttttatttaaattaaacaatatatttttccttggcacgcttcccctttttctcccctcccaaatctaagctattctctagaatttgtgcagttatagcaaatttgaccgatgattccatttttcttttcacagaagtatcggaatgacacagtctaacatatttcttggtatgcagatctttgtttgctagaaggagtttgattatattttcattctgtgaatttctctagaaattatgacactgttcttcccacccttgccagtaatgttaacgaacctgggtttgtgaaaaatttcctcttctgtttagtcatttcattattttcatgatgtgtgttgtttgtatttctatcaagttgagaatttcaacaattggtattgttaaaagcataaaatgtggtgtgtgtgtgtgtgtatgtgtgtattttgtgtgcctattcatcatactgaacatgcaaatgtttaatgtgatatttcaactttatttcttatattttgtttactacattatggtataccacatgaaagtccattttaatcctatggttaatatttcaaaagtcttatcaattagttatttaatactttctagtatcattttgaaatcctgtctatcaagagatctgaggtatagatattatatttatgttttagatgtttaaaaccttttgtttaataactgctcaaaatttgggaaaggtcatggctgaatggccttgaataacatacctgagtcttaggaatctgagatgaaaagctagggataaatgatagaacactctttgttctataggaaggtttgtgtgcaggatgaatttatagacatttatcacatttctgaatgaactcatatgtataatagtgtcagttaaaactcctgtcctggaatgattccaaactagatggtgcttttcatttataacctatatgcccttggacatgtttctcaaccactttaaccttagtttctcatctaaaagtgaagttgatactactttttacctcaaagcaaaatgaatggtttcaggtctatgtggagcccacaaccttcatgacaggaaagtcaaagagactggcaggtcgcatgtgccaactttccacagaaattttgagaaagtaatcagaaagtctaagaaaagacagctaacagattttttttgttctatttgctcctcaagctgagaaacaagatgggagcaaacgggatcaataagcttcctttaggggcagaaaagagaagacattggttcctatttcacagtggattgacaaaggtgtttccgtaggtaataatgttttggctgagagatgtcagttagcacaggaagcaacacagtgggattggccaaaaaagaaaaaggatgataattatgtatttggaatttgtctgaatattaacaaaggtggggaaaatttggtctataatacacctagaattgttttcttcttatttaatctgttgggtgtgtgaaaggatgtaagtgacaacctccaattattacagaacaccatgttttacaccgtatttactccagttttggatgatgagttctatacctagcacagatacatacaatacgttgtagaattaaaaaatgtagaattaaaaaattggatagattatgtcattgttaaataacataaataactaaatagctagaaaaaaagtctgagcttctagagtagtgtttgcaaaacaaactctcaataaatgcctgttaataaatgcaagtgggatctcctagttgcatacattgttgaagtatcatttaactgcagagaataatggccaatccaagagagattttttgctagggaattctgtaatcttgaggtgctcacacatgaaataaacatttattccctatgaattctaaaataaatattttatataacttttaaattaacatgaaagtaccttcaattttgcatgtagggatgagaagccatcatatgcagtgtgaaatcatggaagaaaattcagaggcttagaatacagtggagttagctgcattcctgtaggtgtttaatcaatattggagaataaacacaaataaattgagaactgggaagtttagagtaaataaagagtattgttaatacagctaattctgtgtatatgttttcaacatgtcaaatataaaatgggcacaaatatttaaattggctaaagataatgttgtttgactctattaaatgtttatatgcactcaacaattttgactcaccaaagtccatcattttaaaactggctactcctctattttatgagattaagagtaatatgagtatcatgtattactcataaatgcttgagacacattctggctaattttgaatattataacctctaaggaattttttataaagaaaaatgaaaattgtgatggcaaatatattcataatcctgctcaatcagcagttttgctgctagtaatgtttggatgctcacaacaagtctactgaattgctggagtgcaacacagctcgttggttatttttgattttttaatgctttcttttaaataagtggcattcagctaattatatgactaaaaatctgactcaaccacagagttgttaatttaccagcaacatgtggacattgtattactctattttccagggaaaatgtatatatattcttccccaggaaaatgaacaagctggactcctaaaaccacaaagcgttgtattttatgaagtgtcttctgtcttgttatttcctgtacctcagttactatccttgacaaagtctgattgtgctctgctcagatcctcaagactctgcatgtggatttgttactctttgatctccaattgctcctttagttagcaccatactcatttagcattcattaattaaatcaaatatgttggtttgtttcctaaattaatctgttctccataaatattcttattccattagcttctttttgctttcaaagtggaaagcatttatctttcagccttcagctttaattgatgagcatcttaccaccttttgagaaattcatgaccagaaaatcaagagtgggtattggcaaatacggatagggggtgggatgtttaaagatgtggcaagaaaaagtatacagtaattgagtgatttttttcctgaagggataattcagcagaatatatcatttttattctatttaattgggttggtttttactagttttactattatagtgaaaataaagtacaaatattgttttctctacaattggaatcctctaaaaagaaattactgagggtttgttttagtggaaaaatatgtccaaagccacttccccaacaggaacatgttaactgtaatgttacatgtattctccctattttacctaaagaagtgtcagtaataatgatgtccagaatatacttttccccatagtatccaaattcatgtgataactagcttcattaggagtttagattacttttaatatttgtgtagagcacatcttaggactttaaaatgatcaagtccttgatcttccttgagttccacaagaaggtgttcactttgacaagtattcgcatgcagcaaatctttttctgggtagtcctgtttgtaatattcttaccataatgagaatgaataatatctaataataattagtggtatgaatcatgagtagaaacaaatacatactctgtcatataatatagtggatgtaattaaagatacccaaattgaaaagataataatctttatactttctaaataatattattgtgttaatatttttccctcagtagctaaccctaaataacagagaatttgagatgaaatatatttgttgttgtagctaaatattgtcggagatctaggaagtaacaagatatattaattaagagagataaggaacgatatataagacagtatttttagtatcagaacacatactttactttttaattaaaatgtttaataattcaattaatgtgacaaaatacacaaggaagagaaatgtaaggaactttcataatgtagccaaacatgcaaaaatgcagaaaaagaaaatcccttcccttgaaaggctgataaaagtattaaaaatagtttcatattttcatgaagggtttgattgaatcgattcaaacaactttttcccaatacagtaaactcttgtttatcaaaatctaacttttcttttatcaactaaaacctacctttttaaaagcaagttaaaaatagtttttttaaaaaaaaaaatgaagctatttttaaaatcaggtataaaaaggtctatgtgaccgatcaaagaagcatcagaaattggttaaaggccaaattcaaggtgcttttcaaagctttcttctaatataagaatgttatattagattatataaatataaataacaggttatataaacaacatcaggcccaagctcttttcaaaaccttatggctctagtggagaaaacagtacggcatattctgttctttccctacatatgcattccccagggatgcatacgtccgaaaagggaaaacagatattttgaggatgtcctaaaataacaggaaggctgatatttgatcttatagtaagagcttttctatattacttaaaaccccagaaagtcatattaaatatgacatctccacttttcttatttttcttccccatttagacctatagaaagcaattgtaaatatgtttgtgtaaaacactataaggaattgcacttttcccctaacctcagtgtgtaagtaaagccaactttatttccttacacttacaaagttgttgaaatgacttaagctttacaagtggtgcagattagaatgtcaagtccaatgtgttttattcacttgtagagcagcatgtggtttaaattgactactgaatggccaaagaacccttgtgaatttaccatcataaattctctgattacaaattcaaattgtgtggttttatgagataatagcaaaggatattcttagacaacaggttgaattcatacaagaggcattttgagccctgtactgggactgtatatttttattgcaggcagtattcctgcacgtgcggagacttattgaaaatgtaatcttaccaagtagatgatcttttggttttcttttcacatggttaaaaaaatgcttatttcccattcttcttttcatgaacaccattttaccagtgaatatttctttttttttcatttgtcccattaattttttcctcttcaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagagggtaagtgactggaaaggaccagtttgtccttggcacagtggaacacatataactaaacattttcactagacaagaataagcttcagtaaaatctccaaatggatatatgtttccgttattttataatggttactctatttacaaacttgaagtttgtttatgtacgatatgattttaactcaccctcttttttgaaaaagcaaattgttgaacctggcacttatttatgtgtgttcatgaacaaactactaatttttatatttttgcactaaaaagtaataagaattcatagtaaaattaatgagctttgggtagggaaactacaacagaagtgctgaatggctagtgggcaatattgtgtaagcataaatgttagatatatttaaggagcaattaagtcccatctgtagccaagaggcctagtagtgagaaaggaggctggctgcgataaaatgccttaatgcttccccccaaagtcacagatgctgttttaatgaattaagccaacatttcccttttattaacacaagttcagaaaaaagcattaaaatataaactcttgcttaaaagtggcaaatgaccaaaaggccaaattcactcatgcacacatataagtatgtaaagtagataaaccacagatgagaaattatgtatttttactggaagtgtactgagtgtcagatactgtagcttcaaaaatgaagagctgatcactacctttaaaaaatgcataggctttatggtacagacagaggcatatacaattcactagtggcctaataggggaatatgttgtcagaggtgtataatttgtccctcaggttcacaaagacacttggaaagtggaccaaacatttgaactggactttaaaaacagaatagcaattgccagagggataaaataaagagaataagaaaaccaaacagaaggaaatgctgttgcattattagagggtaccaggtcaagcaaatgatgaagtgcacagtaaacgtatggaataatggagtctgttgtggaacatgggaatacaaagttggaaaagtaacttgggatgtggttgagaagggaattgagtttatgctctatgaagcacagttagatgtctgaatttaagaagaaatcttgtaactgcagacatttatttgacagggacaagaaaaatgccagaggcacaaaaaccaattaggcttttgattaatttactcataagataataaggatgtaagacagaagcagtggacttggaaaggaagggcaagttcagggggccaattaaatacaatggatacaagtcctgaaaaaaacaggtttccaagcccagacttaaaaatagtttcttatactgtaataggaactgggctaaggtatttttgttttgttcctgagataatttcctgcaaggatttaccatttcctgtttaaatctctagatagtttcttgtattgtattattttgcacacaattaaattacattctttttttgttttttgtgttttgttttgttttgttttgttttttgagacagagtctcactctgttgcccaggccggagtgcagtggtgcgatctcggctcactacaagctctgcctcctgggttcacgccgttctcctgcctcagcctcccaagtagctgggactacaggtgcccgccaccacacctggctaattttttgtatttttagtagagatggggtttcaccgtcttagccaggatggtctcgatctcctgacttcgtgatccacccacctcggcctcccaaagtgctggaattacatgcatgagccaccgtgcctggcctaaattgcattcttataattagatcatgtttactcaacacacattctcttggtggttgacaggaagtttcaacaaaataagataaaaatactgcatttggagagtaagtcaccgccttttttttttaagttacaaatatccctggtaattacaatttgactcttaaaaaaatgtgcatcttaagaaactgtaacattacagtgcattgtgttaagaacatgtctgtttttgtttgggtatcatgttactctgaaaaacaccttaaaaagataatgtttccatcttaaacatacacacacacacacacacacacacatacacacacacaaacacattccagtgatagcagattaagttttagaaagaaataatctgaagtaagtcctccctgactatggaaaactaatgagaaaacttaagattactctgaattagtacctttgtttcctagattttggtttatatttctcaatccaataccaaaaccaaagcatgaaataagaggagtgactgcagtagtgcattttcagtaagttagaatccagatagtgttatatatgattaacagtgaatacacatgggtttttacagatattttaaacataaactttgcagattcttttagtaatttaacaagactcctatcttttgtcctattcacttttataaccattataaatataaactacttcactaattcctaaccattttattccaaagagcaacaaggccaaacttctgaccactggtgaaaggaatggtatgctttttttggttactatgaattaggcatattttctaaactgattttgaattctgtagaaataacttctctctccaccttcctgttcacaaatctacatataccctcttaaagtgtcaaggtattgagttctaaactgtggccaagaataatgaaagtagctctagagaggcttgtgacttttcaaatagaatggaaatttgtacacatggtgtacgtgtgaaaggcaacttcatttatggattttattgaaactaatacattgatgtatgtaagatagcgttttgacctaatgtgtgtacttgctgctggaactgtaaatgaaaataaggaagtgtgagcgctgatgaaacaaaaatgatttttgtgatatgaaagcaaaggcaaactccccaaagaactattctttaagtaactgttttacatctcctttgacttacctctctgaaaccctgtggttaatacagttcagcaaaataagaagtttcatatcctctgttgattactggagttggttgcctctcatgagcaattaaagcacccaagacacagaatttagggtgtgtataatcataatgttaaaatgtgaaggctcttccaagtactgcaattaaaataaaaagtttcagtgatttgtaaaacaagattcctgaacacagtgaggatcatttagatagttttcatatggtcagacatcattacttaaacattttgccctccaaaaactgtgattccttactaactttaaaaacctatttaattttagatttttctaaaagctctaaagatgaaaccatcagtcacaaaattcagatactcttaggtattgttgtaatatattgtcattcttttgaaaccatattcagtaaaacagaaggaaaagatatataggtagattcataatttaaaaagaatcttgaaaaatagtaagagagtaatctaatggggacaaatcagatatataaattgcaagtttaagagaatgtatgaaagcataaaattggtgtgggattgccacttttttactggtatttcttcagaagccccacacatgggctgcatttttcaaattaacattttgtattttttttttttaataaagaatggagcaattttgggcccagtgcagtggctcatgcctgtgatcccaacactttgggaggccaaggtgcgtggattacctgaggtcaggagtttgagacgagcctggccaacatggcgaaaccccgcctctactaaaaatacgaaaaagagccagatgtggtggcacacacctgtagtccccgctacttggcaggctgaggcaggagaatcacttgaacccagggagggagaggttgcagtgagccgagctcatgctactgcactccagcctggatgacacagtgatactccgtctcaaaaaaaaaaaaaaaaaaaaaaaagaagagtggagcaaataagatagtaagcatgaagaggggatttggggacttcaaagtcatttaaaaatttggctacaaaatgtaaaataaaagcttcttatttatacagttctaagaaaattattaatatacaacttaatatcttaataacctgtttaaattaatgacagttttatataatattttaaattattatctaagacatagctcaaatacatttttataaaatacttagagttaggtaaaaattcttattttacagttactttaatttgactagtaataaccaagtgttgtttttactttggtgggatgattatacttaattttcttacttttaatatgggaaaaaaacaaacattacagaaagtgtatcctcagtttcaatatcaaactatgacgagaatttcttaagaatccttccaaaaaacctatagatagacagatagatagagaagcatattttaaaattatgttttatatgcacaaacctaaatatgtttttattgtagtagctctacaactcgaatcatatgtactcttttgcactttattttttaaattaacatgacattttctcaacaacacataaatacagcttgttttttttaataggaaagtatattccattatatacttttctataatgtatttaaccaatcttgtttgatggacatttgtagtacttctcatttgttcttgttgtatataattttattttgttattaaaaatattttaaattataggaaaaatgagaggtagggaaaggaaagtaaatatacaattctggttagctgattttataaactaatagtatattttaaaatataaaattaatgtaaagcttacaataggccgggcatggtggcttatgcctgtaatcccatcactttgggaggccgaggcgggtggatcacttgagatcaggagtttgagaccagcctggccaacatggggaaaccccgtctctaataaaaaatacaaaaattagccaggcatggtggcgcatgcctgtaatcccagctactagggaagctgaggcagaagaatcgcttaagcccagggggcagaggttgcaatgagttgagatcatgccactgcactccaccctgggcaacagcatgagattccatctcaaaaaaaaaaaaaaaaaaaaaaagtatggttacaataataattctgaacaaataattatatataaactagtcttatattaccttttcaaatacaatatcctgaagtaacaacagttaatatttactcttattcatctatcctttttgtctgtttatacatatatatacacacacatgttatatatatatatatacacatctacacaatatggattcatttagaatgtgtttttttcccacagaaaagggaattttaataaacacagaggtatggatgggtttaaacctactgaatactgtataatatgttcccttctgaaaatattatctgtattcagatattttaattttaaacattaagcttttgatctgttgatatttgagtctgggaaaaaatgttaaaatatttacgttttaattctttggcccctgctaattattatgaactattattaaaagatttaaacccaaaatgagatatttaactcaattatcgtataaatttttatggccccttagttttttttttaatttttacttttttaaattctactataacaaaagtaatatatatgtaccattttgtcactacattataagtagtaatttgttttaatataatggaggttatgctctcattaaattaataagcttctactttgtattaatcaagataaacacttggaatgagtactcacagatgacattgataaatgtatataatattctgtgatgtcaccatcatagtaaataattctaaagttatttaccatttttaaacttacatctttctcaaaaaatttttaaagatatttcatatagatttttaaaattttgattccatgtgtagtaatatggtgcaaaagtagttgtgggttttgccattgaaagtaatggcaaaaactatgattccttttgcaccagcctaatagtttttgtttttgttatttatctttcagtggagaatacataagatacctgtatacttaaaaaaatatagtcttttgtagtgattgcaaaggacgaatatgtgtaagataaatgggctacataaactgccttagatttgcctggaattaagaatttttgtttttattagaaatacttggtaaacatctcatgccctacaacagtgtttttttgtttgttttttgtttatttttgttttttgggtttcttttttgagacagagtctcgctctgacgcacaggctggagtgcggtggtgcaatatcggctcactgcaacctccgccttctgagttcgagcgattgattcttctgcctcagcctccccagtagctgcgactacaggaatgaggcgccacgcccggctaatttttttttttttctctatttttggaagggatggggtttcaccatgttggccaggctgctctcgaactgcaacctcaggtgatccatccgccttagcctcccaaagtgcggggattacaggcgtgagccaccgcgctcagccagcagtgtttcttaaattcaagctcacatatgtattttgcaggttctgcgaaaattttcttgattttaaagaggatttgaacaattctaactaagaacactgacgtagagaattttgaagaattacgcagaaatttgatttccaaggaagacgaaaacaaacctttcctattctgactttagacaagactgtttaaatccttgagtgtcagatttataaccattaaaatatacgtaccaatgtatataatcgtatagattcctttgggctctaagaatcactggttctgaactttgtccttacacatgggaatattcaaactgtcacaaaaaaactcttgtccttaattaaacatcctcaggaatgtattctctgtaacttcctaaacaggttcattaaatttttggtaattatgataataaagatagctttctaaagtatttcttctttaaagtcattttctcttgatatttattctttacatgtttcaacaccacagttaagttaacccaacatcatctaaatgtttacttgacagcagaagaaatatatataagaaatatatatatttgaaatatataagaaatatatatacacacatagacacacatagttacacattcatatatataagcatgtatatatacctaggtaaatattatataaaaagaatagacagacatgtttgttgctgaatttgccctttctttgatttctgcaattattaatttttttaaaaatgcgtaacttttttgataaatgtcaattgtggaaaacctatatctgaagtagtatttatttgttatatatatgaaaaataaaattagtatacatacatatttactgttatatatacacacacactgtacagactttatatagtctatactcgcgatatactttctttgtaaacacacacaaaacatatatattaatatattatatacaattctatgtattctcttgctgtttctctgtctctatatatactatacagagtatatatactctgtgtgtatatatgtgtatattctttgtatatatacacacactgcacatatatagatatactgtaaataatttacacatactaacaaagtataaaatatacaaatatgtattttatataattatataatatgtaatagtatactcatagtatatatgtttattattctatacaagttactttgttagacgttttgtatgtcaaacatagtgccaatatatattgattttcttgtaataatggtacattactgaatcttattcaactgtggtcacttaggattttcagaaatcagtttttccatgcttaatgtatagtaaatatccccccttttatatttctgttgttggtgtttgacatgccatcttgaatttatttgtagtaatttcatcttttgttttcaagtagatattgttttacattattactttaagtgactaaataacttttgaaaaatttcctcattcagaatataagataatagtctaattgatttacatactttatatgcagtatcttttttgcttcattatttttattaaataaaattacagtgaacaagaggatatcacttaatgtacccgcccaggattcccagagttttgctagaacattgatattttattttggcatacctttctaaactacctgtgcccgtactttacaccacaatgatcaattccataattcctagctaaatgtaagagggaaaaattacgtcttacggatatcaagtgacatatctagctaacttctcatctgggtagtattcactctgttgaaaaatatttaatggttattaaaagaatgaaagcacacattagttgctttggtagaatattttttatggtttctaacaaataaacagattatattttcacacatcatccatcaactttttttcagcattaagactaacaaaaatatcatttctcaaatgttagttgctgcactcatctttcagatgtaaaaattcattttaaatgaaagtaaaggttaaagtctatataaaatgaagatgaccttctgcaggataacttcatgtgaatgtcatgggtttgcagaaggatttgaatcagaccaggctcccaatagtctttagcaaaactataggctaaaatacatcatcaatagacctcaggaaatcaagtttattagtcactctaatggattgttttggagtattcaatcaactcaagtcacataaggaaaagcaattttaaaaaaacaactttgaaaagagaatattcactccaagtgctttctgaaaatggcttacttgttttaaaattagtcttatgctaaaaatatttccatatggtttctattttgacctatgagcaacacagctgtaatatttctttataaaacatgtgtcctagtttaatgtttttgagtagctagatgccgcgtattaggtattttaaaccaaaggagatttccatgaaaggatatttctttccttactggcagactctgatatgcacacttccggaacttcagtgtttcctgatattttaatctggttacccttcagtcacaatgttatttcctagcagatcccgttattcatattgcattgtgtaatgtggaagtataaatagtttatgtctgagaagatattcccaagtgtgtggctcaaactggaacctatggaaaacagctttcattctgcccctgaccaatatgcttcccagttctggttatctctcactgagactaaaaggctttgcgaaatatctagaatttctttggaagagtagttaagctttcatagcacccctgtaacattggcaaatttgggctttccttcttggtatggatttttctctcttcttcacatagatcattttttattccttcaagtctcaatttaaaggttaagtttcaattgggcatcatttctcactctttttccttttggtgagattgacctgggtttctgctctctgtattctcttctcaagggatgtatttcccttttggaacattcttcataatgtatgactattgtttattttcaactctgtaggtttattttaaattttttcatagcaaagattgacttattcatctctataactaataagaagcataaattcccagtatatgttacggtggaggttgaggcacatgtgcaaaggggtggggaataaaaatgggcaaagttgtgctgaagttagacattgcaatttggttcagttagttctctagagcaattcaaacaagcagggaaccaagcagaattgaggaagaggtttttttcatcgatctgggtagcactagaaattattttcactaggcagtattgtgaagaagagggaaactttcaagaaggaaggcttgaattctaaatagtgaggatgtaatctggatagtttgttttcctgcaatttattattaatcaaactatgtatcaacttgtgccctgaatctactaaattatgaaattaatgcttactaaattttacctgcctgtggtgttgctagggtaaaaataaaagagcaagttctgataagaaaagtagatgaatcataataatgaggcatgacgcatgggagcatccagtttgaccatctataaattcatcctggccacctgagaaaagtaccctagatctataatttagtaacagttttctcttgggtgttatctttcaaaatctgcataaagaaatcaatccattattttttaatattaatttatcatggtgttcaatagaggaaaaatcgttactaaaaatattttagctggggaaataaattaattgtcattattttataaattctaagactaaaatttcataatcagaacaaagcgctatactgctatattaacgaactacagggaaagctcaataatttgttctattaccttttactttcaaggctcaatcttttaatgagtgatagaaggtgcacaggtaacctcggaaattcccttgtttatttgacttttcaggagaaaagaacattgatcaatatgcaaaatatatactgagttaatttgcattaagttattctaatttaagtcaagatgactggtcgattacgcattcagagatttcttatatatagtaaaataattaatatattttaactaattattaaatattaaatagttgggagtttaaagttaaatgcaaatataaatttttagacagtgaacatgactagctacttcctgagtttgtggagaaaagttatttaatcaatattcccataaatctttgaaaacattacaggtccttatcttcttcaaatgatacaagtgtactttagcttgagtgtaatagtttagattaggtcttttgtttctatgtgattgatcatggtcagttaactaactctagtgtctcatgtggttgatcatataatcacagcctcaggccacaacttccaaattatggctatcgccatttgtcaagccagctcaacatacaagaagtaagttagagaataaggcaaaagacttggggcttgaccactagaattgccatgtaggaaacaagatactgatacattctgccaactttttcagagactagtgtgccatatcagattcctattggtaagagatcaaagaaagagtcatttctgtttctttttctctttgctctaaaaccttaccccccaaatcatttaaaaacctggatgagtaaatacattgtagcagaataagtttaaagcctttagctataaacttatttttaaagtggctttaacaatctttttcagttatttgattacataaaggcaagtattggagccacattcaccagaggcaagctggaagttttgtttcttacagtttccagtttgagcctaacacctatgactgacttcttagaaataagccatttactttttcacattccatggataaaataaatcaaaaagaatattcagacctacaagagaagaatcacaaaatagagccctggtgaagaccagtatccagtgcaggaagtaaaatcaaaatgcagtgccctgattctgatacctctggcagcctcccctcatcaatgtgtgtcccaaatagccagggttattctatgttccccactattctgctggatgagatttcttgtttatgtgttagtaggtgcttgtactctcccttcaagatagtacatttatgattgagtatggttttctgaagatcatatttaaacataatacatggtggttgatatatgtgggaaatattgttcaatagtttcttttgagatcaatcaaatcacattatatacgatgcaaattcttacacaactgtttcatccagatgatcttatgctggggctgtcacctgtggagcataagtgaaagcaaaattataaagtatttgctcagttcttaaggaaggatacttgccatcatatcttaggaactctggccctctagtataacattgtgcctatttgttggcaaattagggagccatccagatggtaccatttttgtacattccgtgaagaatttctgtccctcttaagaccttgcttcaatataactggaaaggctttacgtctcaatgagcaccacctaaacttcaaatattggagagagataataaaatgcgtaaataccaagtaaggtgtaaataactgatagctaattcattcttaggggcaaataagttgttgagattaaaagaagggatttataagggccctatgaacatgttttgggaatttgcagagcaagaagtggaaaatatgttggagcaacagtatggctgacttccattcctcatgataacgcatacattgcatcttcattcagatggatcatggttaggcatcatagttaagctcagtaacaaaaaattgtaagtgacaaatcattgctctgtattgtgtaaatgcctgctgctttttttatttttacatgagttttcaacaccagacttcatttcttcagcaatgatattgtttagctatatcctctggttaagttttcctggtgagaatacaagtcgaatgctagcatcttaagaactcagttacaaacactcagttcttacctgcttccacttttatcctccaaaccatcttccagtgaccatgttgatagctgaatggaatatgttgcagagggagattgtgctggcagttgctaccttatttctaactaagaataaactgattttgtttcagacaatataaacttttattgtcaacatcaaattgttttcataatgaaagtatggtctatattgcttttcccattctctaattagtcatttaaagtacactcctaaagaaaatattgccttttgatgtcactctagagatagtaaaatcagtggaaaactgtctttctttaaaaaataaacaaaatgataaagtgatgatataataaagtaattaggaattcttaggtaaatagcttatatggatttcccttaataaattattggcctttataataggagcttccttggcctttatacaaatttcagcaaactttaccagtgttcattaagctatagcatcaagcaactgagttcaactttaaagcttccttgttttggatactcaacaatatttgcatcagttacaaacttggatgaaattaaatagctaaaagaatcatgtgactgaatgtatcataacataatctagcatggcacagattctactttacactattaatatatttgataatttgatctaatagaaactaacttttttttcttttcactggtgaatcttaattaaagtaaaatcattacttgcagctaaagttctgattctgcattttattcaaattatgatcatattcctctcaacagaattcagtgagctttttgcaaaaaccattttataggcacatataaaatctacaatatggcaagctaaccttataccaaaatatatgtttctcaatactgcttgaaagaattgtacagtcattataaatgttaatagcccctatctgagaataataaaaactggggatagtgttgaggtgggatgtgggcagtttatcaaaattttcagctttgtttttgcttcttaatagtcaacttttgtttttgtttttgttttaaaaaaaggaacttgatactttgtggaatccatctgtgctataatcaaataatccatcagcaagtctccattaataaacgtcgctaccaggaagaatcaatgttgctaaaattttgttctttgctcagctcacaattatttcctctttctgttttctctggaacagatgcatacaccagaattgctgtcagtttcaaaattaataagctaattattttatgagaaataacacagaatatataaatacaaatattttagtaatgtacaaattgcaaattcctatcagactgaataaaagtgaaatacagatatttttcattaaaaaattctattgaagtagtaaaatatttgaaatcacataattccacattttgaaatatgaatagaagtgttcctgctgtatcacgttcattccttctataaacatgtatagattgctatactgcgctaggtctgaagctccaaagaagaaaacaaagcaggggcttcctcaagcaacaaaaccagcttggtagccaacaagattacatagggaagtgacaaggtagttttggaatgctagatcaagggatttggcaaatgcatgtaatacctctggtggatgggacatgtaatttgtcactgattagagattcacagaagagattccaaacagtattaaagatcagctaaaagtataggctaagaatttacagtaatgcctatccacaaattgtgtcagaactatgttaccagtggagggtgtctaggtttttggtgtcttgaacaaataattggacaaaacacacaaacaaagcaaggaaggaatgaagcaacaaaagcagtgaattattgaaaatgaaagtgcactccacaggatgggagggggcccaagcataggagctcaataactgcgctacagaattttctagtgtttaaataccctctagaggtttccattggttacttggtgtatgccctatgtaaatggagaggatatttcttgtcatagctgaagtgtttccatttgatttagttctaagaagtcagcgtgaattggccttatgttccctgcctccagaccctatcctcctgcctcagcaatatactgcataattgacctctttttaaagaaataagcataatgactccaatacctatggcttgaataaaaatttgtgttgatcccaatttacaaaagtcccagtttacaaaaagcatcaggttcccaaccataattttacatactcaactttattctagaagggcatggaaggcaataagagtaaacagctatgcaactatggaaatcagtaacctgtgtagaaattaccaacatgacaacaaaaatacgttccaaatagatttatgaacctctcttctttctttatcatgatgtacagtaggttttgcatttcccttattttggctttctcatttaacttggtgtgcacaggaaataagtttttgaatgtcttactgtgacactgagtgtgataatgaggaggcatactgtgattgcaaatggattaggtgggggccagggaaaggggtacttactagagaataaaacacacagaaacaatcttttttgaaaaaacaaactatcttcatttgtttttattgtttggaatatatgtaataagaaaactttggggactttttttttttcttatattcttaagtaacctagagacaagaatgttataagaaagaatgtaggctgactggaaaagagaccctaaggaagacagaaagctccaaaaatgttatgggctagtcaggagataatataggcattcatcttcctctacagtaacttgtgtgttaagaaatgactttgccttattcaagcactgtgagtcatgatgaaatgaaccgcttgggggaattttgcaactcgctcaatgttctgacccttttcatatttaggtatgattggggattttctaaccaagctgatgatgatattagggaacattttcatagcttgttctttagtccattagagcaacacattgaaaactagtttcatggtatccttgaaaattccccaacttgtaccctaaaaaaaaactctaaaattgccatgtgcatatgtatgtatatacacacacatatatataaatagacacacatacacacacataaatatttcatcaaacaactgtatgtattctctgctttggatttctttaaaatagcactacaatcttgttaaaataagtagaaaatactctaaaatgttaaaataaaagggtgaaaggaaatttataagaacttggagaaatctaaacacatttgaaaattctcatttcaggtattagacaatgttgctgtgtctcactgataagaccaaataagatatgacatgatataaaagtttgggatcaggaacagtttaaaaaagactccgtatgaattgaaaatattaaaagtatatatttttatttaaatatatgtatatattatatgtagctaatgcttacatatggaaaatattttcatgattttttgacataatccagttaaatttcttattttataaaggaaactgttgcagcccagagtctcatctgctcaaaaatagacactcagttagtggcacagttagagttgctgattccaggagcagctctctttagaccaatctcactatagaacagtgtatctttataatagcatggcaatatttgtgccattttatcatttctttttgatgtatgatttttcaatataataaaacctattgatttagagacccttgtatgtattgccaaaataatattcagaaagtgagtgctttctatttatataagttatcacagatcttgagctgtttctgtcttgtgtttcctggccagagataaagagaagattatttttcatagacaagaagaggaaacaactaaattaattgcctttgtagctagggatttatagttcaaactttggacccaagtttttaaataattctaaaataggatttcaatggttattttttcaatttaacaaagagaacataaattctatagctgagttctgaagcatttcattaaatttaagttcatttatctgctcaggctttcagctgacatctgcagagcaaaatcaagatcttttctggcaaattgattgatggtgtgccatattatttataaggctcaaactatgtacatttgaaatattttcatttaaatgaaatttgaaacaagatatgaaaccttgcaatatgtatttacccagaaaacaagtgaaattcatatcataattaaatataatttttttgcatattctaagttggcaaaaggttatagaaaaatttttaaatgggtgggtgtggtggctcatgcctgtaattccaactttttgggaggccaaggtaggaggattgcttgaggccaggagtttgaaatcaggcttttcaacatagcaagccctcatctctacaaaaaagaaaaaaaaattaatgttctcttttaagtgcaagttttgtcactatggtttaaatcattttgctaggaagtttataatgtggatgtcatagtgttggaaactgaatgccaccattttatgatttgctgaaattacccagtagcaattttattttctattgtacatatttgctagtctattcaaagcaaatattcatgaagctatagcaaaagaaactgccagagaatagcttctaagcatctacagtgttgatgacttacagtgagtctctggaattcacagaaacattttcattataaattcagattaaattaattacattcttatagataaataaatacttgtaatatagtgacttttaatttgatatttaatttaacaggtttttttttctctagtgctccaaatttaatcagttactaatgttttgactggaatgaaaaaaatacataatttacatattacttctggccaagatgtattttggttatgttatttgatgtgtattcgttagcagtctaagtaatgtaacattggtcttcattaaaatctctgatttctttcatttatcttatagaaacaccatactgtaatttctgttccttcttctggttgtagaagagaggtagcagactcatgactcacagtttgacttggcctactgacctgcttaataacacagatatttaaaaatgaaattaactgtcaacatctaagtatcatgagatttttcaacagacatttcaatatctggtgattcttttaaagatcagaatatctggcagtcctagatctctatttcttcatgattatggtgaggcagacctaaatcgtgctgtcttctatactctaggcactgacatcctgtccttcacagtcccatgtaccgctttgtctcatacatcctgataacaagcctgattcattcatcctactttctggttttatccagctctctaaccatttgttttactattctgccttatgagagtagaatgaagtataaacatatatggtaattgattcagacactctcagaaatggagaatactgcatagtttccaatgaatatctcatttaaaaataatgacattaagacattcttgggcagattaagtgacttactaagacaacatatacaatagctaggtatcaaatatacatctttcggcatgagtttaagaaaccaaatttgaaacagttgcaaaaaagtaggccacatttcaccagtagagattcctttcaggcagtgtgtgctagtaaatgtttcacaactaactctctgggaaaacaaagtggatttatagcatttgctgattttcataatgtaaatactcccaccatgcccaatttcaaactaatgaggagatgacaagcagctcacaaaattccaaaaaaagaaaaaattcactgtggctctgtggatcagtaagggccagctctagcacatcagaataaacatatggttcaaggagattcttgtgtaaattgggtgaagaaaactgcagctattaacattcaggcttaataaatgaaatcatttctatcacactggcacctcaatcagaaatgtctatctcatgtattagaatattttctttaaattttagctgtcatcatagtttagattggccaatgcaattgcactggcaacagtgatatctgtaaacacaaagtcaatagcttttacagacttcatcacttctggtttattacaccaatcaaatatcaacatgtgtaatggatactttatataataatccctaaagtggagtctctaaatattttggacaaagaaaaagtatttaaattcttcatcctcctattgagtttggactggctaaatgcttttgaaactagttcaacactggctccctaaagcacttgtgacacttactgatgactcaggttttgcaagtggaaagtagagctaatgatcagaatggtatcttatttccctcaggtattacggtgtgtgtgtgtgtgtgtgtgtgtgtgtgtgtgtgttttagcactaatgagaaaattccctagacttcctttagagttcctatgtgtaaagtcaatagcgataagtgacgtgggagtattttaacctggaaattggaaagtaagtctccaaagtattacattttaacgtcagtacggaacagtagcaattttctctgatggattttatttttttccaagtttcagtcagtgttttctaccaaatctaagtaaaaaattgaatctggagataatgcttttagaatttaaaaattatgaataattcaagttgattgtttaaatttcgttttctttaaaaaaaattatttgtccacctgggagttatgaaatgatatctttaatttgccaagttggagaagtcaacgtgagatttaacatttgctgtagaaaagtgaaagttatttatttctaggttatacttagtaaggagtaccatatatttagttgagaaagcatgtgaaccttcctttctacattcaatcttaggtttcttttctatgtatttttatccattagtagtctaccgtacctaatgacaaatctcagaacaatgcaaaaaaaaatgaatgcagcattcaaccatggccaaattaatagtaatactagagatccagctcaacgtggtctttaggggcacagattctggagccagattactttgtaattcccagttccacattttactagctccatgactttgtgccagttagttattatcatcccttatctgtaaaataagattattaagagtgtctactcatagggctctgagaaatcatttgagttatatgcaaagcgtttagaacagtgcctggcacattataagtgctaaataaggcttatctctaattaatacatcactgaaaaatagattcagtaaattttcctttgggtaattaagcaaagctcatttctctctcaaggtatttctctctttccagacaactcttccctttctgcaggtttatttaaattaatcacagttgttctaataaagtgtcttgaaatacataaatgaattttggttagaaaaacaaataggagacctagagatcacatcttattatgccttaccttgatttcagaaagtaatctactaaaaatatctgagtttatcttcctttttacttctatatctctctcaatttagattgaagtcaactgatggttatctttctattctggtgaatattaataatgaatgaatatgtccaatgtatcccccaaagtggggataggtccattccaaacttggcagttgaaatagctgtacattaattgttggtgaatatctatggacttcactatgttacttccgaaacaataattggcaaccacagcatctataatgacgtttttatattttaaacttcatcttaagcttttcacaggagtgacaagtacaatctcagatgaaaaatttggtatgaatgaatacgaattagtggagaaccttattttaaccaccagtaatagcaatactgtaagaagttaactttccaatatttatctttaatagcattacacattttcaaatttcaagtagccacatttactttggttgaaaaaaaagatttttaaaaatttagtagtttttcccatgcattttcctactcatttacctactttcatgtgagtataacttaatttgtttatgatggaaaaaatgacaacctctttcaaaataagtagagaatcattcctggctgtcaaaatatctcacaattccatggaaaattgattaactctccatatgataattcaagggagaagtgtcactgtatagctaatcatgtgccatttactaatagatctgaacttacgggtagctttagcatttgtgattgaaaattttgtgtacaaacagaaaaagaacaaattaatatattttctggaatataaaaatgctacatctataataacaagaatgtaaattggaagacatctcagccctagttccttgtttgtttttcatttcacccatgttttacattttgaaaaaaacaataatccaagaaggccggatgtgttaggccatttttatgttgctataaagagataactgaggctgggtaatttataaataaaagggatttaattggttcatggttctgcaggctgtataagaatcatggcaccagcatctgcttggcttctggggaggcgtcagcaagcttacaatcatgacaaaaggcaaagtgggacaggctctcacatggtgagagcagggtcaagagaaagagctgggagatggtacacacttttaaacaatcatatcctgtgagaacccactcactatcgcaaggacagcaccaagccataagggatccacccacatgatccaatcacctctcacaaggccccacatccaatgttgaggctgacatctcaacatggtatttcccagggacatagatccagattatatcactgaatcaatttgatcagtagtgacaacttaagaaagagaaaaagtaataaacaataagagaaacaatattaaagctttagaaactcaaaactgtcaacataaaataaataccataataatacctttttagcaattacattttaatgtccccattcgataccaaattataggcattttcatagataaaaatatttctttttaatgtcagttaaatagttatgagataactgtgcttaatatttaaagttttactaaatgctaatttctaatttctaagcattctgctctctatgccctacaactaacaattgctccttttgtcactagagcgttctatgttttattattcttttattcttctacctgtctaattctattaaaaatggacctcagtagtacatatccatatacattatatgtgtgtgtatatataaatgcatgtatatttagatggaattttatagaaataatgtcttttgattattatattagcactcatttgattaagatgatatcctaatctcttcaatatcctttaattctttcattcacttattcaacaaatatttattgaacatattctaggtgccaggcattttgctatatctgggatgcacatttgaattagatacagttcttacctcacttggataattatattgttattaggaaattatagtaccgtacgataagtgcaagatgagtgaggagtggatgctcttggagaatcccttctagcaaaactgagttaggggactgattaaaagaaaaaggcctgctgatgaaattgacattctagttaatgccaagaacagggaaatacgtttcaggcagagaaaattacatgtgtaaaaccagaggcctttttgttgtataatattagttaacacccatgtaacactatatgccaatcattattacaagtgattttcacactatgtaaacaacccttttgacataggtttgttattactcctatttttctcttgagaaaactgaggaatgaattagttaagtaactttcccaagttaacataaccagtaaaattcaaggctgggatccaagtagcttggttccatcatctgtaagtttcctacttcctctcaattccatactgccttttacaataaaaatgcacagaagatttaatttattatgctaggtattcattttgcagcccaatcaattgagtaaaataatttgagaaaccaacttacaaacgtttaaataatacaaaaaccctgtgtgtcatcaatcatgaatttcaactcagcaagaaggctaggaatttacttcactttaacaaagatttattgtcttcctctacatgcaagactctgtgctaggtaccagggatgtaaagatcagttagtttaatctcttccctgaaagagttcacaatttttcctgcaaaataatatgttaaccaataagaatttataaaacttatgccaaatacaaccaagcagacacctacgtgtgatataagggtacagagtttgcctgactcacctttgaatgcatagcacgatgtatattacctgactaaagatagaatgaatgaatcaacacagcaacatgctataaagggaagaattactttcctcagggtaaatcatgagatacttcattaaaaggaggcatttagggcctgtaagagtggattggattttcttaacggaaggtggtagagtagtaaggtagatgaaacttgacacatagagggaaagaggagcaaaagcaatagagtagaaaagttagaactgaataagaacaatgagagaatgtcctgaagagttgggttggtgtaagtttctagatggcctcgaatgatgtaacaggagcctataagaacattttagaggttaatttgttaccctttgtgcaaattaatggtgatctaaggcagactaatgaaaaaaagaagagaaggaaagagatatatgtggaagttagttagggatgtattaagattatgtttttagaatgctgcaatacattttagtgcagtaacctacattaactgaaaaagagagagtcatactttgaaaataagaacaatctccttcatttcatttatgggcatagcaaatttctcttcttatcattgcagtttctgtggtccaaagcatgtttgaaaatgaaacatctgtgatactgaaatatcttcaataacaaaacatctgcgatacgaaaatatcttcatttttttttagaaattgagaaggcttcccttaggcatatgtcccagatatacagtatcacatcttagttataattgaaaacactgtggtgccccaatagagcctccaaaagaaaaactaacccatatggatttaactaaaataaatataaataattaattaaataaaacctaaagtgtgaactgatttgtatcaaagcttctgctttaaatgtcaatgagcagaacacacttaatccatccaaatatggagtgtttgttattgatatttagtatctatgtagagaaagattaaaatagcatttaaactaaactagattctctttagaattcataggtaagttccttccttctaaatatttcctagaaccaatattttaaataaagttatggttctagattctgggagtatactcaagtatttttgacttgcatacaatatgtagattcccatcatttctcaattcctgtgtcacctttccagcccctctccccataacacaaaccaattgtagaaaagttagttcgagttagataaagaaaatttttaaaaaatatatattttttgagccccctgaccctcagagataatcagacccaactcatataggagcattttagctctatgcattgggcctgatggacaataatttcagtggagcagagatagtggagaatgaaagaaaaatgaatttcatgaaacacaatggagatgagaaaatatgctgaagaagagttgtgtctctgcatgaaggaaaaacaatggtagtaataataattccatttattgaacatttattttatcattgaatcatcataagtaggttttataagtctttttttaagatgaaaagaattgtgcctcaaaaagaattaaaaaaaatctggttaagaatccaggtgggaagttttagaattgataaatgttttatgtctcaaggtataattttagtattttttatagttacattttggagattgtcttgatgtggcacctgcaaggcattttatacagtccttttgtggttcagtaaacagctacctgggccttagttatgggatagagactgtcagtcaccccagggtaaggactatgtcttttctcatctgggcctgttcaccagccaagtacctggagaacagtagttccttcaaaattaagtggtcaatggagaacagaagcaataatgagaaaagaaataattcaaaaagttaatttaggtagacaaatataattatataatgtaactaattacctctggcaagctagctatttcaatttcaattaatactattgaagagagttgtcactggacatttattataagtcctatatgtatgtgtaataggttttattttgagaagctataggtctaattttaagaatgcattggttatactgtgctttaccaattctaagtaaacataataaaacataatatttatatttgaagtcatatgcaagtatagttacataaatagatatgattactgaatctcctgtagaaattatttgcttgtatcctttaaaaattaattttagttgtacttacacacatatatttcttgcatatttgtacatttatgcacacacatagacaaatataatgcaaccatttgaaataatatctttgtctaagttatacaataatcagttgccataccattcttgatggtgtgtccttgactgcttgcctgaactcatgaagttattacaatatattaccatccagaaatattataacacataaaataagtctgttgacggtttatagaggtaacttgaattcggaagaataaaatatttgatgtatacggatatctgctgcatatgacagtttctaacttagaaatggattaggctttaaaaatttgaaatccagataggaaactactggctgttttattcaacgataaatactacagtactaattatgtgctaggcattacttaaagcactttacaaattttactttatttggtctccataacaactctataaggtaaataatattcccattttattgacgatgaaataaagcacaatgaaatcaaatatcttataccagctcacatagtaagtggtaacactaggctttgaaactcatcggtctggctccagagtctacacccataattattgcacagaatgtcttgtaaactctattccctttcacttacttgccccttgtaacaggtcttcaacagttttgcaagcgattgctaaagtcttagagcgagccacataagtattttatcttcagtgtggcacatttatgaccaaagattgcaaaaataacatgagtatactcttaaaaatgaaacataaataataaataaagacttatctctttatgttgtttaattatgctttggaaagatcatttttccttacagaagaatatgttgctagatagaagtgttgtagtaattcttttttttttttttttgagacggagtctcgctctgtcgcccaggttggagtgcagtggcgcgatctcggctcactgcaagctccgcctcccgggttcacgccattctcctgcctcagcctcccgagtagctgggactgcaggcgcccaccaccacgtccggctaatttttgtatttttagtagagacggggtttcaccgtgttagccaggatggtctcgatctcctgacctcgtgatccacccgcttcggcctcccaaagtgctgggattacaggtgtgagccatcgcgcccggccgacatgtagtaattctaaaggatctgaatgtgttcgagaattttagaggttatacacaacaagtactttattatgtctactgtaacttatgactttcctttcccctattatagatatatcactgtcaatatcctattgtttcaatctttattactctaaaatagaattcaggcaaaggaaaaaagttcaagtaaatgaaaagatttatcaaagcatttaggtaatagttgggaggagtgaagggaaaaaatagatcaaataatatataggtgcttgtatttgaaaaaggtttgagtttaaatttctaatccatgagagaccaaaagacaaagaatcttttgtgatcaaaccgatagataactatttggaggggagagagagacagtgctggggaagactgcatagctcacaccgctttgtaggggctcactgggtactgttcgctgggattctcttggcaattagcccaagagagcagagcatggcagtgaggtgagagcaagcgtgaatacacactgatgctcctatgcgcagaatattcgcagtttataggtaaagatatgtgacttgcgaatattcctacacctacaaatgactattcccacactgtttttataggtcactgggctgtgttttgagctcaaatattgcctgcatcagaattcgtcgttatttcatagtgagtcatttgacaagtctttgttcttttcctggctgcaataattaagctaatgaaaattcttctcagtctcagacctgctgagaaaatttcccaggaatatgggcctttgaaaaaaaacggaactcttcccttgcttacttaaaaatagtattaaaaaatagtagtttacctcttttgacttgaaccaatgcttgttcaagactaaggatcttccacatcccacacagtcttctgatcctcttctagaattctaagccctttctacctaaattttctagaggcaaagtgcaggtttaggcaagggaaatagccctagagatgtctatggggtcccatgagtgaggaaatccagggcaaaatcaacttttggcctgagaggagccttttagcaaagacgtgattagaaatcttaaatccaacctatgtttctgtctaacagaaaagcttttgatccataatgagccactttgagggattttcaaagaggtattgctttttgaggtctcagagaaggaaaagtggagcttggagcctgcaaaaagcacactgaccctaaggagtaccggaaagttgctttctcagggagctatgagtgaatgttttggaaagctgcttgcctggcacaaaagaggaactctgaaaggctgacaaaaatgttccttatttcagcacgtatcaatttattactcatcagctcattagggttttacacggtagttggtttatgcaggccccagtgtgtaatgaacccgagaagtgaaaactcccccagaaccccaggctctcccaggacaggtaatttactttccagtgaatggtagtggactcatgtttttgtagttgcaatcgcaggtttgctctgattagtgagatgtcccagaactgtaaattagagtgttttatttttgcttcagtatatacattctgtatatgcatagctaagtggatatagaaatagatttcagtttgaaatttgaattacttaaccagtgtttatcaacagtgtacagtactgatgttgcacatggcatcagggcaaagtgctacaataaaacataggaaatctgtgatcttaaaatgcactttgccctgttcttgtagagccgtagattgttgctgtgaatgtcagtgctatttagggaggaactagagtgacaaagatacatcctggatttcttagagttgcctatgaccacacgtgcagtttgtctctgaagccagggagtgcctgattaaatacaggacccacccactgtgagaaaacactctggcatcccagctgccattcagaatgtaaaatccaggatatgacctgtcaagatgagcacttcagcatattgtggcaatgcagctgtcactgagatacataagtctccagagaaaagcattcaaactgtttccatggtggaatgaatacaaatgcacagcagctctagtcatatttgaatgtgagttttttcagcaggatggtccatattaaatatgcagatgtgtgcaagtgaccccagtacctcttctcatctctgattgctgagcattttctgaaggcataattttcttagttttcatgtgagaggggcagggaacatttgtaagccatacagagttaagatatccagttgtcctttttccttaatgaagacaaaattgttatagattatccatgacacatctgaaaaagagatgttttcacaacgtagatttaagttattttatatttatttcttgatattgaacttattctcttcaacactctgacaaatgtatagtgctagcaacatatttataatagaacttcaaaacttctgacttgtaccattagtgtcaggagaagcccagtgaatataattagtgattttataagtgtttttctaataaggaattaacgtgtatcaccctacaagtgtgcccaaataagtggtaacaaaaacttggggaggaaatttccttcctatgggatgtgtgtgtgtgtgtgtgtgtgtgtatatacacacacatatatctgaatagaaaactgaatatatatatttacatatgtgttatatacatttacagataggattcgatgtattaatgtattatatataattgtttatgtaaatataatatacaacatataactatacatgttatataactattctgaataggacactcatatagatatttactttattaattagaatgaaatgatatattacctaatgataccctgtaacaatttgtttcacttgtttttctcagaaactcttgattttaataattcattaatttaacaagtatattcaggcttgttatgtgaaaatgttaagtatataagtgtttccagtttgttcacgtataaatttagaacttgcatatccccaaatacctgaaagccataactgaactacaggataaccttcagaccttcacacttgtcacttcttcattgcactgtgatttttgttttcgtatttttttttggccccaagtacctatcatattccccagatggcttagccatcatcactggcagattatgaataatgttttacattgaacagatgtaagcaatttgtaatttttcccctttctgaaccagctttgttttgatgaatcaactggaaattgaaacttaagtagaacttctgtttgaaaaggagcaatgttttcccacattggcatatgtagtcagctcttaaatatagagaagaaacaacgaataggggaactggccagggtgtgtggcaagaaatactggaagatcattatttagcattgccatatagttccaatttctttattctatagaaccacataataataaaaaaaaattaagttgctccaaaccaaccaaaagttcatcaggttgcctgtgtttctatccagtaagaacattcttcaaaagaactagaattctggaaatacagtaagagctggtgaaatgttaaaagagaaagaaatgagctatccccttgacaaggatgtgtttgctctgctgaattgtattttatgtaattatataaattataattgtattttttgaccctaatataggcaagtcaaattaagcattactgacaatttggtgttaggataagctctctacaagctacaaattaggtgaataatctctctacaagctacaggttaggtaaataatgacaaaaatatctacctaagacagaccttaattatatggctagaaaaggtacatttatttatatatcgatagcctattcataaataatatatattttccttacaatagccagtggccagacctaaaacgccacttaatgtccagagttcagttatggtcctgcactttcagagcctgtttctgacctgataattcttgcagtggaaagagcaatcaaactgagtatccttcgctttctttaaagtctatgagaacaatctaattggcagttggtctggaataaatcttaattattgaacacttgcaaatttgaaaacttcatatgctacagacagaatttgataacaaaaatgtcaactatcctaggcagacactaatgcacttcttatttctgtgctcattacttaatttcaacatcactgatataggaagtttaatgttaatatataaaatataattcagtagaatcatagaccatcctcaaagtttctttaacccttgcttccaaaaaataaataattaaataaataaataaatacacatgaaatctcatgtctatctttagcaatatttagaattgcaaaataaattaaataatatgatttgaacccaatcaaaacaactgtatttattatacttcttctacttatatcccactctaggaatctgtatgtttctctgacagtgaataatcattggttctaacaatctggtaaaatctcttatttttattacttttttagagatagtctcatactgtcacccaggctggagtgcagtggcatgataatagctcactgtaaccccaaactcctgggctcaagttatcctcccacctctgcctctccaataactaagactacaggtgtatgccactactgctggctattttttttttttttttgtcaagacagggtcttgctatgttgcccaggctggtctcacacctttggcctccaggaccctcccacctcaacctcccaaagtgatgggattgcaggcatgagccactgtgcctgacctaaggatcttattaactaaatcttttgtgtaggcagccattggaggaactcattaggtgtattttcttatttgattaaggaactgaatgggatggcttaccttgcccccctccaccttttttttcagatgctataatttaaaattccttagagatatataacagagttccttagttcctgagtttgctttgatacacaattgttagaccaaaaataaaaagcctttttttttcatgaatgttcaaaatgtaggatcctctggatatcccttaaagagttcccataaattttatggattcatagccttcttccaaagaaagaattaagatagcaactgagctatttcagttgtcttttagttaagtaaccccattagagatacaatgtgaggtttcttaatattttaaacttaatatttccccaatattttaatgcagtttatactctagcactctatagtttctttttgaacctctatataccctagattcttctcttgccttctgcactctacaggtattacatgcattttagcagtttatacatgaaatttgagtcatcatacaaaacaatattacatgaatgtactaaaatagaaacagatggtcaataatactgtacatttcttcgtaaaccaactcccacagattgcctttcttcagattttttgcccaagtagaaccaatcatcaaacaagtgattagagaggctttattatggaaatattcctcttgaacaataacaacaacaaaaagccatttcaatcacatttccattttaaagaaagttatatttcaccctctttaagtttattgttataaagtctgagttaattatctctatcaacttatattcttattcaaactgtcagtaaaaaagtttgtgactctcattcttgaatttctattacaccagttcgatagaaagaaaacaaattgtatggaataaatgtttgtcttaggcagtgcctctaaatttaagtgaatttcatgattgctatattgagttgaattgtatagtccacattccagattgacaccacatgatcagttttcactgctttctaaaatgtatcaagtccaaaaaaagtaactattggagttttttgtttcttcatttgttttgttttaccggataattttaaattcctggttgtataattcaggcactagttcgttaaattataaacaaagataagagttaaatgaaactgaacttaaatttgttggttgagttgagtgttatatgagcaggtattactggaaaggagaccccatctagaccccaagagtgggttcttggatctcacgtaagaaagaattcacggcaagtccgtaaagggaaagaaagtttattaagaaagtaaaggaatataagaatggctacttcatagacagagcagccccaagggctgctggttgcccttttttatgtttatttcttgattatatgttaaacaaggggtggattattcataccttccctttttagaccatacagggtaacttcctgacatcaccatggcatttgtaaactgccatggcccttgtgggagtgtagcagtgagaatgaccagaggtcactctcatcaccgtcttggttttggtggggtttttttgtttgtttgtttgtttgtttgtttgtttatgagacggagtctcactctgtctcccaggctggagtgcagtggcgccatctcagctcagtgcaacctctgcctcccgggttcacaccattctcccccctcagccccccgagtagctgggactacaggcgcccgccaccacgcccggctacttttttgtatttttagtagagacggggtttcaccgtgttagccaggatgatctcaatctcctgacctcgtgatccgcccgcctcggtctcccaaagtgctgggattacaggttttggtgagtttcgcctggtttctttattgcaaacggttttatcagcaaggtctttatgatctgtgtcttgtgttgacattctgtctcatcctgtgacttagaatgcctaatcgtctggaatgtagcccagcaggtctcagtcttattttacccagcgcctattcaagatggagttgctctgtttcaaatgcctctgacacatgtacataggtattgtgacctgattttgttaatgtgatttcttcgacataatatattaaatttcatttacatattgattcgtaatttacagtgaactattatttgtacgttatcattcaattcttttagcattcctaaagggaaaatgtttttacccaaatttagagatcaggaatctgaaacacagacattgcaaggactagccaaggcttagagcttacactctgagggctgactccattctaagtcctaggatttttcactgtaccgaagttgttcaataggaacattaacattattttagaaactttctctatattaatgttcttgattcggcaaccattttataaatgcagtttataaattaagtgattctgcctaaaatgtgttgaaggtatcaccgttgattcaaacaaaaagtaaagggaggaaaattagcgatggtttgaatagactgaaatttcaccaaatagagattgacatgtggagggaaaaaacaatccaggtatttattaatatttgactaatgaaaaatatttcatagcgtcttatagccctttaaagtttcagggctaaaagttgaaagtttttctctaattttgtggagcagaattaaaacagtggctttgtaatataattcaaaacccaaagcctgccaccttgtcattgtcttaacattatccttcatggaggttttcctcagctgggaagttccctttcttatatgctcatggaaagcccttgtctgagtgttcaatttatgccagggacaaggcaattgtctaaatgggcagttcctacagtatctgccctttatggcaggaataaaaatagagaataaagatttatatttgactaacccccaaatgctattagtttgatacttgctgggaatgcttttaggaaccacttagaatttgcttatggctatcttaattctattcatttgctgggatttgagaactctgatccttgactgatgtttagttagtgtactttgatagcaagaatgttacattattcaatggaatatagatcacatttgttgttccttacttttcttgaaattgattttagcacaactatctgggaggttaatgtaacctgatttattgatgtaaactgagcatatccatttgtaaagagtccagatcaagctaaaataagatcatcagaccattagaagagttgtttatattttattgtcatagtaaaattaacttttattgggaaactaacctcatataggctggggagtatgaaagtatattctctaagtgcctccttggactccttgttaatgtaaataaaaaatttgcatggataaacacctagatcattatcgtcttccctatctaacccatttttactgagcgttaggattacctacaccactaccaccccttgtattttaatgctttttttttctttgtaggactccatgtcctctgataaatgattgcactgtttcctttcaatcttagtaagaaaaatgtagtttccatggtttttgattttcaaaaagtaatctgatctcataagagcacttaaatgttaacctaatttaactccttcatcatgcttcagaagaccatccctttctatttttctagtatttcactttttgtatgtcaccacttcttcattctgcaagtttagattacgagtttcagttttttctcagaaggattaaacgtgaaggtcattaaaatagtaatggattaaaagaaaaggccattaacatctgtggtttgacatctgtttcatattttactctacctccaatttgccagctcaagattttaagcattctctttgacaactcccaaaagatattttactaaatgcagttataatccatctattatatgatgcttatttttaaaattcttcttcaccaaaatctagcccacatacgattatttaaatcactcatgtagtttgggagtcatctattttagttccattcaacaatctgacatggtaaataaagtctagagtattctctctggttatttttgtttaatttttctcagttttcagcaagattccattttcctgtgacttcattctcttacattagctttagctttgaaattgtaaggggtcattttatgactttcagattatcaagcattatcaaaacatcatgttttatataataaatatatacaattttatatgtcaattaaaatgaataagtaaatttgaaaaaatacattaattatgaatttgttaggagaaaagattatatgacccctagttacaagtgttacaggaaagtggaaattatattgtaagtttttcagtagggatgatcttaccaaatagctctataatgcgattgaagagaaatgctgcatgttatgtcagataaagtaggggtagttagtatctgccagcaagatgtaaagattagactactgctatagttggatgaactcccgtgttccttattgtgaattcatactgcttttgaccatatagaagtgaatgttttagacatagtgaaaccatattaagatcctcattttgttggtgggtaaactgggtcctaatatgtttaaatggtttgaccaagatcacatcattaacaaaggtaaatcaaggctgggcttcagtttttccaatactttcccactattgaatattgtaactcagggattagcaagtcatgagaatgctctgttttattaacactacaaatctctaaaataccagcaagaataaattaaataagcatgcattaagtacctactgtgtatccagcattgtgttgaatatgagttaaaaataaaaccatcatttatctcttctgtttctatttttattagataatgttaaacatttatattaatatgtaatgaagctatctttacaaagacagcttccttactccactttctctctttataaatggtttactccattttctctcttcacaaatggaataaacaactaatacctggaaatgtttctaagtaattttttaaattgattttcttgatcaaaactcatgaagctacaggccaggaggaatattttctgtctcttctgcgtctgaagaatactggagcttgcttgtactggctggcaagatctcattgcaccatctcttcccaattcagtgttcactgatgtcaggttggtagcttgaaatcagccatgatggtaatatttacctttttttgagtgttcaatttatgccagggacaaggcaattgtctaaatgggtagttcctacagtatctgccctttatggcaggaataaaaatagagaataaagatttatatttgactaaccttcccaaatgctattagtatgatacttgctgggaatgcttttaggaaccacttagaatttccacagaaattgacaaatgctaatatatcattgaactgtctcccgacacccagtgtctgctttaaacattcaccaacgtaccaatgtacagcttgttggctgagtaaaactggataagctattttacttcttgagccacaactgcatcctctatgaagtagggatgataatatattctattgtgtatattataatattttatgaggatcatgtgaaagtggtttgaaactatatggagtaaaattattaatatcacaataatgagagttacgtattcactaaatatgagacagttggcaaaatcaacataatatatgtagatctagaatttcttaacattgtatccatacttgatgtgacaatgtgcatagacagataaaaagaagaggggtgaaattcagagctaacagcaaagccttatttctctgatagacgtcagataacatacatcggtactgaatagaatttagtgatcattgagcataaagtagtatctccattcctttcttcatgccatgagtcctttatgcctctgatgaattaagcttataaagtttgataaagtattgtctgtatgtatactatgaagagcttctgtagaaaagattttctactttctttttctcagctacttgacacagacctctgaatacaaagggcacatagaaaaaaaaattaacaattgacctcttaaagttacagacttctgctttcattttaatgatacttcaaaataccttcagaggcatcatgcaattctgcatggaaattcataccctttggtacaatgtcattgcctttgtcatttgcaatgtggttaagtaaaatatatagtgaaagtacaaaattgtcttctgacttcaagcacttttgagagtgtacatgagaaaagtgggtcctttatactagtcctctcttatttacctttgaaaaaaattcccaaaaagcttcacacatagaaaaaaaaccactattgatactggcctgttaatcaccataacaccatacagatcattatttattttttccacctattaactccatgttggaaatgatcctaaggacttgctattccaagctgaatgttcttaagtagctaaagaatacaattttttaaagttaaaattaaaatagttatagccagatatatgtgagcttaaatcttggtcctgtcacctacaatttctgtgaccttcaactgattatttatcctttctttcccatcaccaccaagcctcagtgtcctcagctatgacataacatctactcacaggtttttggtgaggattaaatgaaaaagcaccacatatagagctctttacactgtctctggcccattatatactctcaataaattattcttattgctacctcttagtaatcgcttatctttttatccctaggtttactcttagcttgccaaatcatgttaaatatgtctgtctgtccctttatttacacacattagaagaagatttaagatctatcacttattgtctgtctggcatactataaggattacttcatggcagagtgaattattctcagcaagttcagtgctggaagttccacttttatttaagaaatttactatcatccctgctttatctgacaaacacaagccatctcataatcttaaaaggtatcatgaactgtaccaaaataatttcaaaacagaattaacttgtttgtgctttatgtaatatactgcagactagaatacaatgaaaggactattttaacagtagggaagaaaacagcagatattctatttcaatatgtccacggatgactgctttaagtttcatgttatgtagctgacacacatatactcctcataagaatgaatggacatattgacaaatgtgaatgatggaatctcaaaaaacatacatttatttattgctccatactgtgatttttgatgggaaaaataaggtcatcataaatggtctctattaggtttctggggtgactctagagttgagaatgtgcagatatgtcctgcaaagattactaatagaaagccaattatctggctgggcacggtggctcatgcctgtaatcctagcactttgggatgcagaggcaggtggatcacgagatcaggagtttgagaccagcctggccaacatggtgaaacccagtctctaccaaaaatacaaaaaaaaaaaaaaaaaaaaaaaaaaaaaaattagctgggtgttgtagtgggcgcctgtaatcccagctacttgggaggcttaagcaggagaatagtttcaacccgggaggcagagattgcagtgagccaagattgcgccattgcactccagcctgggtgacacagcgacagagtgagactctgtctcaaaaaaaaaaaaagaaaaaaagccaattattttataatatctcaaattactgcagactggaagaaccaaaagacatttttttaacccttgacatagacttccagtggaatgcagcacaaatctcagttactggaagacaaatatgagaggagaaatagaggagactccttaattaagaatacaaaggtatattttgttatacacttcatctcacattccagatagaagaatttctgggctcattaatggaaactttgcttataatataacattaaattacaactgttggcacagtgagattccatccttgatattcaaattcttctagaaattgtcacatttgatttttggaagaagaataacattttaagagaaaaaactatcattattaggttggtataaaattaattgcagtttttgtcattactttcaatagcaaaaactgcagttacttttgcaccaatgtaatacttctaaacttttagacttctttatttaaatataaacacaaaccaatattccttgtttgtcaatatattgaatgtgagctctccttagtatcaacgttgttaaatataacatttttgttcctaaaactgtggttgcttgaaataatcaggtattttgactcatcgggtgattattatctgcttttattatgagataaaatctaaaatattacaggatttaaaatcaataagcatttattaggtaccttcttttctttgcaatgtgttacaacctgaaggaaggaaagggaacaaaatggtgaggaggaaggagacaaggaataagagtgtttcacacaatttcacggagagagaagatttgaaactgcaattgaattttatagaggaaaccccaaagccatagaattaaatgtttgtttcagaattaaggaaacatgtccattgaggttaaacgacgttaccacaattgtccagccaataagtagtcacagaaggttccaagagagaagtgggtttgtgagtgggactgaagaatgattgttttgggatatgttgagagccaagtagtattgcttattatatgtcaagctttatgttcttttacctttactgtctcttttacagcattacaacctttcttgttaaatattgttaactgggctccaaagaagtgaagcagctttctcaagtacttataaacatatcacagatacaaagctgtgtcttctgactataaatatagccttctatagcacactgatttggtgggtagagacattccaaattttcagtttgtttgaagtaagaaattgaactaatattttggagcaagagtatataagacacctcacttagccaaaacagagctttcatgctctgttttgtatgtgagagagtagtgagatctacagaggctatcaaatttattaaaaagttataaatgttctattaacacataaagtccagagtgaatgtttcatacaacagaagaaagtataataataaaacaaaagggaaggaaagaaggaagaaaggagggaaggaaggaaggaaggaaggaagaaaggaaggatgaaaggaaattaataatattaaaaataaaacataacctctctgatgaaaaataatttgtatatgtctatatgtgaatgtaacatatattaagatccaaatcagccagagaagcaaaaggatgttgcatgttatagcagtaattatccttatgtggatggattataggtaatgtttttcttagattttttttccttcaaattttctacaaggagcttacatggatttggtaactcaaaaaaatcaatttacatagaaagaaatacatgtatataaactaaattattgtttgaatgtaaaattttgctaaattttaaaccataacatgtacagttgggataaaagctggaacatgttatactgaaacagtgtgaatattccattattttatcaatgcattattttcaatttaatatttttcctaatgaggatgaaacacaagttaatattctatttttgatagactccataaaaatttgcagttttcaaatatcaaattgtgtataggtagatacattcaggtatggatttcaaaattgtagtctgggctctagcttttgatgctgataaatattatctaaccaattatgctgacagaattaaaaagaagatctattcttgtccttttcacatgtggaatttgttactggtttaataccgaattgcaataatttagattggcctatacaatttcaaacacaacattaggttgataataaacacaaaatacagtcttattgactgtatttgatcagttctgtgtttttaaatttttagaaagttattacttattgcctacttagtgacctgatttaaggtatttttcaacttatctgttacatattgatgccatttattaaggtgtatctttctgtgacactttttagaaatcaataggataagtggcatttattttgtgttgtttcttcaaaaatgtcctgaaatattgacggtatatttttctttgaaattattcaaactgttgcaaatcaaatatcacaaaatttatttttctgttagcatttctaaagctaaattaattcagtattttaactgcatagattaatttatttagaacaagaccacaaaaagtttttaaagtcactctactcattattttcaaataagatgctttgcaatcacagtttcattttcaagacacttcagtgatattctatttgtggtgtctcataagatgtcctgtatcaaaaaatttggagtgatttcacgtctctgacaccattttaaagccaataattttgctttcagcatttctaacgttgtagttacttatttgtattgcatgtagaaattgctttggtatttgtcaatgagcaaccatagttacatgaacctcgaggaaacctctccagaattaggaaatggaaagcatttgttgatagtaagaagtctggagtttcatacaagtaatatagcagcatttttctcactttagaaataattcagcatgaccttcatactgccaaattgttcctaatcattgactttgcctaatggaaatactgttttctttttgactgattttgaatttgcttggcttactttaaaaatttataaatagatagtttttttttaactaaccaactctatcacctaacctctgcaaccatacatattcacaatactttcacataaatcacattcacaatactttcttataatcattatttcatgttaaaaaacacttgttttctcagagcccagagagcttcaggccacatcatagtttcttcaaagccttcaaagaagtttgactatgctccttgcatagaatcactgtctatgttttcttcattgtgtttatagtgtatgagttatggttttgctcattcagttactttgagttatgagaaaattcctagatgttcttctctgaaaatttcttataaaatcgtctttactgagaacagatgttctcaaaacaattgtgataataaagagttcataacacatttcatacagctcaaaatatttagcccatggccttcactaaatgagaaaaaatagaatatgtgtgaggccaatcctgattcagagaagggagaaaatgaaagacaaaatatagaattatgatggccaggtatattttccctgttttggatgtttccagtgaagtttgaaagtataaatttatttaaggaaatgaagtaacatatcactttaagtttttttcatactcagtactctagatgtattttatctcccctggaaagttttataaaagttttagagaaaaagaaaataatatgcgaaatctaaagcaagcttattaaatacagcaacaaacaggatctaacataatattccccttacgtttggatggcagagcacatatctctccaaatagaagacgatagaaaaacaaaataatttttaaacttattaagtttttgtgtttatcattggacaactttgaaagtaagagaaaaatccacactctttcagctgttttcaaaaaaggtcattgtccttaaggaaatgaatatgccaagaaatattggaagtctccttccttccagagatgtgagtttgcgtgcttttcacaccaatgtttgacagcagtgatggatttaaacattttgaaggactttattgcctataaagtacttatcagcattgaaatatattttatctatctaacaaaatgttaaattgcataactggaaaactatcaattattctacaacttttttttattgttgttcttatgtgagtggaagtgaggcttctaatttgctttagtaaattgtgacttggaaaattggagctgaataaatcagttgatataacatagataaagcatttatttctttggatttttaattgcaatatcttacattttgaaaatctataggcatagtttcaaacttttttttctgggaggattacttaatctctacccaattaccatgacttctgcagttgtatttaatcctttttgagaaaattttactctgcatgttatataaatgtttgctattattcatttcaaaggtgagattctagagtaatattcacctacattccaggtcccttgggtatttatatgacctcaagaataagaaagaaaataaaggataaagaagaaataaaataaaagcatcaaattttctaaatgcttaaaaatatttcttcagtaattctttaaaatattattcataaagataccttttaagttttctgcattatatacttgctataggatatgctctatgtgtgtctaaattcttctcttcttgattttgttttttgtttttccagttactggctgaccaacaaagttcctatcaaaagacccagcacaggtcttctcatgtatacacttgccacaagattctgtgatgaaattcacctgtatggattctggcccttccctaaggatttaaatggaaaagcggtcaaatatcattattatgatgacttaaaatataggtacttttccaatgcaagccctcacagaatgccattagaattcaaaacattaaatgtgctacataatagaggagctctaaaactgacaacaggaaagtgtgtaaagcaataaagcacattttgaaacaaacaatatgcacttcttttctgaagatgcttccgaagatttgaaaataggatccaaaacacggctgggtttcagcatccaccaatgaactgaaaggtgaataaaggacgttcatgagaaatcgactaccagctgatgaaatacctgcaaagtgctctaaaaattaaatattttgactttaagggtcctagtaagtgccacttccactaagaatacagtttgaatgtataatcagtagtgtttacaagatccaacagtgcactcatcattagttaacaaagcaaatatgttcatcactgtcaggctgcccacagcaacaccaagcatattagaagaggaaccccaggaacgcaactcagaccttgggaaattaaaccatccttgtcagcagaagccaagatggaagcagtttgagcaatgaaatccgtaagattaaacaactcaagtaaatgcttcagtcaggactctgagtctgatcatgaattttatgttttaatttatgttttttttttgtcttctggaatctcttttggtttggatattgggatgcttagaaatcctttctgagatgcatatgagtgaggaaataaactttaagtaattatttttaaagttcttatactttttaaaagctatcacacaaagacttttttttttttttttgtctcgctctgttgcccaggctggagtacagtggcgcgatctcagctcactgcaagctccgcctcccaagttcactccattctcctgcctcagcctccggagtagctgggactgcaggcgcctgccaccacgcctggctaattttttgtatttttagtggagacggattttcaccgtgttagccaggatggtctcaatctcctgacctcgtgatccacccgccttggcctcccaaagtgctgggattacaggcgtgagccaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaataggccgggaaaaaaaaatctttggtaccaaagattacacttgtgtttctacacagcaaaccatttttctttcatgaaaataatatattattaacatgaatatattattttgctattaatgtgaaagttgtctctaaatattttttaattttcaaactcatactttattttcatttgaaatgtttttcacaccttttgcattacataataattttgtggaagcattttgccctttagaataaatattagattgatatagctgaaatgtgacttccagttctttgatattccccttgttattcaaatagaaatatggaaatgctttatatattactgttaaatttcttagtgcagaaataacattattaatagagtattgttttcaaaacagagatgattaatttcaagaggtttaacagtgaaattgtgtcaatattttgcatttaaaatgaatttaattgaccgatattttctgtagttaaatttagtcacaatatcacatatgttcttcaagaaacacatgaaattattaataaagtaattaaaaaatttttaatgtataacagaattgaccaataggccagttttctggtaacttatgatagtagattgtttctttagaaactgggcagaagctctgcattctcacttgtactttgatttcttatttcttgggcaggcaatttgaggaaagaagaaatggcatggggaatatatatgttttgtttcttagggaaaacagtctgagaaatgaataaaaagcatgaagtacgtgtgtgtgtgtgtgtgttaccatggaaaaggatattcacagtagtacagttctcaatatttttaattagatgtcatatttttttaatatagtaaaaccttgggatatagaatattacatcttttgagaatgtatgtgtctctaagtaagtaaaatctaatgcgtataggagactgatagctaaaaatgaatggaacattaatgtacttttataattaaacctcttatctatcagaaattgtaagagaatagatacatgttttgaatgtaaagttgaaaagtctggtttacttaataaattgaaagtgatttataaaatctaaatttggactacttgcaaatgataagctattctagtagcctttagtttaaatccaacagaaatctagaagtcacaagcaaatatcttaaaggtaaaatccatctgggcactcatttaaagtatatcttaaaaaagcagcagcaaggtaccttgccatttttagcatattttcttcctttttcttttttcttttttttttttttttgagatggagtctcactctgtcacacaggctggaatgcagtgatgccatctcagctcactgcaacctccacctcctgggttcaagtgattctcgtgcctcagcctcccaagtagctggggttacaggcgcccaccaccacactcggctaattttgtgtttttagtagagacaaagtttcaccatgttggccaggctggtcttgaacttcctgacctcaggttatccacccacctcagcctcccaaagtgctgggattacaggtgtgagccaccgcagccggaccatttttagtatattttcagtaaatacatttaaacaatgttaaggccacagcacacatatctcagccattcattgttctgtgcattgatgtttatctcatagatgcattgagtagtgcctttttagctttttcacattactttgtcaccatatcctttgtgttctctaaatacattgcccacttccaaaaatgttcagcatgaaaaaaagggcttcagtgtcgattgagattgcttttgttcatctcagggatttcaatagtcaagaatgaattcagttaaaggtatttagggttcaaagaagacaaactgtacaagcccatttcattccttgttgtatacctttccatctgccctcccattttaactatctactgtggcctttttatggaaacagagcaagatcaatgaaggctaatggcaagaataagaaaaagagttgagatttaaccaatagcggagcataaaggatcatgacaaaatcaaattataaaagcatacttgaaataggtggagctttttcttttgaaaatatatattcacaattttaatattttaatttattttttactatttaaccctgtacttggcaatgctcaggcagctgattgtgaaatattcttgtcctttacagaacatggttgttattgtgctgttgacatgaatagaccatggaaacattttcatcattattattcagcctgtgctgtagttaatgttaagttgctgaaataaaaagtgagcaagtaatagattttcttggcaaatctaatgattcagcccacaggactgttgaaactactgcggaagtttttctatctgaaagaaggtgctgggcattcaaatgtgttcatgtattgtatatcatatgaattgtatatcaattactaatgggaatttctacatatatgcttacaaaagcaatttatttaagtaatgctaggggtagtgtacataccaattagttattcagctactatacagaaaaaggatgaacaaattaatttatttctaattgagccagttagacataatgcatataacgtgatatttggttcatgaaagagttgttttcatgtggttattgtagggagtatatataattgtggaaggggtatgggaagagttgtgtatagttagttgttatctctacaagtttgaaagttttcccatcaaacattatcaatataccaatgttttaaaaattgagtgagggttattatttgtatttgatgaaagaaaatccaaataaagcccacctagaaatagatattttattatatatgtgctatagatatacctatatagtacaaatagacatgtgtgatgcatatatacaatgttatatatgtgtatatgtctgtatacacactgagtctgtaatatgtatacactaaatttgtgttatgctaacatcttcagggtctgcactgtgaactcccctggagataagtaagtccactttagaataaagaagttcttttgagacttcagttactaacgtgctttaagaggtatctactttataactgaattctatgtcgttcatacgtagagttacagtaagggtctagtatgtccaaatcttaataataaagaagaaaagtaaaggcttcaagctagcaatgtattcgaattacagttttcagattgtggctccaggccttgtgtttctcatttaagtagcaccttttaataaaaaccgtttctttgtgtaggcaaaagcacaagtgtttcaaatgtaaatagcaggaaaaaaaaagagtttacagagatagcattgctgcacagaataattgctactgagtatttcttatagaatttgtggaactgaaagatgaggtttattctgtcaagttcaagttcattctgttcaacactgttttcttattgtttgtgtatagcaaccgggtattattgttttatcatttgtaaaattgtaaaataaattaatccctttttttcactgtttctcttatctcatatatccaagcccttggttatactttgtatgtcaatgttaggtgatcatttttaacaagctttggcttgtgctttgcttttccactccccttagccctagtggttggcaattaggcaaaccatttatttttaagtgtatacatgggaatatgaacaatgtcaaaaaccccatgaatattaggaaatccttaacgatattttgtgtagcacattctgtttgcggttgagggaataaagtatttcacaagtga

SEQ ID NO: 471 - DNA, 157582 bp, Homo sapiens
aggttatgtaagggtttgctttcaccccattcaaaaggtacctcttcctcttctcttgctccctctcgccctcattcttgtgcctatgcagacatttgagtagaggcgaatcactttcacttctgctggggaaattgcaacacgcttctttaaatggcagagagaaggagaaaacttagatcttctgataccaaatcactggaccttagaaggtcagaaatctttcaagccctgcaggaccgtaaaatgcgcatgtgtccaacggaagcactggggcatgagtggggaaggaatagaaacagaaagagggtaagagaagaaaaaagggaaagtggtgaaggcagggaggaaaattgcttagtgtgaatatgcacgcattcatttagttttcaaatccttgttgagcatgataaaattcccagcatcagacctcacatgttggtttccattaggatctgcctgggggaatatctgctgaatcagtggctctgagctgaactaggaaattcaccataattaggagagtcactgtatttctctccaaaaaaaaaaaagttatacccgagagacaggatcttctgatctgaaattttcttcacttctgaaattctctggtttgtgctcatcgttggtagctatttgttcatcaagagttgtgtagctggcttcttctgaaaaaaggaatctgcgtcatatctaagtcagatttcattctggtgctctcagagcagttagcccaggaaaggggccagcttctgtgacgactgctgcagaggcaggtgcagtttgtgtgccacagatattaactttgataagcacttaatgagtgccttctctgtgcgagaatggggaggaacaaaatgcagctcctaccctcctcgggctttagttgtaccttaataacaggaattttcatctgcctggctcctttcctcaaagaacaaagaagactttgcttcattaaagtgtctgagaaggaaggtaggttatatttttattcccattctatagctgggtaaagtgagttctaacaaagttacttgttaaaggtcactcagaggtcagagcatcagaaaaaaagacaatcacaaggctgatgttgtgtgctggatagtttaaactgaacaggaagaaaacatttttgtgggctttatctaaaaagaaatagtttgctctgagtttctcagtttcatttattcagcaagtatgtgccaagtgctattgtaggcaatgaagatacagcagggaacaaaacaaaactgacatggagcttccaactagaaaggagaacgagacaacgcgttttaaaatatatataatgtgttaggtaaaaagtgctataaggagagctaaaacacaatgagaggctagaagagtgatagtggcggaggggcttctctgaggagatgacatttgatcaggggtctgaataaagtaaagaggccagttatgtgaatatctggaagactcaaggggcagggcggaaatagccagtagaaaggccctgaggtaggaaggtgtgtggcaagtttgaggaaaaggaaagacagtctgactggagcaaagagaactggagctgaggccatcaaggcagccaggagccaggtgcagactgggctttgactctgcctgcagggaggaactgctgaaggttccaagcaaaggaccgccctgacctgccttaggtttgaacaggatccctctggctggtgtgtgaagaattaactgtagatgggcaagtgtggaaggaaggagagcagtcaggaagctgccataaccatctacatgagagaggtaaggcctcagatggaggggagcagtggaatggtggaaagtgtttattttgaatgttaagcctgcaggagttgctggaggattggacatgggggatgagaaaaagagagaggcttacagatcaggtaatttagctgatcttaagccccttacagcttaatattattccaaggtgccaataacagccaaggtaaacaaccttgtcttggacattctgcctttatttgcccacacaagatgaaattaaatatatatatatatatataatttaaataaataaattatatatatatataatttaaataaataaattatatatatatatatttagtgctgtttccatcagctactagctgagacacttgggcaaatgagggtgatctccagtcctcagtatccttgctgttaatgagagatggtcatttcttctctgcctagctcaaaagaatatgttaaataaaactctgtgaactttaggcagcacaggcttagggcttcttagtaacatcatcagcaccatcagagttaacttcatgagtcagttgagttgcctttggggtatatcattaacagattccaggaagctcccctgcccaaaagcctcccaccaatggcctgccttgttgaaagaattacacaattagcccaattcctttccattaaggcattgtggactccaaacatcctcctttaaaatggaaactaaatcgagctactgtcagtcatttgtccttttaggtgacgttatatatcagatcacttttctgccattagagctagttgaagtttgaatagggaaaaggaacgaatgaacgtggggcagagaacgcaatagtcggtgggttactcagtaggctgtggacagatggagaggatcccggtgggaggagcctctaaagataaactttctatgggaaaatgttgacagatttacctgagtcatggtttttcttacacctcataaaaatgaaggcttccaagggcagctccttgaaatagctgtaacaagtagccacagaagttgagttgcttaaagaaaaacattgaattcatggggaaccgtacgctttaatagcccctttggcttactttgtttaaacaaactcatcccgagcatctcacacttcaccaattttgagtgtccctgctttacctcagccttttaaagagtgtctttcccctaaatatttctggaaatgcctaagggtgctgacgtgcagccagaaatagttcacttctgtccccactatggcaggaatccatggaccaaggctctgatgtttccacaaagatgcccctcaggactagaaatctgtccccatccccgttgccaccacagtcaccatcacctggaaatcctgcaggaccaatgtttgtgaatttggaatatatgctagatgccttactaccttgttatgaccttatttctttatagcacttttaacctagcgcattacatattttaaatgtataattcagcgatccagatcactggtccagtgtcacctcccactcagcaaagtgagatgaacacacttggtgctacattcagctaggctggcactgtagatgcacccagtcccaggtattctagtggctcatgacagggcttcctcactggagacatgctgagccaagcaaggcagtttttaccaccaaccctgatagtcgtacacatattctgctcctccacccccaccaaggttgaaactccgctcctgtcagctttgcagctaccaccaccccctcagggagagtcatctctgttcccaaacccatataaatgtcattcaaagccagaggatgtaattgctgtagtaattgttatagtccactcatccaggggccccactgcaaagctgattaaaccatagtgttactaccttttacagagttattattcttccaaatcaacccactgcacctttctccaaggctacaaaagtgcccctagggtggctgtgtacaggcaagttttgatgtcagctgggaaactacctataacccccactctctgctaacaccaacttttctttttctattttattttattttattttactttaagttctgggatacatgtgcagaacgtgccggtttgttacacaggtatgcatgtgccatggtggcttgctgcacctatcaacccaccacctaggttttaagcctcgcatgcattaggtatttgtcctgatgctctccctccccttaccccccaccccctgacaggcccgggtatgtgatgttcccctccctgtgtccacatgttctcattgttcaactcccacttatgagtgagaacatgcataacaccaatttttcttattggaattgtagtgccagtttagttcttcagtggaagcacttgttcttctctataatctgttctccatctgggaacaccctactttctcagacataggtttgcagtgcattggtgggcaggatttcagtcctttctctgaaagttcctaagccctattgaaaaatgaatgcactggggaagggtgtggcccatctctctccccagaagctcctgagccacatttcttacccagtcccggaaccctggtatcctaaaccatgtctgaacctgtacccctgtggccccagaaagggaccaaacagtacatcccatgaaaccacaaagagatcataaccttctcctctctcctcccacatctctacataaacaacatttatatagatgactgaattcaagatacgtttatttggtactgatggtcaactggaagttcctaagcagaattacttataatgtgggactgtgtttttagtggttgcagtgaaggctcaacacccctaaacacggtgggaacttgctgaggaggcaggctgtgaagggcagggtattagcatctttccttaaaataacatgtgtcttagtgtgctcaggatgctacagtaaaaataccatagatttggtggcttaaacaacaaacatttatttctcacagtctggaggctgtgaagtccaagatcaaggcactgacagatccagtgtctggtaaaggcctgcatcctagttcatagcccgctgtcttctcactgtcctcaagaggctgaaagggtgagagagctcttccgagactctttcataagggcactaatcccattcatagggctccaccttcatgacctaattacttacaaaggccctacctcctaataccatcatattgggggttaggatttcaacgtatgaattttggggagacacaaacattcagtctatataacaacacgtaccgtgaaactttcctactcataaaagtaatatatcttcactggagaaagtaaaaaagtacagaaaaatatgtagaagaaaatctaccatcatctcacatccagagatatccatggtaaatattttaatacaattcctgtgaagttattcagtacacattaatagagtttgaaaacataatctaatataaaagcatgaaattcataaagatattttaaaataaagttaatatgtatgtgtgtatatgtatttttatatatacacaaacatatatgcttattatttttattgtgagcattcccccatattattagaaaaccatgattttttgttctttttctttttcttttcttttcttttttttttttggagatggagtctcactctctcacccaggctggagtgcagtggtgcaatcttggcttactgcaacctccacctcccaggctcaagcaattctcctgcctcagcctcccgagtaacagggattacaggcccctgccaccatgcccatctaatttttttgtatttttagtagagatggggtttcaccatgttggccaggctggtcttgaactcctgacctcaggtgatctgcccacctcggcctcccaaagtgctggaattacaggcataagccaccgcaccagaccaaaaaccatgatttttgatggcatcatcttatggatgcaatataattaatttaaccattcttctactagttaatattaaggtcatttccaacttttattgttgttacattgcctctcattttctttataaatatttggctctttttattttggatatgttgtagctaaaatgccatccagatagtttattctgatttagtgcccaccaggttctaggtgcatgactgccatagcagagatagttgcatacagttcaagtttagattttgtttgtgagcgggagaatccaaagaccaagttcctaatattcttttgcctgaaaaatggctacataaccttgccaaatctcttaacattttcatgcctttgtttctaatatggaaaatgaagatactcaccaatttgtaactgtaaactactacacaagaatgaggtattcatttaaccatatggtgagattttgtagttaaaattaattaattgtgctcagtggtcagactactggctttaaatcctggatccattattcattacttcctattgtgtaacctgggcaagttacttaacttctcttctccttagtttcctcatctataaaatgaataacagaagcacttaccataagtgaggatgagataagatggtggtatatgtgagtggtacacatctgttactattattatcattgttatttattattaagcagtgaatttagactcaatgtgaaatggtttagaagtcatcagcttcccgtttcatgttcttaaagcactggtgataagagtatgcctgtatcatgcagttataactttaatcaaaatatgaaagtaactttaatcaaaatgccaagtcaaattagcaaagtcagcccttttcaaaatgtgtgccctaaagtaataaggtctgcagggtgtgccccagggacctttggtggggagtgggtggtagtcagaatggcgaaaacagtggggatttttagggcccccactcacattgctttgcttttatagcaaaaattgttggctgatgaacaaaatcatttccttttcttggactcacagctagacctaacttcccaagtcctgtacagttaaatgttaccatacaattacagtggagccatatgtgtctgtctcaaccacccaagcctgccattgcagtgtgaaagcagccataggcaatacttaaacaaagggatgtgctgtgttccaataaaatgttaccaaactttcctatagtttgccagcccctgaactagagcatggtaaggcaagagagaattgtagaacgtggttggaaaggcagaaggagtcagggaggaaagaccttgtggaactctagcacaaagtttggattttatcctaaaagcagaagggaagcctttgaagggttttagaaaagggtatgacctgaattacagaagctcagtcctcagcagatcagtatttcaacattcactcaccatgtgaaccattgatcccattttgttacttcctctgtagaatctcctcttaaggaaattgaaagcaagctcctgaatgagatggcattttcagggaaagaccaggaggcagaccccaaggggcttcacaagatggcatttttgtggccttggtggatttgccatgaccttggcttggcaggatcagaaacctgaatctattcgcctgtaagtcctcttttcttgtaagtcctataagacttacactaagttcaggtgattaacatattaagtcaaaaagcccattttagtaatttttaatgaaaaacataattgccacatgtgagaagcccattctattttcatagacatacttatattagaataacaatgaccataatggttagcatttattaacaataacattgtgccaggcacagtgtcaagcattttccatgatgacctcacaagtctatcggtaggaattgtggttaaaaccctcttatagataaagtcagaggttctaaacttataagatcacaatgctagtgagtggtagagatgagatttgaacccacacagtgtaaaccagagtgtggatacctagccactacaacatagtgtctcataggagacatgttcagaaggttgctagtggacattgaatccatgggggaaaagaaggcagaaaaatctgattttaatgttatcaggttaatggggcctgatgcagccatcttgcagaagaacggtattgctagcaggtcctccatgtttgtttacaacactggctacggccttcccactaggatgggaattcccaaatcctataatttcctagatggtgctggaagaggcactgctgaggtttgttttgccaactatctttcccctcttcttcttgccttatttgtcattctatccattaaggtgacttttcatccattttatatgaatttcataattaacctctcagggtaattcccccagcccaccctactatcagggcagtccccaatatgactaatcattcccacatactaagaccacagactgcttcagaatctgtatttatattttcactattaaaaaactatgctatcgtttcctgaaatctctatgaaaaaaaaatactaagctatatctggagtgaaatggtcagtaagaacacagtttgtcacacaaaataatgaaaatgctatttcttacttatagtgcagactggggttcttcctctagaattagaaatattaggcttgctaagatgtgatggggagttcattggggctagtgttttagcttttgaactcttcaaaaggaacagaaatgaagaaaaagacctgctttaataaacaaggttaagtctgtatgatttatggacttatgagcaaatctgacatccactcacatgggtggtcctcccaagggataaacttcgtaaaagcacatttaagaaaaagggagcagatactgttggtgccctcttcaccaggagacacactgaaaggctgcagtagcacatcagagcctcacaggtcagcatcagccaaacagctgttctgtgcatcacaagaattcgtacatatttcaaaatgactaatttgtacctatgagacaggatttgacccactaatttttgtaccgtaacgttttaataaaaattgttttttcaaagcgaagctttgctgagcagatgaattatcatgtgggagtttaaaaattagtcaaaggagtcttgacaactaagtcctttaagcttggccttcccttggcctctgcctactcctgatcataatctgaataaactttaacttttcgactagaatgcaaaacacgtgtttttgtaaaacgaatattaatggcataactcgtgctttattattttagctgatttgtatcaatgtatcaacattccaaagaaaatagggagcatatgttggttaataatttttgttatgactattgacatgtaattcacatgacataaactttaccattttaaaaagtacaattcagtgagtttgagtatgttcttaattttgtacaaccatccccgctatcaaatttcaaagcatatccatcacaccaacaataaactctggttctattagtagtcactcccaattcccttttccctagccccctggcgaccactaattaattatttctctgtctctatggatttgcctaccatgaacattgcatataaatggaatcacacaatatgtagtcttttgtgtctggcaccttccactcaacatactgtattaaaggtttctccatgttatagcatgcatcgatccacacttcatttcctgttatggctgaataacattttgtcctctgaatctaccatatttgtttatccactcatgagctgatcacttaggctgttgccacttattagctattatgaataatgttgttatgaacgttcatgtacaagtttttgggcagacatgttatttctcctgggtaaattcctaggagttgaattgctgggtcatatagtaactctatgtttacctttttgagaaaactgccaatatgttttccacagtgtctgaaccattttataatttcgctggcaatgtatgagagttccactttctccacatcttcaccaacatttattttcctttttttaaaaaacaattattgctgtcctagtgggtatgaagtgatatctcctgtattttcaatttgcatttctgtaatgaataatgatattgtgcatcttttatgtgcttattggctagttgcacatcttctttagagaactatcaggtcatttgcctttttttgaaatgttggttgtctttttattgttgaaatataaaagttctttatatattctagatctagacctttactggatatatgacttgcaaattctaccatttctgtacgttgtctacaatttcaaccattctgtgggttgtctttttattttcttcacaacgtcttttgaagcagaatagtttttcattgtgatgaagtccagtttgactatttttttcttgtgcttttggtattgtaactaacaaaccattgactaatccgagattctgatgtacatacatgctttcttctaagttttataattttagcttttacatttaagtttttaatccattttgagttaattttttaaatattcttttgcatgtagctatccagttgtcccaatgctatttgttgaataggtgattctttcctcattgaatggtcttggtattcttgtaaaaaatcagttgactgtaggcatatgggtttctggactctcaattctacccgactgatctgaatgcctatcctcatgccagtactacactgtcttgattactgcagctttgtagtatgtaagtagtagtacgttttgtgagtcctcgaactttgcctttttttatagattgttttgctattttgagttaagtatttttttaaaacatcaagttaaaaatgaagctgccactctctaaaggaggacaatttcagaaaggcactgagacctgtgcttggtatgtagtaggtgcttttgaaaatgtttgttgcatggaatggattgatttcatctctattctaacactcaatgccatgttcatttcccctttggagcctttcatctctcccttctcttttctaagaaaatcagtaactctctcattcatacattgtacacatacatatctttatttgtttatgtgtctattttccactaattagactataatgccatataaggctagaattacatctaattcattgctgggtcccaaagccatgcttaagaccataagtatataggggttttttttcttttaaaaagtttttatttttaattattatggatacataagagttacagatatgtaaagggtacatgtgacattttgatacaagcatacaccatataatgatcaaatcagggtaactgggatatccgtcacctcaagcatttgtaatgtatttgtgttagaagcattgcaattccactcttagttattttgaaatatacaataaatttttgttaactgtagtcaccctgttgtctactgaacactagatcttattcctcatatctgactgcattttcgtatccattaaacacccctcttttttattttttattttatttattattattatactataagttttagggtacatgtgcacaatgtgcaggttagttacatatgtatacatgtgccatggtggtgcgctgcacccattaactcgtcatctagcattaggtatatctcccaatgctatccctcccccctccccacaccccacaacagtccccagagtgtgatgttccccttcctgtgtccatgtgttctcattgttcaattcccacctacgagtgagaatatgcggttaaacaccccctctttatcccccctccccactacccttcccagaccctagtaaccatcattctattctttctctctctgagttcccacatatgagcaagaaatgtgatatttgtctttctgtgcctggcttatttctcttgcataatgtcctccagttccatccatgttgatgaaagagacataatttcattcttttttatggctgaataacatttcattgtgtatatgtacaacattttctttattcatctgttggtggacacttaggttgattccataccttggctattgtgaatagtgctgcggtaaacatgggagtgcagatatctcttcgatatactgattttctttcttttgggtatatgtccagcagtgggattgctgggtaatatggtagctctattttgttgttgttgttgtttttaggaaccttcatactgttctccatagtggctgtactaatttacgttcccaccaacagtgtatgagggttcccctttctccacacttttgagagcatccgtaattccctgtctttttgatagaagcaattttcactgggatgagatgatatctcattgtagtttagacttatatttctctgatgattaaggatgttgagtatttttggccattcgtatgtcatctattcagatcttttgaccatttttaaatcaaattattttttcctattgagttgtttacacaacttatatattctgtttattaatcccttatcagataggtagcttccagatattttattccattctgtgagttgtctcttcactttgttgatggtttcctttgctgtgcagaagccttttagcttgaggtgatctcatttgtccacttttgcactggttgactgtgcttttgatgtcttattcaaaaaatatttggccagaccaatgtcatctcttgccatatacaaaaatcaaatcaaattggattaaaaacctaaatcgaaggcctgcaagtatgaaaccactagaataaaacaatatatatgtgttggagggagagaagaaagtaatgaagaaagaaaggccaggtgagaaagtaagagagaagggaaaatgaacaagaaagacaaaagtcattccaggcactgttttaaggggcatctcatttattcttacaaccttatgagataagcactcttactttcagtttgttcaggatgctataacagaatcccatagactgcgtgggttataaacaatagaaatttatttctcttagttctagtgactgggaagtccatgatcaaggcactgacagaactgttatctggtgaggacctgcttcctggtttacaaatggacagccatcttctcttcttgctttgtcctcacatggtgggaaggggtaaagaagctccctgaggcctcttttatatgggcactaatcccattcatgagggctctgccctcatgaccaaatcacctcccaaaggttccacctcctaatgccatcaccatggggttaggatttcaacaggaatttggaaaggacacagacattcagaacatagcacccccattttacagataagaacagtgagaaacagagagttaaataattttctcaaggtcatacaacgaacccgtagcctaggcagcctggctctttggtcatgttcttaaatactatgccatactgtctctcaaataaacactaaaatcaagatacttgggatgatcgttgggaggcagagcccagatatctatactttaaacaaattcccaaatgatctgatgggcaactcagatgaaaatcaatgcttcaagaaatagccaaataaaactctatggaaggtaaagatggggagagcttggtgagatgtcatacttgggaggaaaagccagggaaagtaagagaaaactgggtattagtaaagatcatggagaagggaaaacacaagatattgctaggctaaaaaagaggcagacctgatgaagcagtgaacaccacttcagccactccctaccttggccccagctggccctggctgtgactgtgttccatactctgcaatgacatgtaacttccaccacgtccatatcatacctaaagcctacttcagtgtgtccacaaaagcaagtaagaataaaaagtaagagaaacaactcacatttatttgctgcttattatgtgccaggctatgtccttttttttttgagatagagtctcactctgtcacccaggctggagtgcagtggtgtgagcttggctcactgcaacttctgcctcctggggtcaagtgattctcctgcctcagcctcccaagtggctgaaattacaggcacgtttagtagagatggggttttgctatgttggccaggctgatcttcaattccagacctcaagtgatgtgcccacctcagcctcacaaagtgctgggattacaggtgtgagcctccacacccatgtgccaggctatgttttaagtgctctacccatgagaactcacttagtcctcataacaatcctgtgaggtaggtactattgtttccccccattttacagggaaggactctgaagcacacagaggttaaggagtttatcaaggtcactgtagctaacaagcagcagaaccagattcaaacccggagcccacactcttaatcactatgttgcttctagaagaaagaaaataagggatgaaggatagtaaaaacatgcaagcccttctgagccccctgttgttggccccactttggcaggagtgttaggaagactatgggaactcaaaggtgacacttagcactctcctccagaggctacaggagccatcattggtagctagccatttgtatcccccgtgatggtggagaaaagcccacactgttgcaagtttccagaattttctctgctctggaaaagactcccaaactagggttaatcaagtatcttttttggtgaatttcattaaaattaccacataaaaaaagaagaatttgtcctgaattatacatataggagaaaaatgataaaataaaataatttccattatctttgtagcaaaaaaagttggaatgattccaccaggttctctgaaggactttgttttcaaaggagatgttaaaatgtgtaaaatatccaaaggatacacttttgcagctgaatttaggatcttaagaaacatggttttaccgtgtttcccaatgattgttgaaaagaagcagtgactgggttacatctagggcagggtttctcagcctcggcactattgacattttgggccgggtaattctttgttgtggggggctgtgctatgcattgcaggatgtttagcaggatccctggcttctacccactagatgccaataagattctccctttccatctgtgacaaccaaaaatgtctccaggaatttccaaatatcccctagggccaaaatcacccagttgaaaactagtgttctagggaaaaccattataattaatagcatgtctatgatctcccctgttgcgggaagtcagggaccccaaacggagggaccagctgaagccatggcagaagaacgtggattgtgaagatttcatggacatttattagttccccaaattaatacttctataatttcctatgcctgtcttcactgcaatctctaaacacaaattgtgaagatttcatggacacttatcacttccccaatcaatacccttgtgatttcctatacctgtctttactttaatctcttaatcctgtcatctcctaaactgaggaggatgtatgttgcctcaggaccctgtgataattgtgttaactgcacaaattgtagagcatgtgtgtttgaacaatatgaaatctgggcaccttgaaaaaagaacaggataacagcaattgttcaggtaataagagagataaccttaaactctgaccgccggtgagccagggggaacagagccatatttctcttctttcaaaagcaaatgggagaaatattgctgaattctttttctcagcaaggaacatccctgagaaagagaatatgcccctgagggtgggtctctgaaatggcccccttgggtgtggctgtcttctatggttgaaactgtagggatgaaataaaccccagtctcccatagcgctcccaggcttattaggaagaggaaattcctgcctaatatattttggtcagaccagttgctctcaaaccctgtctcctgataagatgttatcaaagacaatggtgcccaaaactttgttagcaattttaatttcgcccccgtcctgtggtcctgtgatttcgccctgcctccatttgccttgtgatattctattaccttgtgaagcgcgtgatctctgtgacccacacctattcgtacattccctccccttttgaaagtccctaataaaaacttgctggttttgcggcttgtggggcatcacggaacctaccaacatgtgatgtctcccccagacgcccagctttaaaatttctctcttttgaactctgtccctttatttctcaaactggctgacgcttagggaaaatagaaaagaacctatgtgactatcggggcaggttccccgatactccccaaagtattgcatggaatgccacatttcttttatcatagtgcttcaaataagtatttcagtgtgttactgaaaatatttataaacaaaatatatttgatagcagggtatgaatatgcccgtgtccttggaagagaaagaggggacaagagaacaggtataacagcatgttgttggtgaaaataaattggtagtaatatagattgaatatcccttatccaaaatgcttccgacaggaagggttttggatttcagatattttcagattttgaaatatttgcagaatacatacaggtagagcatccctaatccaaaaatccaaaatctgaaatgttccaatgagcatttcctttgagcatcatgatagcactcaaaaagctttggattttggagcatttccgatttcagaatttgggattagggatatttgacctatagtaatgccaaatactgcactaaaattagcaaatgtaatctcattgaattgtgacaacagccttaagaggaaacccgatcattatgcctacttagtagatgaggaaacagaggtaactaggtcaaggtcacacaacttggagtgtcagagtctggattctttctagttctgccctcgtccaagccagttctgttaacactattcttcctttcagcataatctgtgtcatcactggagcttatgtctacctgcctgccacccagcaccaactgtttaccctttaagtctcattctgcctcctccaggagccttccctgacccctgccttcaccttctgacctgtgccccttcacaccctgtgccctcttaactgggaaagccctgagggcaggggccataccttatttacctctatctccagctcactgcacagaggcattcagcagatgaccagtaaatatgggctgtctagtaaaaactttgcagttagagataatgaaagaaacataattacttctgtgtgggttgagaaagaagggaagggaaagtccagatacttaagcagaaaaaggcaaacagtccaaaaggggaaaagtaacttgcccaaatcatgcagttgagggcaggaagaaagggggacaaagccaaaaccaaaacccagtcccttgtcccagcccagtgctttgtctgctacgttacacaaactgtgattgtgaaattaaagggtttttgatggcactgatataagtaaataaatggctttatgagttaacacatgacaagcaataaactcataaaaggtaaatattgacaactgaagattatatatcactatgtttagtgtgtggagaacccaactaggaattaggaaagcttgcacattcagtctggtttcttggcaaatcaatgagacttcaaacaaatcattttatttctctgtgcttctgtttcttttggctgtagtattttgctggttaaagagcacgtgatcaatgtctatgcttttaaatgtctgtctttatttgagcatgctcagctggatgtggaaaacctatggttctcttgggtttcataaggatcaaatcccacagtgatatgtaaacttgtgtggtttatagaattataggacctcaaagctgggagaggcctgataaatcatatagtgaaaatttccagccagtgcctggatttcttttacagaatctttcttttattggacaggtgctcccttcacaatccatgatgtaaggagaaaaggggcttcgtttgaaggaagttagtgtattgtgtatgggcgtgtactttctgcttggggtgtgcctacagggctatctcactttctgaaagcgtaataataagttactttaccatgcattaattaaatgtcagagaccatgctaaatgctttacagagaatatcttttttaatctgtataagaacctcctgaggcagataatattattaaccttacttttcagataaggaaactaacattcagaaaagttaagtaacttgctaaagacatgtgtctactaggaggtagagtctcaagtctatttcaagctcctaataagtaaataaatgtctattgaatccaactaatgacatcccactccatattcccctgccactgatgagagagagaagtataaagtttatgtaaataagacagaagcaatgttttatataagcattgtggatttaattccactaagggattgatttttcatcttaatggaactttttcttcagctatcaagtttcagtttcaagatcgcaaatgctaagaagatattaaaatattttaatacataattccactagatcatatttataggtactgttaatatattaccaaatctactataaacaaaacaataaaacaaaaggctggatcaatatggaaagtagagtaataatttaggccctaaagaaaaactacgtaagacatttcttagaggattaccaggtttctctctctctctctttttaaacacagcctaaaatagaaaagcaatttatgtattaataaaaaaaatagaaacctgaggcagatgtaaccagaataggtgaattaactgaagactgatattcttatttatgtttgtgtattttaaataaagaaggagtttgaccatctcatctagttaatcattaaaaggaaactcgagccaaacttgtgaagcaggtaaagtttatttttagacattcaactggcttctcttttgggctccccttttcttttggggtcatcctccatgtctggtaaccttaacctccctgtctcttccagaaggagcaacacccccatgttttagacctttacttctgatgtcaggaccctttctgatgcaagtgttagctaactccagctggctgaagaggaaggaggaggaagagaaggagggggaataatgtattgaagtgtgtaatagtcaagtctaggagcagccctcaccttaggatctagacattcatattatataattgggaatctatttccagatctctttgctttttttttttgcaaacctcaatccaatggagtctctaagtggtagaccacagctgctccaagcttgcatcgtatcagcttagctattcctgttgagaaacaagacaagtttccaagtagtcccagaaagccaagaattaaggtgtatctgtccctgtcatgtgcctatctctgatattaccagacctggcccatgcagagttacagatgggttaataccaccataagcgcatggaccaaagttagggaaaggatagttttccaaaggaaatgttaggtcctagtatcatatgtggagaggggatacttggcaagtaaaacagtacctatctaccatgtggccacaacagggcagatcagggtccctggtaggatggaggcagccatcaagcattatggtatccctgaataatcccttcccagttcatatgtaaaccaatcctcttaaattgttaatgcatttaacataaggatggattcagcaaaactgtatcaatagcaaaacatgaggggtctccagctagtagcctgtcctgcatagccatccatgactactgctctaattgattttttctagaatgtctaaaggaagatgaaagtagaaaatgagctgtagtggacaagcatttttaaaatgagcccaataatgtagcacttttgggtgcttgataattgttgcaaatcacatttgcctgagaaatttcaattctataataattgtacaatagcagaaagatctagatacaaaaatattcattgcagcatggcttgcaatagtgaaaaattgaaaacaatttacatatacttcaataaggaaaggttaaaacaatggtatactatgctactattacctgaaaatattgaaaagatgaaaagatgtccaataacatttgatgaataaaggttgaaaaatacatgtagtaaaatctcatttttgtttttaaaaaacatatatgcatgcatgcatccatgtatagacaaaaaggatttgaaaatatacaataaattatagttaatcacatttaccttatggtactgcagaacatcagaactcattcctcttatctagctgtaattttgtaatcgttaactaatctctccccatcctccccttccccctgcccttcccagcctctgatagtcacaattctactttctatttcacataataaaagtttttaaagaggggaataatggggtgggggatctggaatatacataaaaactcaaaaataattacaaatttgttgccatcaaaatataaaaagaaaaaaatagttacatctgcaaaatgggattgtgtgaggaagtttttacctttatacatttctaccttctgtatgtttggatttttacaataagtatgtgttattttctagcatcttttgaagtttttttcttaaaggcataagtaatatctaaagttatttttcatccttctaatgccgtctacacaaagataacgatttttcttggatggccccaatctctcttctgtaagatctttccccatttgtcatatccataactcataacctcctcacccttcactgctctccattttctctataaagtgagcccagtcagtacttgtaggcttgttaagcattacttctaataagaaagactaacttgtaaagcaaatgtggaaatgtactaatatagcatcaagcacaaaatagccattcaataaccgaactatttaattccttttttttcacacttcatcctttccctaattccagaaagaacttgaactgggtcataacaaagacaaatttagacagacagataaagatatctcataggtagaaataaaactgagtgattataaactaatcacaggaggctctgttagtctgatgaacagaaacacacgtgataaaatcacagagaggtaaaatagaaaatgaaaatcaggatcaagaaaagggaaataaaaatatgctggacatcattcaataactatttgctgatggtaattatagggatggaaaacccatcaggcctatggagctaaaattaatcagcaagtattcacagagtgcctactgcttctattactggttctggcttcctgcctgcccagtgcagaggcttgagacatttgcgtgacattcagcttgtcaagacagaaggagcaaaataagcagacagaggctcactgcagccgcctatacccatcatattgttggaatcatattcaagtgagacaaactccttcagtggaagacgataaaactagcttaaaagttgtaaacatcacttcatcacccaaaaaaggcccaattaagtggagatactatttctgcaaagcaatcatcaattcatttgtgtaacatttgaaatttcaaagtacaaacccacattctattaaaggcaggaagtgaaaccaataaaacttgtaacaactatacttaattttcagggttctttccattgctgacaaacattttaagtcatgtctattctcttaaaatgtaaaatatgatgtttatgtcactgttaatattttgataaaaagctattgtcatggacatctgggtttttttctgcatgcccagaaatcccttttctcctatttaaatttaaaatctccaattatttggagaagcacctcctcttctctctctttcatttgtaccccattcttaggtgtcagtggtgggcacttgagctaggctttgcccatcatagtacacattcctgacatcccttggtcatagttattggtccagggataagcatttgaaccaactagaccagtgaaacccctcccaggaacaactactaaaattatgggaaaagaactctttccactgaagttactaacctggcaggatgtgttaaatccaggtgccacaggccaccaggtggagaggtggagataatctttccagaaaacaaaacaaaacaaaacaggaaaatgaagctaagggataaaatttaagccctttggacttcatttgagcccctgaatccagtcatgcctcctgaaattaaacttcccctggacttttcagtgaatcaaaaaactctgtttttaacagtggggtttcttataaatgcaccaaaaaatgacctaatgaatgttgtctacaagcttccattagaagtattatcttcaagagaaaaaaaaaacaaataacttgaagaaaacccttcataattcaagtcagtcctgctaacctctaggaaaccctccgtgaccaccatctccatatccacacccattttcctaaccttaaacaccagatgacttcttgaagcttatgaagtgccctatgcatctaacacatttctgtaagtctgcattgttctataatgacttgtaaccgtatctgtctccatttcctccagagaagagattgttatcattttgatatccctgcagccttatactggggcctaacatataatagttgctattttgttgaaggaattgtattttgttgaaggaattctcttttgttgaaggaatgaatggagagaatattaattaagaaagtctcttctattaataaacattccctgattgattgaaaccatgcctaaaatagctaatcatcagaagaccaaagtaaacaacatatccaaactgaatcctcaaagtgttagtcattggtagctgtatagctgagaatctttccttcttctggtcattagggttgaaagggtgggtgaatgtggagacatgattctttcttttgcaaaacatttactattttttaaactccataaaatgtaataacttctcttgaaaaatgttaaaacccaaacaaaaaaacctgtaatgtggaatatagattgtaggttataatggaggaagcagggaaagtggggaaaactgtggttgccagaagttttctgataactaataggcaagacaatagggtggcttttggtagggtccttctttatggcatagcaaagaaaaataggaatgaagaagtgagaagcatgaaaggggacagcaatatatgtgtaacacagggtgattcagtgtgagagttttataattaaaattgccaaatgtgagaaaaaaaaatctactataaattgggataggctcaaggcatggagatgaacaaataacccctccatgtgggcaaaaatcaatgaaattactagatgagtagcttagtatgtgagttccagttgcaacatgttactggtatttggggcttcccctcccccctccccccctgcactttgaggcaattcgacatttgactaacaatccagcctaactttctccatctgatataaagatatttaccttgaaatcctagaactgccaacatctcctacttcctactacaaccctccctgactccttttctctggcacagctttctatgcactcaccccattcaactaagcctgcttactcttcaccagaaggtcttctcttagcataaaaagttcctggaagtccatctctttcatagagctgctggatgactgctttgcttacctttggccttcaaaatacctctcctgtccaaccatagctccccagctcccctgccattgcaaccaatacaaacttcgtcatctttccttgggccaatgtgcctgtctcctcactgctctccctgctttctcccttagcccctacaactcatactccacatcgcaagcagaacgagcttttcaaatagtaaattagattatgtccattagtgtgttagtaaatgtttaacagctcctgaggggaacagagtatctatgtgttttataatttttacatatatgtatcacataatttacaaaaagcaagaaaaaatataacactcttaatagtaaattctatatggccatgtgattttcacagaaccatttcagtgatttttgcagaatatttgtgtccatagccaacctacagctaaaattcaaacacgtttggcaaaatcagaccacaaataaatatctgattaatatccaatcagcaaagaagtcattcatggtactgaagtcccaacatgaatgttggttgatatttttacattaatgagcgagataaaagtgaagcaacaaaaatggatgttggaactaaactcgttcattaatgacagaagtgacttcttttgctgataatagctttcaagtactagaaaaatatttcctcaagtttttgtgttcacaaactaaggcacttttaagttcaatcttcattattaaaatttcttctactctgtcagtctagacaatcaacaaaacaaatcaagctctggtttgtcatgtttcccaatttctatagtataggtactccaccatggttgatttcaaactaccaaaataacatttctgaatgcagcgttaggaagggatacgctgcatcataccatcgtatggtatgttcttatacagaacagacagaaataactttaagaacatagataatagtaaaatggagtaaaataattaggcagtaaagtcttcagcatttatttttgttgttaaaatatttgattgtgagtttataaataatttggtttttaataatgactgtgattaacaaccaacttacaaaatctctgaaaatttaacagtcagtgcttgcaagctggtacaattgtttccggtgcactactgaattatcactcccctgcctaaaattccagactgcccattgcactgattccctgggaaataagtgaaaagagacaatgataattttcatttttgttgtggtgaagtgatagtgcaaaaattccataagctcctctaagttttccaaataaagcttagtgtttaaaaacgtttgaacacatgatcccatgtaaggcctacattacttcctgtgtgataggtggggtagatatcattatccttcctttacagattgaaaaacaaggctgagaaaaatcaaatgcctaccccaggctcattcaagtaagtaaatggcagaatagggtctaaaaaccaggtcttgtattgaaaattcaacaagaggatagagaaaatttaattgacaaatactgatctcaaaacaatttttttttcaatggtgacaaatgtcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgagggggaagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccgccgcgggagcctacaaacttttattagcctcggggagtgggggtggggggctggcaagggccgggcgacggtgacgaaagggcagcgcgcgggtgacagcgctggcctcttcctctccctccgcaggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtgagcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattcggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaaaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacaacattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatattgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgttcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgaagtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttaagactgacaggtgtatatgaatacagagagtatacataaagaagatgtattttcaattgacagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattataatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacatggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggcagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagtaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttccgttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagtcaaataattaaggatttgttaaatatttgtcttaatatcaagcttttgcatatcggggccctcttttataagctttataagcaatcttttgttttctctgcttgctcaaagtagctatgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtagtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctatttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtctgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatatagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatcatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaaggatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtgtgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccatttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctatttgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtctttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaatatcttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcatatacacagccctactcatgcatgtggccctctagatttccaggagtatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaggagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcaattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgtttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataagcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgataaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagagtattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacaccaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacgagctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggccgaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacgtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatattaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctcactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactaattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaactaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtatgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatactgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcctactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacaggctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagatatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacataggtaaacatgtggccatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacgattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctcgtgatagtgtgggagatcgcaaaacatctgatggtttaaatatggcagtttcccctgtgctttctctctctcctgccaccatgtaagactttccttgcttcctctttgccttctgccatgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcctagagacttgttttgaatacttttgaccaaaatgctgatagtgacgtggacaatgaagtccaggctgaaatggtcccagagatgaggaacttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttcctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcgcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaattctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgattaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactacaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacaacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctattctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcatggcacaccatagagggcatagggccacaggaacaagaggaaggtcacctaattctgtcttggaagtcaaggaagaagtaacattgaattttaaatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatctacgtttgaccaggctatttaaacttaactgcagagtgtcagcatgttaaacattgatttacataaaatgatagctgcccactttcttgtaaatgttataaaaactgtagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctaggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgacagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtacatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttgtttaaatacccacagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggactatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccgccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtattcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaaacacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacggggttttgccatattggccaggctggtcttgaactcctgacctcaagtgatccacccactttggcctcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatgggaagacatggaaaaagaaagctaactacagtgattttgtccactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagccaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactaaaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgcccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcttttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttatggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaatactgtttttaaaaagtatgattaatccattaaattagaataatgcacccttcatatattatggtactacagtgattcatgaaataattctatataattctacatacaatcaaagaaatataaaatgtgttttgtacggaagtgcttatttttcatctggggaattccagtgagattggtatattctaggccagataattttttcaaaatagaggacaacaaacatgagatgttcccactgaccaatttggaagcctgatcattaccatatcttctcttgcaggtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctgattttcatcccaacaatcttggcgctcaaaaaatagaactcaatgagaaaaagaagattatgtgcacttcgttgtcaataataagtcaactgatgctcatcgacaactataggaggcttttcattaaatgggaaaagaagctgtgcccttttaggatacgtgggggaaaagaaagtcatcttaattatgtttaattgtggatttaagtgctatatggtggtgctgtttgaaagcagatttatttcctatgtatgtgttatctggccatcccaacccaaactgttgaagtttgtagtaacttcagtgagagttggttactcacaacaaatcctgaaaagtatttttagtgtttgtaggtattctgtgggatactatacaagcagaactgaggcacttaggacataacacttttggggtatatatatccaaatgcctaaaactatgggaggaaaccttggccaccccaaaaggaaaactaacatgatttgtgtctatgaagtgctggataattagcatgggatgagctctgggcatgccatgaaggaaagccacgctcccttcagaattcagaggcagggagcaattccagtttcacctaagtctcataattttagttcccttttaaaaaccctgaaaactacatcaccatggaatgaaaaatattgttatacaatacattgatctgtcaaacttccagaaccatggtagccttcagtgagatttccatcttggctggtcactccctgactgtagctgtaggtgaatgtgtttttgtgtgtgtgtgtctggttttagtgtcagaagggaaataaaagtgtaaggaggacactttaaaccctttgggtggagtttcgtaatttcccagactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtttaaaaataaaagttgtagttttttattcatgctgaataataatctgtagttaaaaaaaaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggagaaacatcataataaaaaaatctgctttttcatta

SEQ ID NO: 472 - DNA, 27723 bp, Homo sapiens
aggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggagggtgagtgtgggccgggggcggtgcatgagatgatggggcgagctgaggtccacccgggcgacgctctggacctgcgcgaaggccggcggtgcgcgactcgccccttcttggcgtctccccgggcgcgtctccccgacttctctccccgcgcaccgcccgctggtggcccgcgaaagggggccggtgggctgagggccggtggacgggagcccgggggtggttgggccgcgttcaggccgccctcagcccgtggctggtagccaggagggacagtgcggtaagcgctgctgaggcataccctctggtgataagcaatttattattaataacattatatcaaataccgacattgttgtggccgtattaggagccaggaactgtgcatcgtgctttatttacatcattatcccatttaatgctcccacaaaccctgtcagatcggttccgtttagtgtctccatttcacagatgaagatgctcaggccccgcctaagtttgcgcttctgatacgtggcagaagcctgtctctctgacgccaaagcccagtctggagtccacgctgctggaccactgtcttaaggaggccagtcttgctcagctccctgcatgaaaaacagacgagaaacacgggagactcccggtaacccccaacttgccggtagggaaggcagccactctagaggcatggcgagggtggagagtggaggccttactttcatgctccttcaccccactcctcatagtcctgttaaagtccagaccctcggtctcgcttgtcatttagaccttaacaggaataggcaggtctttcttttccctggggtgtcctggatggaggcaggacagcagagagttgtggagaagggtgagtcatagtaacacaattaccatgaatgaaagcgctcactgtgtaccagatgctgtgctcagtgctttacgagcatcatcttttggaatctttactgttttgtttttgtttttttaagggatgagggcttgctctgttgcccaggcgggagtgcagtggcccatcatggctccctgcagccttgaactcctgggcttaagtgatcctcccacctgtttcccaaagtgctgggattacagatgtgagccactgctcccggtttatgtaatttttatttttatttttttttgagatggagtctcgctctgttgcccaggctggagtgcagtggcgcgatcttggctcactgcaacctctgactcccgggttcaagcgattctcgtgcctcagcctcctgagtagctgggattacaggtgcctgccaccacactgggctaatttttgtatttttagtagagatgatggtccaccatgttggccacgctggtctggaactcctgacctcaggtgatccacccacctcggcctcccagagtgctgggattacaggcttgagccaccgtgcctggccttagtaatttttaaatgcatatgcagtagatgttatcatgctcattttatagaagtaacttaagactcagagccaataagtcctttgacaaggtcatacagccagaagttgaggagccttgattcaagcccatgtctgcctgacttcagagcccaacctctgcattttcactatacttaactgctagcctcacagaggggatggcatgggttggatatcttctgtttcagcccctccaccgtgctctgtgccctgtgtggctgtcctgtgtggaataaataccagctgtcctaccgtcttgcttccattgtgttggaatgaggggagagtgaggtcagggtattgattctctccgctccctccctgagaagttattgaaggctggctttgcccccggtggaaagcattgaattctagaaagctgccctctgtgttacccttgatgtttcaaggttctgtgactacttctctctccagactcttaaggtctatgagtggtaactggctcctcctctactgttactggccttggaattccttaccattgcttttcatttctctgcacccagcctacacattagtggtcccttcattaaactctcctcaacttgcccaagttaaatgtgctgtttcctggcagaaccctggctgattcagggttcagcttgggtctttggtcatcatggccaggccatgaatggggtgaagacagaagaaacttcaccagctgatttcttctcagagtagctgaaaatctgaggtgttttttttttttttttttctgcagaggatgccactggcagattatgctggcctcaggtgctgaggccctgagagactaagcaacctggaggtagcaatgctatccaggtgtctaggaatggaagcaaactcctggcttcaatacccctatgccactcttccctaggcagtcagctagcaaattcttactgagcactcatcatatgctaaacactgtgctgagcactggggatccagtggtgagttagagcagcaggcctttggggaaggcagccactaaataactacaaattactaagaaaattgcaagactgagaaatgcatcaaggagagtcccagggcgtttttgggaactgtaatgggagacctcccaccctggtctgagggtcagggaatgtgtccttacagaggtgacatttagggtgagatctgaatgaggaggatgaaggatttggcaggaggaagcttcccagcagagaaacagccctcaggaaggctctaaggcaggtggggataggaggagtgtaaatgatcagggactagagggatctgatggccacaggtgagagtgcagacagaggccacattggggcctggtagctctgctacagaatgcagatgcattcacagggtaggggaagccactgaaagagttttagcaggggagtgacatgatcagatatgccttttatctttcagtttcacttgtattgctgtgaaggtcagggtctggaggggggatagcaggctgaccagggagaccagtttaggtggctacagtagttgcccagacaagaattggctgtggcctttgctgagaagtgttagttgggatggggaaagtagatggattgtgaatgtgtttagcaggtgaaatttttttttttctttttgagaaggagtcttgctcttgtcacccaggctggagtgcagtggcaccatcttggctcactgcaacctccacctcctgggttcaaatgattctcctgcctcagcctcccgagtagctgggattacaggcatgcgccaccatgcctggctaatttttttttttttttttgagatggagttttgctcttgttgctcaggctggagcaatggtgcgatcttggctcattgcaacctctgcctcccgggttcaagcgattctcttgtctcagcttcctgagtagctgggattacaggcacccgtcactacaccccggctaatttttggtatttttagtagagatggggtttcgccatgttggccaggctggtctcgaactcctgacctcaggtgatctgcccgccttgacctcccaaagtgctgggattacaggcgtgagccactgcgcctggcctaatttttgtattttttagtagagatggggtttcaccatgttggccaggctggtcttgaattcctgacctcaagtaatctgcctgccttggcctcccaaagtgttaggattacaggtatgaaccagcaagcccagtgtgcaggttaattaatagaacttagttattgtgcctttccatctctttgaattgtaaacaccactcatcataatcatcatcatcaccacagccatttatggagtgtttaacctgtggcagggaccatacacatcttttctcatttaatcttcacagtagcctcataattttctacattttggtggtattgtctccatttgctaaatgagcacacagtattgcctatggaaagtatggattgctgtccctccaacccttgactgtttttggtccctcctcatttgcctttcctgccagaagccattgtgaaaacacctgcagctggtaaagagccttctgagaaaagctggaagggtgtgaaggtgctgacctaggctagggctccctggcagaattggcatggtgccctcacacttgtccttcagacaacttctttgctgccagtgatgcaataattatcactttatgtatagctcaaactgcagtctcttaaaaggcacattaccagtcgggtgcagtggctcacgcctgtaatcccagcacactgggaggccgaggtggctggatcatttgaggccagaagtttgagaccagcctggccaacatggtgaaaccccatctctactaaaaataaaaaaagtagccaggtgtggtggtgcgcatctgtaatcccagctatttgggaggctaaggcaggagaattgcttgaacccaggagatggaggctgcagtgagctgagatcgtgccactgcactccagcccggacaacagagcaagactctgtctcaaagaaaataaaaaataaaagcacattaccaagggagggttcaatgactgtcacatagtatgacatttttattttcgtgtggaataattcagtgtttcttttcttcctaattcctaaatgaaaacgttggtacctgaaggcataagatttttttgttcctaatctgtactgtgtacttaaatatttttacaatgtgcagggggatggaggggacaacactcttgaacttaaaataccagctccatgcaccacttacattcccttttgattttgtgcaggggctatctgagggtcatcagagagaaccagattaaaatttgtgccctgatttttttatcctgaggttcttcgttttggcattcttcatttacttgtggaatctagaatgttgattaggtagcaagagcaaatctctgaagaactgtggtgtttgggagttgggttggaccccaaacctggcatcctttcttttccagactcttagcctctctggcttcatttcctgctttgtcttgtggctgacacagaaaacatgtgtgtttgttttttcttctgatcatacaggcaatacacactcattaaccaaaggctatagaaataaaaggctatagaaataccgccaatgtgatcccgcccctccaccaatttggcaaagctcccttcccaggcacccagccgcttctctggattgtagtcacagaagtgcttgaccttctgctaaagactcactttgctgcccaagccttaaactctgtcctatgtaacctccattgccacctctcccttcttacctgcctttttttttttttttttggatacagagccttgctctgtcacccaggctggagtgcagtggcgtgattctcggctcactgcagcctctgcctcccaggttcaagtgattctcctgcctcagcctcccaagtagctgggattaccggtgcatgccgccacatctggctaatttttgtatttttagtacagacgggatttcaacatgttggccaagctggtctcgaactcctgacctcaagggatccgccctccttggcctcccaaagtactgggattacaggtgtgagccacgcgcccagccccttcttacctgctttctcatcagctttgtgtatcctcagattgctcctatgttccaaatagcaaaatagaaacctcccttagtcttccttgcctgtagcgaatctaccctaccttcctcgccccctttatagctagatttttggaaagaattgtgtatatttatccatgtagttaccattttggtttctctatttctttatgtggatccatatttccatctgttaacatttttcttctgcctgaaggagttccttgaagatttttgtcatgtgggttcgctggtaatgaattcttttatcttttgtatgtctgaagaagtgaagaagtatttatttcacttattattttttttttttttgagatggagtctcgctctgtagcccaggctggagtgcagtggcactatctcaggtcactgcaacctccacctcctgggttcaagcgattctcttgcctcggcctcccgagcagctgggattacgggcgcccgctaccatgccaggctaatttttttttttgtatttttagtagatacagggtttcaccatgttggctaggctgttctggaactcctgacctcaagtcatccacctgcctcggtctccctaagtgctgggagtacaggcgtgagccaccatgcccagccaaaatcatttttttctttttttttgagatggagtcgcactcttgcttgctttgtttccagtgagaaacctgttgttatcctttgttcctctctacatgatgttttgttttttttcctctggctgctttaaagatttttttctttgtcactggttttgagcaatttgattgtgatgtgctttgttgtagttcattgagtttgggttttgttgagcttcttagatctatggatttatagttttcaccaagtttggaaagtttttggctataatttcttcaaatatttttctgttcctccactctcttctcttgccagtactccagttactgtacattagaccacttgaaattgtcctacggcccactgatgctcttaatttctttccattctttttttttttcctgtgtgtttcattttggataggttctttttatttatttatttatttatttatttatttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcgtctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcccccctttctattccacaaaactgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggcggggggctgacgctcccatctccctcccggacggggcggctggccaggcagaggggctcctcacttcccagtaggggcggccgggcagaggcgcccctgacctcccggacggggcggctggccaggtggggggctgacccccccacctccctcccggacggggtggctgccgggtggagacgctcctcacttcccagacggggtggctgccgggcggaggggctcctcacttctcagacggggtggctgctgggcggaggggctcctcacttctcagacagggcggttgccaggcagagggtctcctcacttctcagacggggtggccgggcagagacgctcctcacttctcagacggggtggccgggcagagacgctcctcacatcccggacggggcgacagggcagaggcgctccccacatctcagacgatgggtggccgggcagagacgctcctcacttcctagatgggatggcggccgggaagaggcgctcctcatttcctagatgggatggcggccgggcagagatgctcctcactttccagactgggcagccaggcagaggggctcctcacatcccagacaatgggcggccaggcagagacgctcctcacttcccagacagggtggcggccgggcagaggctgcaatctcggcactttgggaggccaaggcaggctgctgggaggtggatgttgtagcgagccgagatcacgccactgcactccagcctgggcaccattgagcactgagtgaaggagactcctgcaatcccggcacctcgggaggccgaggctggcggatcactcgcggttaggagctggagaccagcccggccaacacagcgaaaccccgtctccacccaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagaccgtggaaagaggagggagagggggagggggagagggagagggagagctggacaggttctattgctatcttcaagttgactattttcttccgtattgtctactttaccattattcttatagagtgcaattttcatctcagacattgtagttattataatttacgtctttaaaagtacgatttgggctgggcacggtggctcatgcctgtaatcccagaatttgggaggctgaggcgggcagattacttgaggccaggagtttgagaccagcctggccaacatggcaaaaccccatctctagcaaaaatacaaaataattaggctgggcatggtggctcacgcctgtaatcccagcactttgggaggccaaggtgggtggatcacgaggtcaggagttccagaccagcctggccaacatgatgaaaccccgtctctactaaaaatacaaaaattagctgggcatggtggcacatgcctgtaatcccagctattcaggaggctgaggcaggagaattccttgaaccggaacccaggaggaggtagcagtgagtgagatcgtgccactgcactccagcctgtgctacagagcaagactctgtctcaaaaaaaaccaaaaaaacaaagacaaaataattagctgggtgcagtggctcatgcctgtaatcctagctgcttgggaggctgaggtggtagaatcgcttgaacccgggaggtggttgtgccactgtactccagcctgggtgacagagcgagaccctgtctcaaaaaaaaaaaaaaaaaaaaaaaagaaaagaaaaaggctaggcctggtggctcgctggctcacacctgtaatcccagcactttgggaggctgaggcaggcagatcacttggggccaggagtttgagaccagcctgaccaatatggcgaaaccccatctctactaaaaaaatacaaaaattagctgggtgtggtggtgggtgcctgtaatcccagctactcaggaagctgaggcaggagaattgcttgaacctgggaggtggaggttgcagtgagccgagatggtgccactgcactcagcctgggcaataaagggagactccatctcaaaaaaaaaaaaaaaggaaagaaagccaggcgcggtggctcatgcctgcaatcccagcattttgggatgccgaggcgggaggatcacccgaggtcaggagttcgagaccagcctggccaacatggcgaaacctcatctctactaaaaaatacaaaaattagtcaggtgtggtggcaggcacctataatcccagctacttgggaggctgaggcaggagaattgcttgaacccgggaggtggaggctgcagtgagctgagattgtgccactgcactccaacctggacgatagagcaagactcagtttcaaaaaaaaaaaaaaaaagggtacaatttgatctttttttttttcccgagacagagttttgctcttgttgcccaggctggagtgcaatggcactatctcggctcaccacaacctctgcctcctaagttcaagcgattctcctgcctcagcctcccaaaaagctgggattacaagcatgcgccaccacgccaggctaattttgtatttttagtagagatggggtttctccatgttggtcaggctggtctcgaactcccgacctcaggtgatctacccgcctcagcctcccaaagtgctgagattacaggtgtgagccaccgagcccggccaatttgattgtttttatttttatttagttatttttttgagacagggtctcactctttcgcccaggctggagtgcaatggcttgatcttggctcactgcaacctctgcctcccaggtcgatttgatatttttaatatcttatatcttgatatctactttactttttgaatgcaatacagttacaattattgttttaatatccttgtctgctaattgtgacatgggtgcaagttctgggtcagtgtggcttgattgattattctcattatgtgtcctattttcctgcttccttatatgtctgataattttttactggatgccagacatgaattttactttgttgaatgctggatattttagattccctatacatattctttttttttttttttctgagacggatttctctcttgttgcccaggctggagtgcagtggcatgatctcggctcattgcaacctccacctcctgggttcaagtgattctcctgcctcagcctaccgagtagctaaaattacaggtgcccgccaccatgcatggctaatttttatattttaatagagacagggtttcaccatgttggtcaggctggtctcaaacttctgacctcaggtgatccacccacctcggccttccaaattgctgggattacaggcgtgagccactgcacctggccccgtatatatattcttgagctttgttctggggtacagtgaagttacttgagaacagcttgattctttcaggttttgcttttaagcaagcaagctgttattttctttagggttaatagtgtcccactactgacgcaggtccttttgtatactctactcaataccctgtgaattatgaagtttttcagtctagctggtaagaagaggtaccattccctgctctgtgtgaatgttgggtactgttccttcccatcctttctggtagttctttctctggcactgggtagtttactcacatgcatgtgatgacccgtaccctgctgtatacttgggggggcctctgcagatctctggagtcccctctctagatagctcctctcatctgcagtattctgtcttgcaaactatggcttcttggtctccttggactcttagctccatctcctcaactgggagagtctgctgggctctgcctggatttcccctccctgagccacagtgggaacgccatcaaggcagtaagttggagcagttgtagggttctcttcatttgtcgcctgtttctcggatgtcactatcctctgttgcctcataactgatttcctgaaactgttgttttatatatattatctatttggttgtttcagtaggtaaggtaaatctggttcttgttactccatcttggccagaagcagaattcccagataatgtttttgaatctctgaatgaatccacagagctctatgccctagtgtgaggtagatcagtagggtaactgtagttcataatagcctattgtatattttaaaatagctagaagagaagaatttgaatgattctagcatgaagaaaagacaaatatttaaggtgatggatatcccaaatacattgatctgatctttacaaattgcatgaatatattgattatcacatgtgctttgtgattatcacatgtacatctgttatgcatcagcaacaacaaaaagctctacagggatattctttgaaatcttatacaaatgtgcatacctgaggaagcccccagaccttcccaactttgaagtcagttggtcactgacactccagtgacatgctgttggcacgcagaactcatcacccagcgggtggtttcttaaccacatggtgagctttcgtgagggctgctggcctcactggtttctgctggttggtgcctggcacaaagtctggcagctggtgttgagttgatgagttggagggcaggaggcattgctatggaggtgagtggagttgggtaaatagatgtacgagactacctgggactcttcccttatctgagcattatgctcaagacccaccttctagctccaaagtgggggaaagttctcttcttcctcctgctgctgcctctgcactgccgagcccatctcccagcactcccaagggcagcagcccaagggtggcaggcaggagagcagagtccagctgtcagaggccacctcaggaaggagctgctgtgtggcttgaacagtgttcttcaggcagtgtggctcagcatccccgaggtatcatggcagggagcctacggctcgttctggagtagcagccagaaaactttgctcgcagacttggctttgctgcttactatctgtgtaccatcggacactgtgctgagcctctctgtgccttgcctcgttacctgttcagtggtcttggtaacccttgtcttgcccatctcacaggactgttataatgtgtgcaaagatgctttgttctagtagaatcttgcataaaaccatgatccttttcttggatattatcaaacaaatgaaactcttatcaaaaaatgaaagtgtttatattctattttcctaatgagatatctgaactggaatgtttttggttataatccacatggcaagcagcaagtttagggcagagctgtgtgtttgtctattatttgacattcattattttgtttgcttgtttgtttgtttgttttttgagacggagtcttgctctgtcgcccagactggagtgcagtggcgcagtcttggctcactgcaacctccgcctcctaggttccagcaatcctcttgcctcagcctccctagtagctgggattacaggtgcctgccaccatgcccggctaatttttatatttttaatagagacagggtttcaccatgttggccaggctagtcttgaactcctgacctcaagtgatccacctgacttggggcctcccaaggtgctagaattacaggtgtgaaccaccatgcccggccttctttgacattcattaatttattaatagtacctgcttgtgaccttcttcctaacctgggaaatggtgagtagctctctgatagtttaatgaaaggagacctttttgtctccagaggggaaaatttcgtgttagaggggaactgtaattctttggggttcatttgttttgaagtcaaatatgactctgaatgtgctggcatgttttagttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggtaaggaaaaattatttagtgcttttctccttttcagtacatttattttatgattaataccctatcaactttgaaatggaaaatcatgatcttgatcatattgtaagcgagatagcatttaatggctgcttcagtgaaaatcaactttgccctctgtgatgtttatagggagacgaggaaatataactagtgttgattatgcttttcagatggcctaaacctagttatccttgggccagtctcaccaccaaacctcacgatagaaatcccagtggacagatagttgcttggcaccaaaatcatagcatttttccttttgagacagagttttgctcttgtcacctaggctggagtgcaatggcatgatatcggctcactgcaacctccgcctcctgagttcaaatgattttcctgcctcagtctcccatgtagctgggattacaggcatgcactaccatgcctggctaattttgtatttttagtagaaatgggtttcaccatgttggccaggctggtctcaaactcctgacttcaggtaatccacccgtctcggcctcccaaagtgctgggattacaggtgtgagccaccgtgcccggccatttttcttcttccaaatgaagtatttatttattacagaggcaatttaaacatatctggattactaaaattataatttaccattatttagactagtaatgcccctggaaaatatgttatattgatgaaattttctctttcatcaatgactgacaatttctgtggggtggttcagaaaacagaagggtaggatgcattcacactgcttatgtaagagaggtaaatcctgactctaagagctgtgactgttgtcagtgagggcacagcacctgtagtgcacatagctcctccaagggcagtgctcggcgctggctttgcatccactcctgagtgcctgtagatgctgtggtctgtgggactcccacaggtgtcactcacatgactgggagagagcagtttaaacagtctgagttatggattaaacaggtggtggcagggacggtgtaccctttttctttttttgacacagagtctcactctgtcacccaggctggagtgcaatgggatgatctgggttcactgcaacctctgcctcccgggttcaagtggttctcctgcctcagcctcccgagtagctgggattacggcacatgccaccacgcctggctaatttttgtatttttagtggaaacgaggttttaccacgttggccaggctggtctcaaattcccgacctcaactgatttgccctctttggcctcccagagtgttgggattacagatgtaagatactgtggctggctaggacagtgtactcttgaattgatctaacctttggccaaacatatcgatatgactgcttagttcagacttagctctgctgagatgatagtttggatttgagatcgtagtcctctaataattccattttagatggtttgagatgcacaattcaaaggtgggggcaattgcctggaccctgtgagtacttagtacaggcatacctcaaagatactacaggtttggttccagaccactgtgataaagcaaatatcgcagtgtagcaaatcacgtgaatattttggtttcccagtgcatacagaagttatactatattgtagtttattaagtatgcagtagcattatgtttaaaaaatgtatataccttaatttaaaaatactttattgctaaaaaatgctaacgatcatctgagccttcagtgagttgtaatctttttgctggtagagggtcttgccttgatgttgatggctgctgactgatcaggatggtagttactgagggttggggtggctctggcaatttctttgagacagagtattgctctgtcacccaggctggagtgtggtggtgagaccatggctcactgcagccttgacctcccaggctcaagtgatcctcccagctcagcctcccaagtagctgggaatacaggcatgtgccaccatacctggctaatttttttcttttttttttgtagagatgaggtctcactatgttgcataggctggtctcaaactcctgggctcaagtgatcctcctgtcttggcccctcaaagtgttgtgagtcgtgaaccaccatgcctggcccacagtttcgtttcgtttttttcttttcttttcttttcttttctcttttctcttctcttcttttctcttctcttttcttttctttcttttttttttgagatggagtctcactctgtcacccaggcgggagtgcagtggcgtgatctcagctcactgcaacctccatctaccaggttcaagctattctcccactgcagcctctcgccgaataactgggattacaggcgtgcttcacatgcccagctaatttttgtatttttagtagagacagggtttcaccatgttggtcaggctggtcttgaactcctgacctcaagtgatctgcccaccttggccttccaaagtgctgggattacaggcatgagccaccacacctggcctgtggcccacagtttcttaattcctttcacgaaagaattctctgtagcatgcaatgctgtttgatagcattttacccacagtagaacttctttcaaagttggagtcaatcctctcaaaccctgctgctgcattatcaactaagtttatggaatattctaaatcctttgtcgtcatttcaacagtgttcacagcatcttcaccaggcgtagatgccatctcaaaaacctactttctttgcttatccataaaaatcaactcctcatctcttcaagttttatcatgagattgtagcaattcagtcctatcttcagactccacttctaatcctagttttcttgctatttctaccacatccgcagttccattctccattgaggtcttgaattcctcaaagtcatccacgagggttggagtcagcttattctaaacgcctattaatgttgatattttgaccacctgccatgaatcacagatatttttaaagtcatctagaatggtaaatcctttccagaaggttttaaatttattttgcccaaatccatcagaggaattgctatctatggcaactatagccttatgaaatgtatttcttaaataataagagttaaaagttgaaatccctccttgattcatgggctgcagaatggatgctgtgttagcaggcctgaaaacaacattcatctccttgtgcatctccaccagaactcttggttgaccaggtgcattgtcaacgagtataatattttgaaaggaatctttttttctgagcagtaggtctcaacagtgggcctaaaatactcaggaaaccatgctgtaaacagatgtactgtcatccaggctttgttgttccttttctagagcacaggcaaaataaatttagcataatttttaaaggccccaggatcttcagaatgggcaatgagcaatgagcattggccctgtggttgctcatacctgtaatcccagtactttcagaggccaaggtgggtggattgcttaaacctaggagttccagaccagcctggggaacatggtgaaaccttatctctacaaaaaatacaaaaacttgccaggcatggtggtgggcaccagctacttgggaggctgaggcaggaggattgcttgagcccagaggctgaggctgccatgagccatgattgcgccactgtactccagcctgggtgacagagcaagaccttgtcaaataaataaataaataaataataagatttattgttaaataaataaataagaccgcagctacactggcctctaaaaagagtccgcctgtcctttgaagccaggcattgacatctcttgtctagctatgaaagtcctagaagccaccttattccaatagaaggctgtcttatctacatgaaaattgatttttgagtatagccaccttcatcaattctcttagctagatgttctgggtaagttgttgcagcttctttttttttttccccattgatctttgatgttactatgttgtagcttctctatcagcacttgctgcctcaccttgcacttttatgttctggagacagcttctttcttaaacctcatgagccaaccccagctaatttcagacttttcctctgcagtttcctcacctctctcagccttcgtagaattgaagagagttagggccttgctctggatttaggctttggcttaaatgttgtgactggtttgatcgtctatctatagcattaagattttctccatatgagcaataatgctgttttgctttcttatcatttgcatattcattgagtagcacttatttttatttttaagcatcagaggtcaccacactggatggagtagcacattaacttcctttaaaaacttttcctttgcatttataatgtggctgtttggtgtaagaggcctagctttcagcctgtctcctatgttggcattcggcatggcttcctcactaagtttaatcaatcatttttggctttgatttaaaatgagagatgtacaactcttcctttcacgagagatgtacaactcttcctttcacttaaacagaggccactgtagggttattaattcacctaatttcaatattgttgtgtctcagggagaggcctgaggagagggagagagatggggaatagctggtcggtggaacagtcagaacatagacatttactgataaagttcactgtcttctatgggtacagttggtggcgccccaaaacaattacaatagtaacatcaaagatacttatcatagatcaccataacagatataataataatggaagagtttgaaatattgcaagaattaccaaaatgtgacacagacacaaattgagcacatgctgttggaaaaatggtgctgaaaaacttgctggatgccgagttgccacaaactttcaatctgcaaaaaatgcaatgtcagcaaagtgcaatggagtgaaatgcagtaaaatgaggtatgcctgtatttgaaatgatgaattatgaaaaatattaaaataacttgtaatattaggaaagcgcagaggaaagtttaaaactttctgcttaattcagcaagacttaaaaaaagtgaaagtttataacttgtcatttgatcatacttttttgctggttcctggattcatatggttcaaaatccaaaaggttccgagggttccttctctcgctgctcctacccacccgttcctctccctggagcagcagtgtgtcctgtttcttgggtatcctttcagaaaaatgtacttttactgctaactttaatgcttgtttcttttaccacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcaggtatcttccattggtggggtttacgtccatcctcctggctgatggttgcagttatttggaggtcctaattagttaagttagaagcagaagagggggggcatgaactgtgtcctgggatggaaggcaaggcaagagtgaatagtgaggattatcatactcctgagggagctggtggtgtcactttatggaggccccttaaagaaagtgggctgttctctgtgtggtggatttaaaggtggcaggtggtagcacctgatggcaggggaggggccagaagacttttgagggccatagccagactgaatcagcacaattggtatcacagtaggatattcctttgtgactttaaggcgcaggttaaatccccatcccaggcagcccaattcccagcacccctgttttgtgtctactcaggatttcttcccttccttttctttttctttccttcttttccctttccctctttccttctttctttcctgcgtacttattcttgcagtcatgttctgtagtaggcactcgatcaagtcatgaattaatttagctctttaacatgacatttatctttgttttatatttctcgtgtatcattcactgggtttttgtccaggctggccttgaactcctgggctcaagcgatcgtcctgacttaacctcctgagtagcaggactacaggcatgcgccaccatgccaggctggtcattttttttttcttttttttttttttttgaggtggaatcttgctctgtcacccaggctggagtgcaatggtgtgatctaggctcactgcaacctctgcctcccaggttcaagtgattctcctgcctcagcctcctgagtagctgggattacaagcacctgccaccatgccggctaattttgtatttttaaacggggtttcaccgtttgttggccaggctggtctcgaactcctgaccttgtgatctaccagcctcggcctcccaaagtgctgggattacaggtgtgagccactttttgtcttttttaaatgtttagtaaagtaagttacagagaactttgttgagatggtatatgtttctcctaagtgctgcgattgtgcctgagttataaactgttcttctcttccaaatcagatgctccttagtaggtcagcctcaacaaggaggttgtgtgtaaataaatctagaacatctgaaaaatggtcaattggtggtaaaatgaagttgagtaaacttccattactctgtacttgaggccaggtgcagtggctcacacctgtaatcccatcactttgagaggccaaggtagaaggattgcttgagcccaagagtttgagaccagcctggacaacatggcagaactccatctctataaaaaaaaatacaaaaaattgactgaggatggtggcacatacctgtggtaccccagctacttgggaggctgaggtgggaagattgcctgaaccaggggaggtcaaggtcacagtgagccgtgatcctgtcactgcactccagcctgggctacagagtgagaccctgtctcaaaaaaaaaaaaattgtattccactgattttcattgtgggaatataactgccaatgtttacctgaaacttttatgaagaaagaaatggctcaacaaattagtaattttcatataggcttctgggttatatctaagtgactgggcccaagggagcagactgattggaaggacagatcacgtcagtgtccagctttggtggggcctccactgcccccaggcatactcagtgctctttggttctgggtctcacactgtccctcctgcctctcccgcaactccctccctaacctgctttcttctttccttccttcagctccatgttgtatcttaattatggagactaaggctcttgctgttattatatgggctgggacatgtttgcttcttatgttaatatttaagttacagcatgtgtacaaaagaaaaaaatcctggttatacactattactattttactaatgcggaaaattgaggcttagcaaggttaaataatctgcccagagttcacattggttcagtggcagaactgaggcttcaacccagagtgttttgacttgggagcttatcaccactagtctgtattatgtaaaggtgaaataagcccgcacagttatattccttctaaacaagtcatcctgccctaattgtgaacatcctggtgtgtttgttagatcatatactcccttgtgccagcttaccaaaccaattgcctactgtaagttgatcttttttgagggacagggatgggcattctgaagagttggaaattttttctgtcaaataagttgacacagtgtgctttgtccatgaattagagttttctggtctggtttgtttagacaggaacttaactagtggaataattgtgccattggtagatccatattataattgaaagcaactcagattgcagaaaaggagtgccccccagccatgacccataagcaaagaggtcagaaacaaatgaaaaagccaaaagtttcaagtatcagaaatctccgtaggtcacacgcaacttcctcatttatttctgtctattctgagatggtaattgtatgagaaagccctctattaataataaattcaggttttttgacttctttctcttgtagcctttctaccaggtttggcaccgtagctgttcctaatattttattatttcaaggagctaaaccaatggccagatttaatcatacagatcgaacactggaaacactgaaaatcttcatttttaatcagacaggtatgtggaagtaatgtgctgaggaagaagatattctattgctgggggtctgtgccttctgtgggttctgatctgctataatccttaagtgaaggattcaagactgactttgagttgtaaaacttctcttctaatgaactgttatgatcctgttaaatacttcccaatcagtatgaagtttaacatgaataggtaattttaattattatagatactttttttttcccttttttttttttttttgagtcttgctctgtcgcccaggctggggtgcagtggtgcgatcttggctcactgcaacctccacctcccgggttcacgccattctcctgcctcagcctcccgagtagctgggactacaggcgcccgccaccatacccggctaattttttgtatttttaatagagacggggtttcaccgtgttagccaggatggtctcgatctcctgacctcgtgatccacccacctcggcctcccaaagtgctgggattacaggcgtgagccaccgcacccagcctttttttccttttttttgaggcagagtctcactctgttgcccaggctggagtgcagtggcatgatctcagttcacttcagcctccgcctcctaggttcaagtgatttgcgtgcctcagcctccagagtagttgggattacaggcgtgtgcccagctaatttttgtatttttagtagagacagggtttcgccttattggccaggctggtctcgatctcctggcctcaagtgatccacccgcctcggcctcccaaagtgctgggattttacaggtgtgagccactgtgcccggtctattatagatactttattgtttgattgactgagacggagtctcgctctgtcacccagactggagtgcaatggcataatctcagttcactgcaacctctgcctcctgggttaaaacgattctcctgcctcagcctttctagtagctgggattataggtgcgcaccaccacacctggctaatttttgtattttttagtagagacagggtttcgccctgttggccaggctggtcttgcactcctaacctcaagtgatctgcctgccttggcctcccagagtgctcagattacaggtgtgagccaccgtgcctggcctattatagatactttaaaacaagtgttactgaaatataattcacataccatacactttacttataacttttaacgcacatttttcacttaatatttacacaaagatatgcataagtcatgagtgtacagggtgatgaattttcacaaagtgaacaccctgggtaaccactctgatcaagaaacagagcactggcttatgcctgtaaacccaggagtttgggaagcctgtgcgggtggatctcttgaggccaggagttcgagaccagcctggccaacatggcgaaaccctgtctctactaaaaatacaaaaactagctggggatggtggtgggtgcttgtagtcgcagctactcgggaggctgaggcatgaaaattgcttgagcccaggaggcagaggctgcagtgagctgagatcacagtactgcattccagcctggttgacagagtgagactccgtctcaaaaaaaaaagaaaaaaaaaaagagaaacagaacattaccagcctcccttcagcaccactgctcctgccttccccaaagataaagataaccacagtcttgactcctaatatcatagactgtgttacttgttttggacttcatattaatggagacatgcaggatgttttattttgtgtctgtttttttcatccaacagtatgcttgtgagatgcacctgcattgtcatgtatggttatgttttgttctttttctttgctgctactgttccatttattaatccatttgtagatgctatcttagttccttaatatttgccaaaacatatggccttattttttattgtttgtaaaacattgtaaagcattgtaaattgaaaaaattacctccattggaaaagttcattcctctaaagcctcactgtctcaattgtgagcatcccactcttcccaaagtatgctcactggaaataaataaaaattataacacacattgcatatatattaaattgcatataatcattttagctaacactaaagaaaaaagagctgagttggctgataggagtaaaagtaggatattacaaggtggttagctagtccaagtcttgtcatggatccctgattgtcatttcgattgatgtgtggagagggagccattttattcagtgctctaagaaaacctagaacacaaatctgggagtcagagcatctttggtaatccctgtttccgttggtggcttgttgttataacagttctttcagtaaattattaaaagcattttggggctgggtgcggtggctcacacctgtgatcccaacactttgggaggctgaggtgggcagatcaactgaggtctggagttcgagaccagcctggccaacatggtgaaacctcgtctctactaaaaatacaaaaaaattagccaggcatggcggtgtgtgtctgtaatcccagctacttgggagggtgaggcaagagaatcgctcgaacccaggaggcggaggttgcagtgagctgagatcgcaccactgcactccagcctgggagacagagcaggacttcatcacagaaaaaaaaaaaagcatttcgaatttagcattacttaacctgtgaaaacattctgtagacacctgagaggagttttactagttacttactgaactttggtctcaaaagacaccaaaatacaactcttataaacacattgactaagaaacttctgatgagttcacagaaattctagtgttttagttgtgaacagctgaatgggttcctgatcctttgatgcagtggggagaaaggcaacttacaaattacactgataggcaagtgaaatccatcccatatatttatatatatactagtggcaatgcttattttaggactgcatgtcattttgcataccatacataatacttgagaaaaatctgtggtgggtgctttttctgcctgatttgaaaccagtgatttttctttcaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaatcacttgaacccgggaggcagaggttgcagtgagctgagatcatgccactgcactccagcctgtgcaaccagagcgaaactccatctcaaaaacaaacaaaaagaagtattgaagtgtaaaacactgttcttgcccacaagttgattctagtctagttcaagacacatgtttagtaaagagacaacatgtaatttaaacaaactttttttttttttttagacaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttagtagagatggggttttgccatgttggccaggctggtctcaaactgctgacttcaggtgatccacccgcctcagcctcccaaagtgttgggattacaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtcca

SEQ ID NO: 473 - DNA, 7579 bp, Homo sapiens
aagtcgcagatgtgacgatgcaaaaacgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggtaagttgagagcgggctgtggcttcgaccggtgacttgtaagatcggactccaggttcctttcatcgtcgctcgctgagtcttgagcccggtgcggcttccccgggcttagcgccccgcggccgggcggagctggaccgaagtcgcctcggcttgcggcgcgtcagccgatggtctctgagccggcagtcgggggccgaggtcccgccggcctcacgttgagtactgggagccctgcaaccccgccttcgtgcagcaagcgcttgattgtggatttgcgagggtggtctttcctctctcgggtgtcggtatccttaaaactagtaaggacaatgatgccgacgctgtacacgtagcgcttgtgccctggacagtgtttcagttatttgcttatcgtcacattcaatcctgttttacgggtggaaactctgaggctcagatagattaaatagcttgcctgggctatttaagtcacagaggtaacttaatggctgagtcgggattcgatcacaggtaggctgacgtcagcgtccttgttatctgttatgctgcctctgtctacaacgtgtaaaaagaccgagccgacctaggatgataattagatgaaagctttgcataggctttttccccaggaaagggtagctagtcaaacatggaattttttgctcgaatttcaaggggcatgggaagaagtactatcttcccctaggagcaagttaattattaccggaatggagaatccgagagacttaattctgcgaacccacaaagaagatgaccggaaaggaaggacatgactgtgtcagatcagtgctagagctgcctgcccacctgtttgactcaggtgaaattctttggtacagtcttaacaaggagttgtggatcattggaactaggtcttggttctatttgagtcatctgtttttctccagagacgagtaaggtagtcagtgaggagccttctggctgactgcacttttgcatttcttgacttttaaaaatctccccttctcatctcccacttaaaaatctttgaaacaagtagattgatggacactacagaaaagcatcaaaatttcatcttagttttgggcgctttcagactttagtctgttttatagcctgttttatagcctttgtgatataagcttaaggctggaagcttctgtatgaattattgaataattccttgtatttgttgtgtcttactgtgttcgcattatttcatttggtccacataagtagccgattaggactctttatcgtactttaaaagttgagaaacacaactgcattcaaacaccttacttctctctggggatattggtggaagggacattctgccttaagaaagggaaagtggaaaagcaagatagaatcacagaggaagaaatgacaggttccaattagatccaccttcttaggactgtattatcagcacttgacaaaatctttctcttgctgtcagatgacttttttttttccaaaaatcttatgtgatggctagccctggaatactttttgttggagaaagaaaatgtcacatcagccaacgaagcagagctagtaagaggcagagaactaagcctgtcacccaccctctaaacttttgtagccccttgctctcagtagcacagtgagagcttagatccaagtgggtatctgaaattaagctggtcaagaaaagaggaaaagtaaaccctcatggagtgggtagaggtgagtggggttaactcttgggataatggaaaggagaggtagttgacagttactcttccccgaaaatattctgacatcttgatttgcaaggctgaaatatagtgtaccaacttatgttgtagcttctattaaagtggtttgaaaaatagatccagttttgcttaagataaagctagagtctattagaattaagagtatgctgttatagaaaacagtagttattttaatgaagaacaagccaaattctctttagtacttagagcatacacactctttataagaattttataaaaataactgattccaaagacttgtaagagtatgaatacgcaatctttttatacaggcaagagactttgcaaatgaaaagaaatactcagcatgtttaggaatatggaagtggtgtgagcattcctttatattcacccgtcccatttgtttcttcaaagtacttgaataaagaggtatttttacacccatgttgatagcagcattattcacagtagtcagaaggtggaagcaactcaagtgtccatcaacagatatgagtgggtaaacaaaatgtagtatatacatacaaggatatattattcaaccttcaggaaggagattttgacacatactgcaacatggatgaactttgaagacatgccaagtgaaaagctggtcactaaaggatagaaattgtattattcttcttttatgaggttcctagagtagtcaaatttgtcgggacagaaagtagaatggtggttgccaggggctgggcggagaaggtaatgggaatcagggtttaatgggtatagagtttcagctggagaagatgaaaaacttctagaggtggatggtggtgatggttgtgcatcaatgtagaatgtacttaatatcacagaactgtactctttaaaatggttaaccattggtaaccattgttacatttttaaaccatgataaatttttgttttatatatatgtgtttttttgttgttttttgttttttttttcttgctctgtcgcccaggctggagtgcagtggcgccatctgggctcactgcaacctctgcttcctgggttcaagcaattctcctgcctcagcctcctgagtagctgggactacaggtgtgtgccaccatgcctagctaattttttgtagtttttagtagagacggggtttcaccgtgttagccaggatggtctcaatctcctgacctcatgatccgcctgcctcggcctcccaaagtgctgggattacaggcatgagccaccgcgcccagcctttgttatatatttatagaaagagagaaagtagttgaatagaatgaagtcacccaccaagtttataaaccagtaggcttttgacatactggaggaatgtccctagataatggaacattacttctccgaacctttccttggaatgatgctcacagatttcttctggtgttggccatttggaataatgggcaagttaaaaccccaatcattgttacctcaataattaaatgtgatgcctcttgggttagggatttgtagcactcactaaagtttctttaattcttatctgtaggacaagtgttggacagccggagtcagtctccatggagattatctttgataacagatttcttctggggaatagctgagtttgtggttttgttgtaagtatagaagagctcttaattgccctgatatttaagttgacaggtatacatcatgtgcattatgttagggatcttaaataagctcaactttcctgaaacagttttctattgcaatttaaaaaatagctttacacagggaaatagatgttagtgataaagttgctaccaccagatagcttatgattatgagtatatgttagttggattggtaaacttgaccacatcttaaccttggtggtaactacttcaacctatggctgggtccgtcaattctgatgctaaatgactggacctcactttctctctactattcttgttttgtttttttctttgtgcatgcaactttcattccatattatataacaagtaaataaaaggttttatatcctggtttaaaaaaaattccaaagaagtaaacttttttataatgaagggttagaattggtaaaggagacaaaaatttaaatgtcttcataattgtaagcagttactagttaaatgcatgttttggtcttttacatgctgtttgttagaattgttcatcaataattaagaagtcttacctattcctaaatttgaatatatatttgagtgtctcatgatcagggaactgtagggatgcaaagatgtgggagacccttttttcattgagtttactgtcagtaaatatcttcatattgcaagggtgggcatgactgggaggtgaacatcagaggaagttatcccagataaaggaaaccacatgaaggatggcatagaagtttgagtatcaggctgtggtctttatgcttaatttgatcttagctgtggtttagaaagtttaattttatggctatatatagcataaactagatggtgtagaatgtaaaatggaagagatggtttcatagaaaaatacaacagggcacaagagaggccctaagttacccaatccaaaacttaactcttttacaaatttcacctactccatgttgtttataaaagtactttttaaactcagttaaatccttccatataattttacatatcatttttaaaaattccatttcaatggattcccagaagccctgtgcctttgccacaccacccttggcccctccttccctaagatgttaggtagacttttgcaggggaaatgagcatgagacactgtaaaaacccgatggctgatttaaagtggaggtcagggatgactctggtttcatgctctgtctaggggagttattagcaaataagaaatacaaggaagggtagatttggtgtacaacatagcacattcagtttagacacatgcttaagttagatggtggtgtccagctggctgcaagaaatgtgggttaggagctaagtgggtttagtaatcctctcacagagatgatggttaaaaaacatggaaatatattttagaatgttgtcaaaagtgatacctttgttgttttctgccccttgtttcagtttcaaaactctgcttcagcaagatgtgaaaaaaagaagaagctatggaaactcatctgattccagatatgatgatggaagagggtacagctttttaaattgataatagttgtttttatgtctttgtatacctttattagatattttaggtagatagagttagacttttggaaattaaaagtttaaatcctattttacaaaattaatgcattactgtaaattaaaagtcaaattgcttctgatttgataataatcagttaatctgacaaagctaaaatatacatgaaatatcccatggaaaaagtctaaattagagggtgaaaactgatggccaccattaaaatctaaagatttcattttaacatctggatttctagttgctaattaaaaacttagaagatcgccaggcacggtggcttgagcctgtaatcccagcactttgggaggctgaggcgggtggatcacgaggtcaagagatcgagaccatcctgaccaacatgatgaaaccccgtctctactaaaatacaaaaattagctgggtgtggtggtatgcgcctgtagtcccagctactcaggaggctgaggcaggagaattgtttgaacccaggaggtagaggttgcagtgagctgagatcgtgccactgcactccagcctggagacagagtgggactccatctcaaaaaaaaagccgtaaagatcaagatcaagtagcactgggctaggcttatgtttctacctggcaaaaatcagctggagctgggtttcagtggggcattactggaggtgctattcagttcatcacagtcctttcttgactcagttccttgtgtgcattatgtgtctggtccctttaagtgttttaatttttgcctcctgacctaaaatggtagtttctattttaaattgtgttttagggtcatgtgggtgctgaaaaagaaaagggtctagttgagtgcttttaaaaggagacaattcaagttgtgtctatcaaacagtagatactaactttttattttattaggccaccaggaaaccctccccgaagaatgggtagaatcaatcatctgcgtggccctagtccccctccaatggctggtggatgaggaaggtaacttcagatctgaaattcttttgtaggattttgttttgaaaacacttctgtagtaatgttttctttaagaagttgcccagcagcttataattactcagacattatttggaaatatatttgttatcttaacccttgaaaaattcactggccttgttatcaaaatgtcttttgagaaagattttataacatgtaatatgttgaggttttcacacagatccaaattaataaccagtaactaattattgtaacattttctttcaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataa

SEQ ID NO: 474 - DNA, 30719 bp, Homo sapiens
gcctcctttgcgggtaaacagacatggccggcgaaggagatcagcaggacgctgcgcacaacatgggcaaccacctgccgctcctgcctggtaaccgcccggagtagttccctgtagtcgggagtggggcgaggctcggagccgctagcggtgcagctgggcctgggaggcgggcgtgggggcgccaagcctggcgagccagcccagcagggccgcaccggaaagctgcttcacgtcggccctcggccagcgatggagtcgcggcgctttcttcgctgctctgttgccccgagccgtgagccagggtgtcggggggagcatttgctattaagaacaggaaacccatcctctccatcctccttgtgttctgagtttagctcctaggaaatgctctgaaactagaggaccgggtcagattcacagcggttacttttgctggtctccttccttttaataagagtgacagctaacatgtactaagcacttaccatgttacgagccgtgcagttaacgctttgcatgcatgtcgccttttaatccttcccacatcagttttcagtttccgatttgataagcgagtattggatttgcagattagttcaatgacttgcccaaggtcacacagcagagtcaggattccaacccgggtgtgtctgtcattatatctctaaaccacttctctgttttgtttttcttactatcggtctttctcaggcatgtacgattatgcttaatcagagatacttagtttttctttttcctgtatgttgtgtgaaatgtttagactttggccttgtgttgaaatactgaacaaaaaaaaaaatgcatggaatattgcataaacttttcatggaatgcctttcaagagatgctttccaaaaggtgtatcatccaaacttgaaagtattacttgagtcccttcgttatatgacaagtatgttaggtgttgtggagatgaaacgagaggtaatacacaatctgataattgaggtttactgtctaggcggggctgctgagaatataactaaacgtaaatcaactgcagaggcggttgatttagggccagataaatgaatgctgttgtggctcttcagaggcagaggttgtttaagggtcagaggatttgggaaaaagcctttcaggtagatcaggagacatctaaaagcacatatttaggatatggttgtgggacataaggcctaggaggtatattgggtctaagttgctgggaaactggcatctcttgccagtgggtttgggtttttcctgtggattgccaagaaacagttttaggtttcaggtaattgcctaaagaaatctatgcttggaagattaatttgtccactggtagcagcatggattaaaagaggaagagactgagtgcgtgcccaccatataggagagaacttttctgtaaaaataaaccatagtcactggttgttctcgaagccattctagctgagttgacacaagggtaagtgtgccagcctttgatggaaagctgagctattttttcagagacattagccctactctctgtgccaaatccggtgtttcagggagaatggtgaatagaagagggaggatactgatcttctgtcgacattcacatcgtgcctctgcatgagatgagtcatcagacttcactgatagctctgaacagtcagcgtggttttttgtttgttttttttttgtttgttttgttttgttttttgtttttcagaaaagcgtcgggagagggcccagagatggtgtagatatagcaataatgcctctccaaattacgtaaattttatttgtagggaaacactgggctttccataattccatgtagtacgagttgttctgaagagtaaatcctctaagttccaacaaaaagctttatatttgagatgtgaagagtttatcctaggcaaatgaaacattaataaacataactgagtaggggaaagtggtttttagccatatttatgaaaaaaaggttactaaagaaattatttagagactaggagtcagaacagttaaaatgtaaatttttaacaatattaattccagcctttgagctaatagtttatcttttaaactttctgtagtagagcaataaagtgggttgtgctgcatgccaagtgatagccatactgtcagagttggaaatacaaacaatttgatgcagaatatttttgtcatccatttagatagctctttttttatctcagtgaaacttacatgttccaaggaaaatttgtatgaagtgttagaccattggctatttacatataagttgaagtaattctgtttttgacaaagttttatatctaggaagttgtaataataaatagaaagtccaaggcagttaccatattgaaaatcatttttattttctgtcaggggcctggctagaggtggtttgacttaaataatgatatgcaaaggaaaacaaatgattatttcgtaatgacattttatcgatttagaagtttatttggggcatttaaaaatacatgaactgggaggtgagaaatgagattcagtaattctttattgttagtctaggccagggtctcccaacctcagcactggacttttgggctggagaattctttgggtgggattgtctcgtgcattgtaggatatttagctgcatccctggcctctacccactagatgccagtaggactcccttagttattgcaaccaatatcccctgaggggcaaaatcacctgtggttgagagtcactggtctaggataggaaatttactcatagtttgtatgaaaaggacagactcacagttagtacaatagcatatgtattgtgtagcgttttctaattttctttgctgtcattggtaacatctggttttctaagacattcttttaaaatgttttatgcttcatgcaaactttatttttaaatttaaaattaagcaaaatagtatgcaaatgattgcaaaattttctttgtttctttcttttgagatggagtcttgctctgtcgcccaggctggagtgcaatagcacaatctcagctcactgcaacctccacctcctgggttcaagcgattctcctgcctcagcctccccagtagctgggattacaggcacctacaaccacacccggctaacttttgtgtttttagtagagatggggttgcaacatgttggccaggctggtcttgaactcctgacctcaagtgatctgcctgcctcgtcctcccaaagtgctgggattacaggtgtgagccaccacacctggccttcattttaagataatgtagcgactgccagggaaatgttgtcactagaaaaatgctgtgaaattcttcctgctaggttatctttctctcagttttaattaacagatcttgcctgctttgtttcttttcttacttatgtaggaactgattgaagttgagagtttgagagaacgttagaggttgacttgttgaagcctatcattttgcagatgaggaaactaaaatttaattgggcagaatgagttgtctaaggtgttaaaattagttactggtgagggagaagagaaaaatctcccatatagaagaattttaaataacttacatttcctcttcaagggagtggagcataactcatcacccctgaagtggaggctacacctagtgatttgcttccgaagggtacaatgtgaaaaggaggggggaaaggaactttacagcggaaaaacctgacacacactgctgtagccaggtgatcaaggttaacagcaggaatagttcataatatataggctggatatgtaataaaaacagcacattggcaacagaccccatttctaaaaaggaaaagaataacaacacttcacttctgtggtcttcctccctaaaacacgtatcctcagtctaatcatgggaattacatcaaacaaaacccagttgagggatactctacaaaaggcctgaccagtactcctcaaaactcagaaacaagcaaagtctgaaaacccccctagcccagaggagggtagggggacctgataactaaatgtaaagtgggatcctggaacgcaaaaagactagataaaaactaagggaatccatttaaaatatgaagcttagttagagtaatgtaccaagactgattccttcgttgtggcaaatgtaccatactaatataaattaactataggggaaaaggatgtgtgacacacgggagcattctgtactatctttacacttctctgtaaatgttaaactattctaaaattcacagttgacttaaaaaaaaaaaatagctactgacagagcccagcacggaccccagtcctctggctccctcttcacggtgctgtagagtttaccaaatgcatgtggttttagaagtacccctcttttgaagaaggaattacatgtttgaaaggttttcattcatctttttttttttcttacaatattctacttttatagcagagagtgaggaagaagatgaaatggaagttgaagaccaggatagtaaagaagccaaaaaaccaaacatcataaattttgacaccagtctgccgacatcacatacagtatgtaatttagtgacagatctaatataatagatatacatttaaatgtagataaaagttcataaaaacaagtgactgatatttgtattactagatatcagaaattgtggatgaggacatgggctatttgccagtagataaacatttaactgtaatttttaagaagcttaatactatgttgtggtagaattgtttgaggaattgttgctctttatactctttctggtaattgagctattaaatacttctctgtacttctaggtactagagtgttattgaacatactaacattttatacttactgtttgtgatatgtgggcatagagatatttcttggtaaaaataatactttgtactaaaaaaattcttgaatttctgtgtttgtgatatattcataaaagattagaaattcttctaagagttaaagttagattaaaaattatattttaacatgggatgcttatataccacgtttattaagtgtttgtaaccccatttgtatttttttctttttttttgagacagagtgttgctctgtcgcccaagctcgagtgagtgcagtggcacaatctcagctcactgcagcctccaccttccaggttcaagtgattcccctgcctcagcctcccgattagctgggattacaggtgtccaccaccacacctggctaatttttgtatttttagtagcaacagggttccaccatgttggccaggttggtcttgaactcctgacctcaggtgatccgcctacctcggcctcccaaagtgctggaattacaggtgtgagccactgtgcccggcctgtatttcttttaatgtgatttgctctttagtctgttgagcttacatttttattacatatcgatcatgacactatacctatatatgtttttatatagtacctaggtgctgatatggaagaatttcatggcaggactttgcacgatgacgacagctgtcaggtgattccagttcttccacaagtgatgatgatcctgattcccggacagacattacctcttcagctttttcaccctcaagaagtcagtatggtgcggaatttaattcagaaagatagaacctttgctgttcttgcatacaggtaaaatattagagtccatttgcttaatacattccctctcatgggtaattgcagtggtcagtgttgaagccaaagcaggctgttatttcgcatgtacaggagaggttgggtaagaatgtgaggttaggaatttggttaagtagaagtttgatagtgcaagttggagtatttttgttcatttcattaccatctaactcagctcttcaccttcatacacaatttaactttctggtatttgaaaaatttttaatcatttatatttgatgaaaaacatttctggaatcttagtttcaataactgtcttcattatagagaagtagtgcttttttattttaacgtaaaggattacttttccaaaagagtggtcttttctttccctctctctcaaaattcataggttgtaccactttaaattgaagctgaattttaagtatcccatggcaaataaaggaaatctgcggtagaggcaggaaatacatacaggaagctcccaccccagtacagtgctgccagtaagcagcagaaatgataagtcatttgacagagtgaaagaatgtttggtttgggaaatgagtttaaacccctgtaagttctaaattattttcagtgactagaaatctattattttcctaaagttctctaattgtacttcctgagtccttcttgtatatcccccatgtgatttaaaaataaataaaattggccgggcatggtagctcacgcctatactcccagcactttgggaggccgaggcgggtggatcacctgaggtcgggagtttgagaccagcctgaccaacatggtgaaaccccgtctctactaaaaatacaaaaattagccaggcgtggtggtatgtgcctgtaatcccagctactcaggcagctggggcaggagaatcacttgaacctgggaggcagaggctgcagcaagccgagctcatgccactgctctctagtctgggcaacgcagcgagactccatctcaaacaaataaataaataaataaaattatcctagctttgtagtaagggttgattctataaattgtttacctgtatttattgctttgcctactttgcatatatttaaaactcaaatgttcaaaattctttccttttaaaattttcttggaagcaatgtacaggaaagggaagcacagtttggaacaacagcagagatatatgcctatcgagaagaacaggattttggaattgagatagtgaaagtgaaagcaattggaagacaaaggttcaaagtccttgagctaagaacacagtcagatgggtaagaaataacatataccttaatgctctttgaatgtttcctaatgaaatagttttcttgtactttttctgttctactgagccttcatattttgtaacttttaactagttgttctctttcccttctaaggtatagcccagtggtttccaaccttgctatgcatcagaatcacctgggaagcttttaaaactatagaagcttgagttccaacctcatctcccatctccagagagtgatgaggctgcagcatcttttaaaaatgattttcaggtgattctaatgtctctccaggtttgagaacaatcatgtaaatccaaagggaagtgttgtttgggatttggcttctttaggattgaaggcctctcggagcataagaggatagggagaccagaggcttgtgagctgttcgtgtgctcaccaggacagctgtggtttttgtagcattgctatgatgtttgaaagccacactggttacatctgcctactgctccagctgagctataaaagccatttatatttcgtgtccctctccagtgtgaattttatatcacccagaaatgctatttacataataaatgatcaataaatacttgtagtctatgtgccttgtgacatttagaaattccctgagtatactgtttcagcagtaattcattttgacaaagctgtcatggctgggttttgcacaaattcaagggatacacattaaaacagacacaaaaaagtccagtttattttatcctcttttaaaaaggaaacaaagcatttgccttgatcactggatattacctcttaacggagtgcttctaaactgtggcatcacccgtgaggtctcacagatacacagtcctggtacgcaatacaagtactagtgaattggtttccaatttatacccacagttgaaaatctcatcagacctctgtgttgcccaggtggtatcttctgaacacatgcaagttctgagtattttggggtttttttgggcggggtgggggattaagactgaaaaaacaatgtgagcagcatgagggcaggaacgttttgtctgttttgttcacatggtgggcgttcctatatatttttgaattatgaaaatattgacatgtcaggtagctccttggagctaaagagagcatagaggcatgtgagatgggattgccagagctcttagggtgtttagttctccccaggtacttttccagaacattcactgtgcaaactttgatagccttaccacattgcactgtcctgacaggattttatgtacgtctccctcaatagataagctgcttgagaacaatgaccaagacttatttatgttttacatttaggaccataaattttatataaatgaatgaaagaatgatctcctggggcgggtgggggtggtctgcattatgataattagcaaactgttttgttactgtggattttgctaacagttccatttttaaagtacttcttatcttcatacaattttgattatttgtgaatacttttatagaaatcattaaggaaaattgacttggggaaaagtatatttctcagactgtcttgacattagtgacttttgattgtggaaaaactattgaacacaagatggcagtataccgttaactctgaaaacaagacaaggaatggatttttgactctagtaaagattaacatcaggccgcgcacagtggctcatgcctgtaatcccagtattttgggaggccaaggcaggacgatcacctgagctcacgagtttgagatcagcctgaccaacatggagaaaccccatctctactaaaaatacaaagttagccgggcatggtggcgcatgactgtaatcccagctactagggaggctgaggcaggagaatcgcttgaacccgggaggcagaggttgtggtgagccaagatggcaccactgcactccagcctgggcaacaagaggaaaactccatctcaaaggaaaaaaaagattaacatcaaactgatacaggtggacaagacttggaaagggcacattctctctagtattctgtagacccattattaaggcctctcataagggtatgtctgtcttcatttaaaaggcctctgtggaatgagatttctcttggctccactacttctctggccctgtaaccaccttcactggaaatggtgaaatgaaagaaattctggagttgatttagttcagtctcgtctttttctgtatcagaatgccaggtactagagaggttaagtaatttgcttaaacagcaaataagcgacagacctgattggttctaggtcccatgacttccaaactggtactccttccattataccagaatttctctataacacatttgaaactcaagccagcttccctttctccagtaaaatatttaatattcatttgtttttcttagagaaataagcatatagaaaaataaaaattaaaaaatataaatatccatcttttacctaaatgacacttcatttattaaaagtacactacagaggccaggtgtggtgactcatacctgtaatttcagccctctggaaggccaaggtatgtgaatcatttaaggccagcagttcaagaccagcttggccaacatggtgaagctgcatcactactaaaaatacaagaaattagctgggcatggtggcctgtgcctgtaattccagctgttcgggaggctgaggcatgagaaccacttgaacctgggaggcagaggttgcactgagcagagattataccgctgcactccagcttcgccaacagtgagactccatctcaaaaaagaaaaaaagtatacaacccccaaagtcatgagtgtgtgtgggttggggagggcggagggggggtgggcatcttctgaacacatagaaatttttttttaataaaaacaggtctcactgacataggactcttcagaagttcctacttcttagcatgtagagaggaggaggggattgatatcctattggcatcacaagagaagatctcttacctgtctagactgagaccaataattgttagtcaaaaagttagctgaagctggaaatcacaaaatgttacacatatatagcttaaacattttattttaactttataaattcattcatttttcatctggagagaccaaggtctttccattgaagcagttctgcagattggagatgactgtagactttctggcactttcattgtacattatccacagtttatactgctagtttttctttaaagagggattctaaagatagtcacaaggcaatttgagtgcagaatttttccagatttgtgcggtttttttcctattagagtagtctgtacctaatttgaaagcagtttatgtctcaacttaatgttccttgaagcagttttattgttgaagtcatatttcactggtttttataacatttatataaattatgttgctgtaatcacaaaacaactgtgataaacaagttggaaagaaaaaaaactagcttatgttaaaaacaaaactcagctgctgggagaagaaccagccactgcatatgcagtggaccctggccatgtttaaccaggtaaaggagagcattccttaatccttcaaggcaattcagacagtttgtactgcagactaattaacatgatctgtaagccaggggatcaataatgttactgtttttatcataatcaaatcttatacaatagttgggtaaagcatagttcttaattcagttacctataaccttgaagaatcagatttctaaaaatttctataggatggtatatacttttaccttcataatgtaattaacaagttatttgtgttcatgaatcaggtgaagaaaattgagattttgtttctaatgagctctaataataatataagaacacttgaccataatttgactatagtaaaattttttaacattttccgaagtcatgtagacaaattttctgagtatttctaatgagtttgcaggaaggaaataaagttagtagagtgagtctactattatcattaaattaaacttagatactttctaacacactcagttatttttccttctaataaataagtaaaatgtcagaatttcatccataatatcttgtggtcaaacagtggttattatgaaagactactttagaagtcttaagtataactaataaagcagagacttttaatatatttgactttgtcagtctgacagtgttatatactagcatttgaatatagttacatattctacatttcagaagctacactctaagagatagaatgcctcacaggaagatagctcatagatacaaccttcctgtttgcactagttcatgataagatgtttgcaattatgatattctcaagtagcattttggaaatgactttattatgacattttaaataacttttaagaaaaaatctaatttatagtttgatcctttgtacagttaaactcttaagaacgtgaaaaggaatgcacacagaaaggttgcatgtaactctctagtgttattttaattcatccatgtaaatgcattcttgatttttctcttcctttctctacttagattagatgacttatgagaaaggatagatgtaagagttaagcagcataagaagtggggggatagaagaatttgggtgtcttaagaatgtttaagaaagtagaagtatcaagcagtagttggttgtatgttggtttttttaaaactttgtttcatttatagactctgtatttatctgaaatgtgtagatctccctttccattccacagtgacattgaagatccgtaccttaggttatctttggttttaactttggtatgatttatgaaataaaattattttctgaaagtttctgtatcttaacatcagtatttgatgaatatgtttaaaagataaaacttggaaaatcttggtatttaaaattatcactgtttagaaacttatagttttgagttagtcaatcttagaaatgaataccatgcttggttctctttattttagaatccagcaagctaaagtgcaaattcttcccgaatgtgtgttgccttcaaccatgtctgcagttcaattagaatccctcaataagtgccagatatttccttcaaaacctgtctcaagagaagaccaatgttcatataaatggtggcagaaataccagaaggtgagaaactaattttttatgcatcttcaaaaaatgaagacaggttgttttttttcctgttttaagaaagaaacacaactttcatgattcattacccagccaccttgtatggcaatattccagctacatttgatcctctaaaaattgcacaggcagctactttatgtaaaagcagtttacaaaagcaataaaatgtcacacagctgtaaggtatccttgttattatgcttatcagctatattaatcgcttttgatttttaattccatgggaaatgcttattaaactatgatcaaattagatgttcggctcttgagttataaacatccattatcttaaagaagggaggattcttttggggtagagtagtagtagagaagtagagtctgttttccttcttccaaaccagagagaaaggtttcttttgctatgtgttttaatgaaatacagttgacatcgcagaaattgacttgagactaggtgctctttaaaaatgttgcttgtttgggcactaattcctatgttatatcctttgactaaatcataattgtcataggaaaaaaaaattgagggagcctgtttctactcgtttgtgagatgtgcaattttaagtatagttaatatttataattgctacctaaagaaaaagattactagtttctaaatttagaataattgggctttttgagtttttttttttaatatggaaagacagtttccactgtaaccttaaaaattctctattaatcattcctttgttgagtggtgaggatttaatattttaatgtaaatacagaatcctaatttaatgtaaattattatggataattaatgaagtggacttatatactagtcactgtaccgaatttttattgttcttgcagtagaattcctccagttttcagtgaaaacttgtgcagaatgggcacttgatgggcatcagggttataaccaggtatctataagacttcctggtctttatctcagttaactgatctgtttcatggtacagtgtgttttgactagtgtttctaaggaagattctaataaggaagatataattagactgctttaagactcccaaacaaccttgaaactagtattttttaacgtttagtaatattgatactgcctttagttaacaggcagcttttgtgtagctgtattagtccattttcacgctgccgataaagacataaccaagactgagcaatttacaaaaaaagaggtttattggacttaaagttccacatggctggggaggcctcacaatcatggcagaaggttgaaagtcaaggaagagcaagtcacgtcttacatagatggcagcagggaaaaagaacttgtacaggaaaactcccatttttaaaaccatcagatctcatgagactcattcactatcacaagaacagcacaggaaagacctgcccccataattcagtcacctcccactgagttcctcccatgacatgtgggaattgtgggagttacaattcaagatgagatttgagtggggacacagccagatcatatcaccgtgcaatactttcttccccataccagatacagacactttaaatacatgtttacccttgtttcttttaactgaactgtgagaaattttgctcccatagtcattttaaatgttactgttgaaataagtatgtcagtgatcactgtcagtatgtggcccccaaggagtagatttggaatatattaagtcatttagtgcctaaaagtatgtttggcactggtttgctactgaaatacgtggcaaggtaactgcatcaagttgttccctatgtgtcatctgaatattcacgtagtgatgtatttcatactagagattttttttcagggggtacaggcataccacggagatattgcaggttcagtttcaaactgctgcaataaaacaagtatcacaataaagttagtctcatgagttttttggtttcccactgcatataaaagttttattcacacaatactgtagtctatcatgtgtacaataagattctatctaaaaaacagtgtacataccttaaataaaaaaatactttattgctaaaaaatacaagcatctgagccttcagtgaatcataatcttttttgctggtggatagtcttgttttgctgttgatggctgctgactaatcagggtagtggttgctgaaggttggggtgactacagcaatttcttaagacagcaacgaagtttgccccacagattgactcttcctttcacaaaagatccctctttagcatgcggcgctgtttgatagcatttaagccacaacagaactttcaaaattggagtcagtcctgtcagaacttgctgctgctttatcaactaagtttatgtaatattctgaattctttgtgtcatttcaacattcacaacatcttcagcagtagatttcttctcaagaaaccactttatttgctcatccataagaagcaactcctaatccatgtttgatcatgagatcacagcaattcagtcctatctgtgggttccacttctaactttagttctctttttgtttctgtcacatctgcagttacttaactgaaggcttgaaaccctcaaaatcgtcatccatgagggttggagtaaacttcttctaaattcctgttaaggttgatattttcaccacctcccatgaatcatgattattcttaatggcacctagaatggtgactctttttcagaaggttttcaatttactttttccagatccatcagaggaatcactatctgtggcagctatagcctatgaaaaatgtatttcttaaataataagatttgaaagtttaaattactccttgatccatgggtcacagaatggaaattttgttaccaagcatgaaaacagcattaatctccttgtatgtctcccatcaaaacttctgggtgaccatgtacattgtcaatgagcagtaataattataaagagtcttttctgagcagtaggtctcaacagcaggcttaaaatattcagtaaaccattatctaaacagatgttctgtcatccggactttgttccatttactacagagcacaggcagagtagatttagcattcttaaagggccctaggatttttggaatggccagtgagcattggctttaacttaaagtcaccagctattagcccctgaaaggagacttagggactttctctggattaggctttggctcaacggaaatttgtggctggtttgatcttctgtccagaccattaaaactttctccatatcagtaataagactttttggctttcaccagagtagcatttcatattcacagctttgctgtttgccccaggaggcctagcgtttggcctctttcagctttgacatgtgtttctaactaagctttatcatttttagcttttgatttaaagtgagagatgcttgactactcttcttttcacttgagcacttagaagccattgtaaagttattaattagcctagtttcaatattgttgtgtctcaaagaaatagggaagcctgaggagagggagagagatggaggggctcgtcagtggagcaatcaaaacacatttgttaagtttactgtcttaaatgggtgcagtttgtggtgccccaaaacagttacagtaataacatcaaagttcactaatcacaaatcatcataacagatataacaatgaaaaagtgtgaaatattgtgagaattaccaaaatatggcacaggcaggtagttagcacatgctgttggaaaaatggcttgatagacttgcttgaaacagggttgccagaaatctttaattttttttttgtttgtttgtttttaaaggcagtatctgtgaatcacagtatgcctgtattaagtatttgggtatatagaatagttcttccgcaccaagatggcttaaaaattcttaaccattaaaaatcctaaattaacgcttctttgcaaagttctaagtatagagtgagagcagtggtagttaattcctgactcaagtgctctgtacagctagttctgtgacctgcctgtaggatcctgcagtcttaaacctgaacttgggctaagcaagtaagactgctttttaaatttattttttatgtgagttactacttaaattcttcctgttctatggttaaagcatcttgtttacattacattccgaatttggcccatgcaactgggttgccactggcttaataagacaagaaaagatagagctgggaagaccaaagaagcacatatttgcctgggttcagatcctctgaatttttcctcttgtcttaattagcccttggttattttcatattcagagttgccaagggctaaagagacgatgctaaggaatgagaaggcctaaaaggttttaggtgatacaaataactccatcccatatacgtcaggttatctacagggttcccttgcttaaacattgatagagtttcttaggttctgaaatttggaatctagatcactaggccaagagaaaccgctagctgatctattttggactccaagtgacctacaaactctgttctgctttagagagaccacttagagccattctgtgtgcatcaaaaaggaatccaacagggaaaggggatggcagatatctttggtaggaactccgtatgcagtgggaccatctgagtggtttggcatgctgcacctttagtgggacgctagcttaccatgagggctggattatgtaacagtgtttgtctttagacagatacaaggttcagttcattcctgtcttcatagagcttgcttgtatctgatttgtccatcccaccataatctgaagtactgcatatgtgtcttctgtctctgtgtctgagtagtagttaaaatggtcagagttgggagatgcttacataactaagctaactcaagctaataaggttgccgcgcacttttcctgcagaaaaggaacttaaagtatcgaggattgtagtcttcctgagatatattcaattaactttgaaactgcacacagcatttgccgtggaaacctaaacaactcaaatgacatgaaataaaattatttaagcttctggaagtgttctgtgttatctaccattctgacaaggaagcattagagaagattcagcacgtgtctctcatgattaaggagttaggccagtgtaattaggaaacactttcaaaacccactccatctagagacatttcttgttctggaatttgagctctgaaactgtttacttcttctcccatcacagtgcctttctctattcactggtttactgtagggggatttgagaatccccctacagtaaaaatcctcctcaaaaaaaaagaggaaattttgtttaaacctgtttggagtatgacttaaatgtttctaagtatattccctgcttgcccagaccatctgcttattcatatatcaaggcttactatgttaatcagaaaagagttgagtatgaaatgtaaagataagtcaaatgggaaacagatactaagaaagtaatgagtctcatctttctggcctctgttgaacttagccatggttgttcctgtttattgcgtagagcagggaggaactgagcatgaatttggaagggcaggggtctcatacgtaatctcccagattagtgtttaaatctcctcctaattttatctagatacaaatgttcttatttctttcttatacagaaggatacgtacctttttcttaacggtgtatcttataggagattcttttgtattagtttatagagcattgctcattcttaaagctgcttggaattcttttgtatggatacactgtataaccagtcccatactgatgatagatctgtactaaataacatgtacaaatgaccttttatataggtaaatatttatgataacttttaaagagtgaggttattggctcacagggtaaatgcatttataattctgtcagttttaaaaataattttgaggccaggcacagtggctcacgcctgtaatcccagcactttgggaggctgaggcgggtggatcacaaggtgaggagttcaagaccagcctggccaaaatggtgaaaccccgtctctactaaatatacaaaaattagccgggcatggtggcgggtgcctgtaatcccagctacttgggacgctgaggcaggagaatcactggaacccgggaggcgagttattttcaaaatacttaaggtgtttgtacttatttttattgtttcatcatggcctgacaggcaatgtagtatcaaacctgatgtttgctgatctgataagtgaaatatattacattgaaggttcaatttgaatttctctgagagcaagggtaagcattttgttgtaagagcagtttgtgtttcctttctgtaaagtgtttgcccatttttctacggcttgttgatttcttgggagttccttgtaagctttatagtctctgtaattaatgagttccaaacatttttcctagtttgtcttttgtcttttgtttttggtgtggtgtgtcaaacagaactgtttttttgttgttgttcttacatagtttaatttttaatgcttctgtattctaaatcatagccaaaaatgacgttcccatgcaaaggaatgtctcatgttttctttggatacttgctgtggtttcattacttttccgtggaaagctctgatccttgtgcagttgatcctgatataaattccactttacttttttccagatggctccctattgtcctactaccactttttgaatagtccatattttctcccattgatttgagatgccaccattgtcacagaccaaattcatatgtttattttacttttcttctcttttggtctgcttgtgtgccatcatcatattgttgttaatgttggcactttatactttgtgtaaataaaaatagggctggtaagcccctcactgcttttttgtcaagcttttcagtgactaccattgattaacatttccttgtgaacttgagaatctgtttcaccttgttccaggataataatcgtaagaacagtaacatttattgactatttttatataaagaagaaaagtcttgaaatcttaggctatgtatagtcaggtgcttcctcagaaagactggtcatttcccaggcatacatcttgtatgtacacttgtgtatctgccattagcgtataagcctcaggagtaggaaagagcttatcattccatcccagttcttattaccatgtaggaatttggttcatgaaagaaggaaacaaaaactggtaactttttaattatttatataaattatttctgtcatttacattgctgattgtaataggatttaacacaataagtgaccacttttagtcactatataaaggaagtcagtggtagtgatttactatttatgtttagcttttcacattactctttccattttcattgcacttcaaagactcacttaaatggagtttcacatgttttgaacattctacgttgttgggaggcaaagccgaagccatagttatgaggcttaagaatggaggactgtgatagattacctccaggtaacagattcgttttaagggcttttatgcctgctttcagtagtaaatcctgttcccagagtgaatactactctgctggagaatccgtcattggtcacttttaagtgcctaaactttttggctagtattaaaattttcttgaggtataaccattttatgacatcaatcatggtgttgatatatttaaagaatgcctataaattgctagaacttatcatccattttacccagatataagacaggagcctttcctattgtgccagaaagctaaatgggactcttaaatttgaggatgttgaaatgtcttaaactttggcagttgctctgtaaaagctagctagctaatctgttctggtatatgtctcttcagtgtgtctaattgactaacacacatcacaaatattaaggatgtattatgcatatttgaatctgtcaggatgctccagataaagaattttagaggtcttctgactctgaaaagaagctacctgaaactgtagcttgctcatgggcatggtggcagagtgaatgcctgatccagtgcattgctcttaatatgctagtgtgccacattttattctctttatacttgaaatttacatattatttcagattctttttcttgacatgggtgccaaatgaaattacacttttgtactacacttttttacatttcttttgtattacaaaagtgaccattctgatatgtgaagtatattttaataactgaatgaggagtgtgtcagcgaaactaaaactttcagttgggtctttgtcattttgtaattctaagaatatatagcttcttctctctaaaatataagctcgacagggtattgaattttgttggtttttctttcattcactggcatagcctaaatgtataaaaatagcctgacacatgttaggcactgtattagtctggtctcacgctgctaagacgtacccaagactgggtaatttataaagaaaagagttttatttgactcacagttcagcatggctagggaagccttaggaaacttaccatcatggcagaaggggaagcaaacatgttcttcttcacatgatggcaggaagaagtgccaagcaaaagggtcaaaaccgtcttaataaaaccatcagatctcgtgagaactcactatcatgagaaaaccatggcagtaactgtccccatgattcagttacctcccaccagatccctcccacgacacatggggattatgggaactacaattcaagatgagatttgggtggggacacggccaaaccctatcaggcactcacaatatttgttgaatgaatgatggttagagtcagactccctgtatacagatcctagctccttcctatttactgactctgtgaccttgagcaagttataccatccttgtgtgcctctgtttccttactttagaatggagataataaactactaaccttagagtattcttacaagaaatgtgaaattcttggcacaatactaatggttgccattgctgttcctgaagattcagagctacttgatgtgctcttggtagtattttcttaaattctgtaactggactgtgacaataatcttaccattaggtatttagtcttaaaagtgagggacaacttattggagagtacctgaagggtctcatggtctgactcctcaggctttaaccactaccagagcacacagtaggaggccatctcagatcacctttggcaggggtccccaaatcctggcccacgaaccagcactggtctgtggcctgttaggaaccgggacgcacagccggtggtgagtggtgaacgagcaagtgaagctgagcgccacctcttatcagatcagtggcagcatagattcttataggagcgcaaaccctattgtgaactgcgcatgggagggatctagactgcgtgctccttatgagaatctaatgataaatgtaatgcacttgaatcattccaaaaccatcctccaccccatctttggaaaaactgttttccacgagactggtccctggtgtcgaaaaggttggggacggctgatctttgcatagtctcaaatataaggattatattaagccagaaatgtttctcattaaggaatcctttgttttgagctgtaggtcgtgttttagaacaagtctgtcctcttccatattgcaactcctaaaatatttgaaaaccagtgtgtccacttgagagacagctctaaactgaacatctctggtaacaagacattccctttgataataaaagttcccatatttgaacagcatggaatagaataacattgtctcatagattctagtcttctgttaaaaccgcagttacttttgcaccaaactaacatagctagaataggattggagtggcggggaagtcgagggtgtgagtggtgtagcacattgtacagttgcgtagtacaattccagctgtcagctcagtcccgagtcccttttatgtgtgctgtgttcccacgtttcctgcagatcttactccggcacttgcaagatcatatgactaggtatgaaacatacctagggtaagtatcattcagcgtatgaaacatacctagtcatttgatattgcaggtgcaggagtagggtcttcctcttgttttgttaaatgttaccttgtttttcttgttctggtctgttaaaagtgccttttgatctaccttattccttttctctctcactttcatgtgtcatgtcacatgtcaattaacattttatttacagtgaaattacaaagatttgtacgtatgtaggttttgttttgagaaaaatgtgataattctttatattctgctataccttgttctttgatcacttgcagagcattccttgatataaacatattctaatgtatttcactctatttttgattgatgtttaggttgtttgcaatttgttgctattagcactgctgcagtgcatcccttcagtaatatttttgtgtcctatagaccatttgcttctctttcaaaaattttgtggttacttttgcagttatgtttccaaacgaactttaaattatacttataaattccattctcactggtattgcactgaatatgtaatttgaggactgacatcttaacagtattgagtctccccctcaaatactgaaattctacaatttctacaattcacatttctccccctcaaatactgaaattctacaatttctacaattcacaattcaactgaaatttctacaattcacatttttatatggacttaggcatgctcctgtttggatttcagttacaattagaggtgataaataatcggtttcccctctccttgagttttatgaaatgaggaacttcatcatgaagtctcaagtaaacgaacattttatctttcttgggattctatcacttcttaatgtttgcccttatagtgattcagctgattctcatttaaagtttttacacaaaaacagtttggattatatcttgaggttttcacttcagatactggacaagtaattagtataaaggcaactaacatggtcataatagaagtatggtgtttactctcaacatttatcttcccaaagttgtcttcagcattgaaattttaatgtttgacctttttaaataggaatgaagattctagttacaatatatatttgaaggatataggaagcatgatttcacacttcatagatagtcacgtcatgggattatctacaaaattttttatctttttaaaattagatgttttcctaggccaaaatcatttttcagatgttgctcattccagcattagaatctttattctgtggggttttttaagtgcctttttgttttgttttcagagaaagtttcattgtgcaaatctaacttcatggcctcgctggctgtattccttatatgatgctgtaagtaacttaccttaaatttactttatatatggtaggccatgtcataattaagggtcattaaaaaacaaaggtttagtttttccagtttctagtgccttataacttaagatatcgttaagagtggtggctcacacctgtaatcccagcactttgggaggccaaggcagggggattgcttgaagccaggcattcaagaccagcctgggcaacatggtgaaaccccatctctacaaatacaaaaattagccaggtttggtggcatgtggctgtagtcccagctgcttgagaggctgaggtggaaggattgattgagcctgggaggtcaaggctgccgtgagctgagattgtgtcactgtactccagcctggacaacagagcaagactgtctcaaaagggaaaaaaaaaggtatcacaagactctttagagttttattaagcatgtgaaattttgttgggttgggtgatagttacatttagaacattaaagcatccatattttactgttttggtttttctctaaacaagtatattaacttacgtctcttgatcattagtctattaattaatgcatccaggagggtttttgctccttaaagtttaacactaggcattgccacattttgcaaaactaagggacagtgctgaaatggtttaaagaatctggatttcagatcagagactgacttcagagtctgatttctgtcacttactctgtgggcctggagcaaattacttctccaaggacctatgaaatggatataatggtagctattgtacctggtgtgcatagcgggcattcaataaatgctagccatttcccttaatgaatcactgcccacaaatctggagtcctgggaaaactcaacaacatgcacgacactaaaggaaactgcagttgatctccgctctttagcagcttttcagcaattacaaagacacaatatatgagtttttgcatgttttgcatatgcttgtgaaaattatgtagtaaataggtgccaagtaaggtatgtagatagcaagtgctagtgcaatttataggtgccataatccctatggactgggtcagaaatggcctaatagaaggcagaagagaggccagttccaagcaggggcatagaacagaacaatctgcaagggagttgggagcatataccgctgggttaagacagtgagtgagaaaaggctggaaggcagacagtgctgggcaaaggagctggagcttgatcattgctgcatacgaaaatggaggcatttaaactgggactgagatgggactgagtgattaaattgctaccagtgttagttttaagagttgaaaagcttaatagtaaattttaataagcccatgaacttgattatggctacctttattttaaacaaggagaccttaatggacagaatcaagaaacagctacgtgaatgggatgaaaatctaaaagatgattctcttccttcaaatccaataggtatgaaaagttagtttcctgcctggagcctgggatgtcttgctataaaaaatagctttttcatggatgcgatccaatcatatcttctaggttttaagactgattaaaacattttaattctgaaaagcataatttcctttgagcagttgaaaaaaaatgagtattttaaaattaattgcaataaaatcctcatattctgtgagcactccaattttagacaagttttccataaaaagttcaaattgcaggaagtggctgtcatccaaaaacacttcctgtgtaaggactcctttccctgttcttcaaggtgcctttaaaagaagtgagtctagttccaggacttgccttaattatagatactctctttatctgtttataaggtatagtttagttatttttctagtctcttggcaaataacttctaacatggatttgagttcatgtttaacataaaaggattttaccaaaaaaagtataagaaaagcaattaaatttagagcttctgaaaagtgtatctttgacagctggtatatttttgtattgtttatacttgtataaaatgtgtaaccttaaagagaagggtttatttcaaaaggatattatccgatttgtaagttctctgatgcttatctgactcctaagtttaaaacttgaaaaaccatgtcttgaagatttttcttacagagtagctgcttgtcttcctattgatgatgtattgagaattcagctccttaaaattggcagtgctatccagcgacttcgctgtgaattagacattatgaataaagtgagtaaagtgaatatgtttttgatgcccatgttttattcaggctggagaactaggatgctctgttggggccaatggagctctgtatagagtccagtaatgtagtcatgcaattcagatttcaattgggatcttacaaacaaactcattgttttgtgtttgtcaaatatgaatacatttatcaacttagtgaaaaataacttgatttctgcatggaaatatccaaggttatatatcactattcctttactctagagaaggtcatttagttttatgtaaatatgtggcagatctcagtttcagtgactttcgtgctccatctttaaaagtgtttttgaatgcttggaaggaaaatgtgatattcagagagagcaatatctttataagtaagtttcttgatgatctatgtgattacatgataaagtgaatgccagtttttcctaccaataatttttctctcaaatcttttagtgtacttccctttgctgtaaacaatgtcaagaaacagaaataacaaccaaaaatgaaatattcaggtaaggtctttattacgtttttaatatacttgccttatcagaattataatgaagactgtatttctgttttccataaactttcctccagtaccttaaagttacaaacatttagcaaatgaaatatagggaattagctcacttttgctaagaccatcttccagattgggtactcagagcaacaatgcatgtcagggattattcacaggtaatgagcatggtaaagtaaaacaactgagaaattcttttccccctaattcttgttgacaatctatatattagactgtcttcaattaggccctaacatagatgcttcagaaattacatttcagtcatcagttttgccatatagggccaaagtaggacatgcttctgaacacatactgatgctctgatataacagtgtttgaaaatcattttatgacaaatccatcagttgtaaatcaagaaggtaaggaaactgctttctgcaaaataatcaactgccccaaaatgaccacacaggaccttgtcattgcacttacactctcagactcctttagaagcatttgagttttatattctttacaatgtctgtcttgaggagggttttaaaaacaagtactatttcctttgggtcatcacagaaaacatttagacatttagacaaaacaggcctgtctgccagctgtacccccaccccattttcatactaagatcctggtattatataaaactgaaggattaaaaactgtatagctcatacctcatttcttggtgaacttcaataaaattctaagcatttaataaaattagacttctcgttttgacgtgttctccatgttgattctttgttttagtttatccttatgtgggccgatggcagcttatgtgaatcctcatggatatgtgcatgagacacttactgtgtataaggcttgcaacttgaatctgataggccggccttctacagaacacagctggtttcctgggtaatattatggtggtggttgcttttttttttctttttttaccttaattgggcagaaaaatccagagtcctaagcagagttgccacaatctttataataaaaagtagacagacaaatgagtaatttgctacaaaaattagccgggtatgggggcaggggtctgtactcccagctgctcgggatgctgaggcacaagaatctcttgaacctggaaggcaagagtgttgcagtgagccaagattgtgccactgcagtccagcctgggtgacagagtgagaatctgtctatttaaaaaaaaaaaaaaatttatttaaatgtccttcattccacaaatagctagaaacatctgttgcactttttgtatcttttatcattgaatgaaaggaagaaaaggttgacaactgcagttgtcctcagattactgtatccagttaaatccaaaattgtttttttctgtcagtcatgtaattctgaaaatcagctgtcttatgacccagtagaactttatatctggaccatattctgtagtaatgtaaaaccggagaatgtttacaaagcaatgatagactaagaaggtgcagaacccattgaatcctgcttttcttctagtttgccttttgtttgtttgcttcagcttaatgattctctatgatcctgggaacctgttcagttccctcagctgtactatcttcagttttcaaagagggatgctaagaagggattacatgctactctggggttaggactatgtatcttggattgccctatcttacttggcaccctatgtgaggactaaaactagaatacatttgttactataaataaatgtggcatggtatacctagggaaaaaaataaggaaacagttgcaattacatggtttatcttaagaacaaaataccatggtttgtatttctggttgcattatctgacaatcgttcttattttagaatataaatatttactttttgagacgtgtccttcctggcccatccagtttaactcagacagaagtgcattatttctgcaggtaattgctgttttctaacttgactgcaatacaacaaaggaaaagccagtacaagttagaatgtggtgccagtacaagttagaatgtggtcttggcaaccagcaatttctataaagaaattcttaagattactctttatttctatgcagtagaagaaaaatgtaaacatggcttaagagcataaaagtcatacatattacaaaattagaaaatgtttttagaaatgtttttaggtttcagggaactgtatggatcaaatctcaacttagaatctctaatccttagaatttgcctctaaagtctgtcttcatgataggtttatatgataggcttggagtacagaaatgtttccttagctgatatctttccttaatttcttaggtatgcctggactgttgcccagtgtaagatctgtgcaagccatattggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttatctaacaaattggttatattctaagatctgctttggaaattattgcctctgatacatacctaagtaaacataacattaatacctaagtaaacataacattacttggagggttgcagtttctaagtgaaactgtatttgaaacttttaagtatactttaggaaacaagcatgaacggcagtctagaataccagaaacatctacttgggtagcttggtgccattatcctgtggaatctgatatgtctggtagcatgtcattgatgggacatgaagacatctttggaaatgatgagattatttcctgtgttaaaaaaaaaaaaaatcttaaattcctacaatgtgaaactgaaactaataatttgatcctgatgtatgggacagcgtatctgtaccagtgctctaaataacaaaagctagggtgacaagtacatgttccttttggaaagaagcaaggcaatgtatattaattattctaaaagggctttgttcctttccattttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatactgttccatacaaaagctatttttcaaaaattaatttgaaccaaaactactactatagggaaaagatgccaaaacatgtcccctcacccagactaaacttgatactgtattattttgttcaatgtaaattgaagaaaatctgtaagtaagtaaaccttaagtgtgaaactaaacatgttctttgttcaaataatgtaaaatatctactcataattttaaagttctaaaaaggctgctttgccacctacctctttgcttatattcaagggtttagtgggtccttccttccacatttgtatgataactttcgttttattggtagtcctttgctactttaaaactaatcaggttaaatgtttactcaaatgtagtaatagtatgaggccaaaatacatgccttgaaggtggagtgaaatcagttgagtgtcacactgcatatttatgtaaatagagtaaatgaaaattcaagaatacttccaatcaggatatgcccctgccttattttttctaaggtctacttttactactttaataattttgggtttgtgtgacttcactggtctggtttgttcctatagttcttacactgcactaaaacttacttactccaggaagttcctgtcagtagcatagtacctctctgtaggctgaactctaaaccagttgcaatgagttaccttgtccctctgaaaagttaaaatttcagtatgtcccataccgtttactagcaaataaaattttctgatctgtaaaaacacacatatactatactactactgaaaatggttttacacatgacaaaaccagacctgatagctaaatctgcatactttctatacagaaatagtatgtattatatgacgttgggtctaaatctgtattttggcagtacttaaatattttaagtaagtatttcaaagtattattttataatgcatctaattactgacctgtatgcagtcatttctgaggctttcttgcatcatagcccctgtgacatttcctcttagaaatattacactctacaaaattgttttatcaaggtccaaaattactatttgctcatagagtacaaagatgttatgactggctacacagaaaggaaataaattatgaaatgtcagtatagcagctgaaattatagcagctgaaataaacagtttgtattatacattttatttacctgatgaaa

SEQ ID NO: 475 - DNA, 39606 bp, Homo sapiens
agggactcttcggcctaggcagccgggacccagccagccctgcgcctcgcgccgtcgcgcatgcgtcctgggtatgtccacgcgcaataaggaggggcgaaaggacatttttttttttcttgctcccgcctctgttcttcccccacctgccacgtacagagcccaagttctcgctaggcttgttgggtcagcgcgattggccggggcccgcgcgagcctgcgagcgaggtgcggcggtcgcgaagggcaaccgagggggccgtgaccaccgcctccccgcgacgccccagtccagtggcctcgcgtccgcccattcagcggagacctgcggagaggcggcggccgcggcctccgcaagccggtatggccactggagacgggggttgcgggcgctctgtccgaggaggccgggagactaggaggcgctgggagggcctcgttcgaaccgcgcggcagctggggtcggaggcactgtgggaaggggctggagggaggagggggtgggagggaggagggggtgggagggaggacgaggccgggggggagggcgggcggggccttgcatggggggaggggaagggaggtcgcggagggggaggggagagaggcaacccctggctgcggtggccaggaggcgcgcctggggggctccgggaggggagtgcgccagctaatgccttggtgcagcctgcctccaagcgtttggattgagaggagaggggctttgggaggtttggggcggccggcgcccaatacccgaaggagctcggaagggtgtggagtggcgcctacgggaataagttgattggggtcatagaatcggagcctagttccttggctaagtcagcgcttaatcaagcgccggctggaggcccagcctggtttatagtgatgattctagctaactttaagagtttgctttgctggacactacagtaagtattttggatgcactgtctcatttaatcatcacaaggattcctccaaattcagatatggttgttttcatttcgaatgtgatgaaagtgagccttggaggacttaagatcacatagctagtagtgagaatctttaccgtcttgctgcactgcctttgaggcagggtttgaggcctcttggcattctttagaataattacaggttgacttggcttagtatttcttgaaggaaactgctcccctcaggaggtgcttaagccacagcctctgaaattgagcagggtcttacccttagaggtagtagaaccagaagtttgtccgccgaacctagaacctggttcaggaggcaggctttttatatgaccttgggcgtgtcagattattcccagtgctgagaaaagtgtacctggtagagggttatattatacaagttagaagccgagtcatttctggacttcagagggggcggggcaaggacaagatgggagaagagcttgtcgtagggctcctactggcagttctaggaactagttaataccagtctctactttggaagagaaaatgagtaccagaattctgtatgtgaagtaatgttgggttgggatttccccttgaagggaaagttttgttgcacacttacttttgagatacttttgtgtttactctggggagatgactgcaagagcaaacgacagctttaggaaagaagcactggttcctggccacaagatgtttacagtcaataggaaacacaaaaagtgaatttgcaggtaaacacggcagatagaaagtatacgtgactcaatttttttttttttttgagacggagtctggctctgtcgcccaggctgtagtgcagtggcgtgatcccccagctcactgcaacctccgcctcccgggttcaagcgattctcctgcctcagtctcctgagtatctgggattacaggcgtgcgccacgacaactggctcatttttgtatttttagtagagacagggtttcaccctgttgatcggtctggtcttggactcctgacctcgtgatctgcccgcctcggcctcccaaagtgctgggattacaggtgtgagccaccgtgcccggccctcaaattttaaatccattgaaattgggcaacaaacccgtaccccagtcagaaggacataccatcaattatcttcaaagctggaatttttttcttaattaggagtgtgtctgatggaagtcacttctagctacataaagaaggtacagtgtgaggggtcggatgtaaaaactgatctatattacagctttcttctcccataattaaaaaatttaaacaaagtctttaaattctatatgtcaggcacttttctaggtgctgctgggaatagatagtaccagctcactgaagctaagcactggttccttttacattattgctggtttacacttcttgtaggaaggagaaggtaacaaatacattgatttattgaaaggtctttattactcttaggctgccagagcaagcaagatggaatatttaccatcttggtgaagtaattatactttagagttggcacatagtaggtatttaataagtagttcctgaataccgaaagcattgcagaaggcattgcagaaggcgaagagttggttgtgtggagatttctgttaatcactgtcttcacgagaagtccattgtgagaactggcagataaaaagctaactgtattcttattttgcattaagataagcatggcatccctagagtggaatgcagttcactctgttctgcattgaccttagagtgttatatttagttttaatgacccatttcattgaagatttattaataaaatatctgttgagagcatggtgaggggtctagagatattaatttaaggactagttagatggaaggacctagcgtatttatatgaagaatagtagggcattaatatataatattcatataataggattcatgaaaacttttttgaagtacttgaagggttgatatgttgggggagtaggtgagtgctttcacataccccgaaagaataaagaataattgcagagaagtgtggtgttaatgaaataacagatttaagaggaggaagcagaaagctgctagtagtaaggcgggaagttgaaactagaatgtggccagtagtagtttgtaggataccttgaaaagtctcaagagatcattttcttggggcaggaggaggaaggagttatgcttggaaaatgttcagcgattatagataacattcaggaacatcttggccttgagaagaagagatattaatccattatttttccctttatttaatagctgttgaatgactgttgtctgctaggcactgttgtagactctgggaatatggaaaacataatcgtttacttcctaccatcaagtggaaaagacaataaaatgttataaatttttaatgtctggtagtgttaagtgctttgaagaaaaataaagcaggataagaagataatgccaggggagccattttaaattagatggttaggaaagatctctctcagttaacacttgataaggaatctgaatcatatgaggggtatcagaaagggtcaagacaaagggaaaacttgaagtatgggaatagcaggggtgagtgaagaagagaggtaggaaatgaagttaaatacttggccagggactggaggccagatgattttataggtcttgctttttgggatgagaatgcattggaaggttttgaacagaatgatactaggttttacttaacagtgttaactctggtgttctgagactagattaaaagtgggcaaaggtaaaaagcaggcagactggttaggagtcttttccagtcatttaggcaagtgatgatggtggcttgaatcaagttgatagcagtgaaggtgctgaagtggttggaccccagagttattttaaaggcagtggcaaccatattttcttggcagtttggatgtaaggtttgagagagagagatcaaccaagatttttttgtcttatacaactcgaaggaagataaagaagcctctaggagaggcaggttttaggtggaagatcaggaatttatttttagatatattaagaaaaatctaaatggtcatgtcagatgaacagttaaatatgagaaaaaataatagtagacgtaaaataaaagcttattttattatccctacagtaaaataatgttgcctccagaccattttaacataaatatggtaacatggggataatgaatcttttggaggctagagtttcttagcatctaatagtagctttgctctcaacttttacggtatgttttgttgtttaattatcaaaaccacttttatcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaaggtaagagtgtttttaaagctattttttaaagtctttttaaaaaaaaaaaaaaaaagacagagcctctgttgcccaggctggagtacagtggtgtgatcatagctcagtgtcacctcaaactcctgggctcaagcaatcctgcctcggcctcccaaagtgctgggattacaggcatgaactgccatgcctgaccttaaagtcttaagtattgtatgtgttattttgcccatttttattggactctttcccatcctctcttcacggtagttgagacctcactttcttgtattgaatgtgatgttcctatagttactataattctctcatcagttaaaattagctaagtggggccgggcgcagcagctcatgcctgtaatcccagcactttgggagaccgaggtaggcggatcatttgaggtcaggagttcaagatcagcctggccaacatggcgaaaccctgtctctactaaaaataccaaaaattagctgggcgtggtggtgtgcgcctgtaatcccaactactcgggaggatgaggcagagaattacttgaacccgggaggtggagcttacattgagccaagatcgtgccactgcactccagcctgggtgacacagcaagactccgtctcaaaaaaaaaaaaatagctaattggtttattagaagggaattttaagtgttagaacattttcacatacattttttttacaagcattattttctccttttgtccatataattctggtttcttttagcttaaaaaaattttttttctattcttatttcccgaaatgaaaggttttagtatgtattgaatgaaaaaggattttatggtcaactaagtaagggaaagctggtttaaacaaagacaaaagtgtttctttattgtaggagttttcagattatgtaatatgcttatatacattttcagaagttagtagtatgcagtgttcccagactcatttgttgacaaaattatctttatggaaataggttttgaatgaaaaatgtttcggcaaacacactgagtagaattatagtagtagactgtatttcctattcttcaacctgccttctttgttaatatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaagctgttaccttcaacacatggcttataagctcaccataggcattgacattggcaagcagatgagtgaagacagagtatgaagaatcatatgggagattttactcactaggcctgatggtgttgtatgtcatttctgcccttatgacattggtcagtacccagttacatggctttgctaagatgcaaatgggttgggaagtatagtccctggctgagcagccacttagcacaacttatactgtggaggagaagtgtaaatcactggtgatcagttaaattgaccatctagctaaaggtataattctcctttgtttttgtgatgtgtagtctaagaatacccaaaacaaatttttgagagttgcccatgttaagaaacaataaaggatagtacttttttcctgttttcttatgcttatcatacattgatttgcacctctgtgactttgaaatgtgtgtcttaatttgatcagtgaattttttttttttttgagacagggtctcactctcatccaggctacagtgcagtggcatgattatagctcatcataacctttaactcctgtccccaggcaatactgccaacccggcctcccaaaggcataagccaccatgcccagcctacaattcagatttttaacttttttttttttttagcaaagtcccaagagtacttttttttttaaattttgttttaattgacaaataataattgtacatatttatggggtacatagtaatgtttcattacatataatgggattagatcagggtaattcgcatatccatcacctcaaatatttatttctttgggttagaaacattcaatattctccttctagctatttgaaattatataatatgttattgttaactgtagtcatcctatagtgctatagaacactggaactacttctatctagttgtacttttgtgtcttttaataaatctctccctatccctcttttcccctaccctttgcagcctctactgtcatctgttctgctttttacttgtataagatcaactttttttagcttccacatatgagagagagcatgtggtatctttttaacttaatgtcttccagttccatccatgttgctgtgaatgacaggacttcattcttttttatggctgaattgtattccattgtgtatatataccatattttctttatcagttaatctgttgttagacacttaggttgattccatatcttgactattgtgaatagtgctgcagtaaaatgtgagtgcagatttctcttcaatatactggtttcctttcctttagttaaatattcagtagtggcatcgctgaattgtgtgttagttcgatttatagttttttgaggaaccttcatactgttctccctagtggctgtactgttgacattcctaccaataatgtgtaagagttcccttttctcttcattcttgccagcatttgttatttatctttttgataataaccatcctaactggggtgaaccttgttgtggtcttcattttcctgatatgtgtgcatttccctgatgatttgtgattttgagcattttttcatatatttattgaccatttctatgtctttttttgagaaatgtctgttcagatcatttgccgattttaaaatcggattgattgttttttagctgttgagatgtttgagttccttctatattctgaatattcatcctctgccagatgagtagttgtatttcctcccattctgtaagttctcttttcactcttgattgtttcctttgctgtgcagaaaagttttccagtttgagataatcatatttatttttgcttttattgactgcacttttgaggtcttattcatgaaatcttttcccgacctattaaagaggttatccttttcctaatgagtggtcttgtcaaaagtcagttggctatagataacatggattatgttcttttgttctatgtgttctattgatctatgtgtttgttctcttggtcaatgggtctgtttttatgtcagttctgttggtctgtgggtccgtttttgtgccagtccatgcttattacagctttgtagtatattttgaggtcagtaagtgtgacaccttcagctttgttctttgctcagtattgctttgactgtctggggttgtatgtagttctgtacaaattttatggtttgtttttaaatttttatgaataattttattggtagtttgatagggattgaattgaatctgtaaattgctttgagtaattttgtcattttaacaatatttgttcttatataagcatgggatgtcattacatatgtatgctctttggtttctttcatcagtgtttttttttttttttgtagaggtttttcatcttcttggttaaactgcttcctagatatttaaaaaaatttttgtagctgtggttaatgggattgcattttttattttttattgtatgtgtatagaaacactacttatttttgtgtacttattttgtttctggcagctttattgaattcatttattggttctaagggttttggtagagtttttaggtttttgtttatataagattatgtcatctgcaaacagggacagtttgcttccttcccaatttggataccttttatttttttctcttgcataattgctctggctagtacttgcttaactgtcttttttttattttttatttttttgtcttgagacagggtcttgctctgtctcccaagctggagcgcagtggtgtgatcatggctcattgaagccttgaactcctgggctcaagcagtccttgcaactcagcctcccgtgtagctgggactgcaggcatgtgccactgcactcagcttcttattcttaatgtttatcaaaatgggggtctcactgtgttgcccaggctggtcctgaactcctgggctcaagcgatcctcctgccttggcctgccaaagtactgagattacaggcatgagccagtgtgcctggcctttaactgccttttttcccacttgaagatgctttgcctttatctcaaactgacctcattgactggctttctcttaactactgtttagggcaaaggtcagcaaacattttctttaatagatcagagagaataaatattgtagctttgtgggtcacataaggcctctgtctcatcttttttttacaatgtaaaaaccatttttcattcacagacctataacaacacagggattttgtccgttggtcacagttcatggacccttagcttgaggtgtcctcgttgtagtttgtcttccacatttagttacaactttgtatttcatggttttttttttttttttttttttttttgagacaaagtcttgctttgtcgtttaggctggagtacagtggggtgatcttggctcactgcagcctccacatcccaggttcaagtgattctcctgcctcggcctcccaagtagctggaattataggcacacaccaccacactcggctgatttttgtatttttagtagagacggagtttctccatgttggccaggctggtctcgaactcctgacctcaggtgatccgcccacctcagcctcccaaactgctgggattacaggtgtgagccaccgcacttggccaaaaagtttttgattgttttgatttgtgtccgttagattctgttagtagagtggagggatggcttaggtaaagttcctgccatcagagatactctgtttctgttgtaggattcagaaaagaaaaaaagaacaggaagttttcttcttttacatacatactttattttctttaaaaaatgtgtttatgaaaattgaacattaaacaagtatgttatgggaagtgggtctggctataaggagctaaaaacagttataaaattctcagttttgtcatctttgcccaaaataaatccaactaattagtgttaaagtaggtgcagcagagcatcccagaagtagtcttgtggcctccccaggacagaactcctccccacccaactgtttgtgaagacaccctgcagaggtccctgatgaactccttgtctctggctgcttttctgttcttgctttctttagagaatgtatttttcccttagccctttgaaagcttttgagacacacagttggtatgccaattatagcattctttatccctgagatctgggggatttcacggtcataaatacacactgttttgaatatataaatatttttctggggagagttgattgttttcatcttaatatcaaaatggtcagtgacctgaaagaatttactgtctatccattcattaaagcagttttgcaacagtagtgttttactctacctatgattaagatttgaactttgggaaacttttttatttcttggtaaaagatgtaaattttttggaatgaaaagatttcagtctaaaccaacaatttatgatattgctctctatgaatctcttactagtgactaataaatattaaggcacttaatggattcactttagctgtattttttcatgtggatatgtgtaaataccttgccataagagtaataagcaaaattgatttagtatatttttgaacaaatgcatttttgctagacctttaaagtttaaggtttctatgggagagtccaactatgttctacaatctacattttggatttttaatttttactagtttactgcttatacaaatctgaaaatttaaaaaattaaaaaacaaccttttttttttttaaattccagatggagatcttataacaatttttgatagttctgacctttcctttgcaattcagtgcagtaggatactgaaactgacattatttggtgagtagtaaactttctaatgaatttactattttattcattgtattttaaagatgtttggcttttttccttttaaagactcaggtaagcaataacttattcaaatattattacatttatttgtgttcaggtagttgttttagattacttgaagcttatggctgtgtatgtttttaagaaaatgatagaagtttaattcagtaagaacagagtgttaagtatgttttttttgaaatcaggtataacttaggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaatagggttcacactcctatgtgaatctaatgccactgctgaactgacaggaggcggagcccaccacttaacctcctgctgtgctgcccagcccggtttggttcctaacaggccacagagtagcactgggttggggacccttgctttagacagtatttcccgaggggtacttaaagattaaaaatagttctgataaaaaccaatagaagactaattttaatcttttagattttttcttttagatcttaatagatatgcaaggcagaactcttaagggacaagatagaaaagattacagagttaaatggtagtgtgattatgtgaaaaataaaatgtgtacactttttccggctgttttgttgttttgtttagcattaattttatttttttttaattttgttgcatgaaacttagagttcagtgtgaaatatgatcatggtctattgatttaatttgtatctatttcatctccatctaggaaggatgaatatgaataatcagaatttaaatgttaataacaaaaactgtttaaaattatttaaaataaaggtatctttttacagtattgaatgtaaaatacttaactattgactaggcataaagcagattagataatctgaagacccttactttaaacaggatctgctagataaacttacaaatgtgttttctgaattctgtaactcagcttgcacaggaaagtaagggaaatatccagggaacaaaaaagtagagggaactaaaggcctgatgtaccaaaagctgaaacttggggtgttcttggtggtgatagtagagattttagcctgcataatttaaggaattgccatctggtgtctacatggtgtaggcccttggtcctagtccctcagtaggccatgctttcaaaaagaatattttagaaaagtctaccttgatacagggaaagtcaaggaagcttaactcttataccttgggccgtcaggggcttgggaagtctcccttcaggattcataattgtggtccttaggtgagttgggtttaaatttaaactatccatgtagtttggtaactcccaagcccagatgttaccattttagaaaaatctcagaagaaaggccaaaatctctcttgaggggtatattctcaatccaggtcacataggtttctcacagacaaaaccgtaagacacatgaagctgtcaggtaagcaagaaccactggacacaactaatagcaggattagattttcaacaacttcagttaagatatgtgatagtctacaaaattaaaagttatttaagacatagaagaaggaataagaatataaaagcagccggccgtggtggctcacgcctgtaattccagcactttgggaggccaaggcgggcggattgcctgagtgcaggagttcgcgaccagcctgagcaacacggtaaaaccctatctctactgaaatgcaaaaaattagccagctgtagtggtgtgtgcctgtagtcccagctacttgagaggctgaggcaggagaattgcttgaacctgggaggtggaggttgcagtgagtcgagatcgcgccactgcactccagcctgggtgacagagtgagactccatctcagaaaaaacaaaacaaaacgagaacataagagcaagatgctattgtattatggaaaaacaataaacagattttataaagaacttaaagtaacttggaaatgagaaatataatcattgaaattaaatactaagtggataggttaaacacattagtcatagctaaaaagagaattagtgaactgaaaaggaaatccaaagaaattacagagtaaagcacaaaaacacaggcaaaagagaagttgaaaatgagaacatccagaatatttctattcagagtttcaagaaggagagaatgggagagtggaaatacattgaggtaatgactaaagaaattttcagagttatataaaagctatagaccctcagattcagaaggcacggggagccttgagcagggataagtaaaagtaaatccccactggacatattgtcatgaaactggaaaatgtcttaagacagagagattaccttaaaagtagccagagagaataagactgatcacatatgaaacaattagactgttagtagacttcttcatagtaataatagaggctaaaagacagtattatcacagttgcaaacagtaaagaaaaataactagaaaagtagcatcctatactccactaaatttcacgaatgaggagaagtaaaaatactttgaaagactgagaatttaccactcatggacccttgttaaaataatttttaacagtggtcttcatcaagaaggaaatttagtccagaaggtggtgaaagatgcaagaagcaatgtgagcagataaactgttgcttggtcagtaggctatgctttcaaaaactattttagaaaagcttttccattgatacagaaaaagtcaaggaagcttaactcttaaaccttgggctgtcaggggattgggaagcaccaatgaaatttatgtgtacgttttaatgagcattgattgttacaaaattaatagtcttagggaataaaaacaatttgggacaaaaatactgggcaataatatgtaagaaaggaagggatgataggaataaaaatattttaaggacttatttgggaggaacattgtaattacctttagatttttttaattgcatactacatatgcagaagtatgcatggtgtacatgtaagagttataattgaaaaattagacattgtcaggaaaggagaaaaaaagaaaacaagggtacctgttcagttcagtagaaagtggtggcggaataaaagaggtagaaagctcaatagatagaacagaatactaatcacagtacacagaaattgactacatatatcggttaaaataatctcttaatggaattttaaaaaaaatccagttccatgctacttccaagagacataaaagattattatgcaaagcttgaaagtaaagggctaggaaaagagactagacaaatgcaaagaaagctggttattaacagaatagacttatataaaaacttgagtagtaatagtcactttatgatgataaaaagaataattcactaggactatatagcaatctgaacacttatgcatgttagctttagatgttttcccctaagaaaaattgacagaacaaagagaaatcaataaatttacaattatgggagagccgataaatcaagcaggctcaaacagcgttggtcttgtacatctagcagttagggagaaatacagtttttttttttttcgagtactcatagtgcattatagaagttgactgtaagtcaagtcttccagaaaatcccaaaatgtaacagataattagatatcttaaaggtcatattctctggcttctttagagactattggacagaatatgtaacccaaatttccctacttttggagacaaaatatggttttaaataagtcaaagaagaaataataatgggaattataaataagtagataatgacttctatgtaaccaagtttttagagaatgctaaagctgtacttagagtagtacttacagccttaaatactttatattagtaaactggattggaaatttttgagcaaggtattcaaacagttacaaaaggacaaacctcaaataacttggaaggaaataataagagcagacgtgaactagaaattggaattgttaggatcaacaattttgaaaagatgcagttggcaaatctttatgaggattagttaaggagaaacaaggcacaaataagcaatgttagaaatgaagtttatagtagaaactttaaaaatttatatataccatgaattcctttatttaaatttgaaaactcaggtgacatggacagtatcctaggtaaatttaatgtactgtttcaagaagtagaaaaattggttgccccaattaacattaaagaaattgggccaactattttaccaaatatctaaggaacagatgattctaaattatacaaactattcaagagcataggcaaagagggaatatacactaattcattttgtggggttaatataacattaacatgaaaaccagccaaggaaaatgcaaaccagtgtcacgtatgaacatagatagaaaatattaagtaatatttacaaatcaaactcatcagtgaatatttaaacacaccagtgtcaaaattgctcacccaaggagtctaagattgctttaaattagaaaatcacatactattttccataaaacagattaaaggagaaaaactagatcatctctagataaagaaaagccattcatatctcaatcatgttgaaaagtcgtagcaaactatgaataaaagggaattcttttttgtgaggcagagtctctcactgttgcccaggctggagggcagtggtgcgatctcagctcactgcaagctccgcctccggggctcaccccattctcccatctcagcttcccgagtagctgggactacaggcacctgccaccacgcccggctaatttgtttttgtatttttagtagagacggggtttcaccgtgttagccaggatggtctcgatctcctgaccttgtgatctgcctgcctcggcctcccaaagtgcagggattacagatatgagccaccacgcctggccaaaagggaattcttttacctcatatgggggcatttattacgtagaacaactgctgtatgcctaatataaaaggattataaatgtaactaaaatacctattataattatatacaacaaaagatacttgggataaatctaacatggcaagattgttttggatgaaacataaaattttttaaaatcaagtaggggaatgggttttgaggaaaggtactctgggagatttaattatgtctatgctgtttcatttcttagtggttaggagcaaagatgaaaaaaatactaagatttggccaggtgcggtggctcacacctgtaatcccagcactttgggaggccgaagtgggcagatcacgaggtcaggagttcgagaccagcctggccaacatggcgaaactccgtctctaccaaaaatacaaaaaaaaaaaaaaaaaaaaaaattagctgggtgtagtggtgcgtgcctgtaatccagccacttgggaggctgagacatgagaattgctgaacctgggaggcagaggttgcagtgagccaagatcaggccactgcattacagtctgggtgacagagcaagactctgtctcaaaaaaaatataaatacatattaagctttaacaaagatgggtgtttagtaagtttatcttgttgtgtgcttgaaatggttcattaaagtcttatgattatattcacactaatgaagatacattattatgtgtgctagggttctccagagggatggaaccaataagatacatgggagttttttagggagaattgcaaggtgattacaaggcgaagtccggtgataggccatctgcaagctggggaaagagagaagctgatgctgatagtggctcagtggctcagtccaagtccaaaagcctgaaaaccagggaagctgatagtgcagcctttgtctgttgccaaaggcctgagagtcccctgggaagctgctggtacaagccctggagtccaaaggccaaaaaacctggagtctgatgtccaagggcaggaggagtggaagcaagcatctggcataggagggagagcgagctaaagacccagcaagcaaacttatcctaccttcttctgcctgttttgtgatagctgcactggcagctgattgggtggtgcccaccaacactgaagatgggtcttcctcttctggttcactgactcaaatgtcagtgtcctctggcaacaccctcacagacacacccagaaacagtactttaccagccatctaggcattcctcactctaatcaagctgacacctaatattaacttaattaatttaaacttagctaatttaaacttttaattgagtataatttggagcttagtgctcttaaacccactgagtagataataacagattataggccatactaggaatgtaaatgcaaggttcttaaaagttctggtaagatgtatcagtgtgctccaaagaccaccaggaacacacctgtagttgaatgaagttgggtttactgacttactgcagcaagggagaatgaataccacggagaacaataggatgtcttacaagtatgttagaaaagtatttttttttgggcttgggtttgtgttacctgattttggataaggttcaaggaagtagagctttgctctgcattggatgctctcaggaagtagagatgattctatgtttgggtatcttatcaaatcttatctagaaggtgagaggaatgaatcttactaaatcttatctggaaggtgagaggaatgaattgaggctaaagctgcagttggtaaagtagtagcagttactcatattagccaggataaaaggttgtttggtcatttttctggtgtggtcagtgttcttgtttttgtctggagttttgacatggttatggactgttgatctatcacagattatagtcttgtgtgatgttggtgttctttgaaatatttatattcaacgggagaacaccacagcctacctgtgagtgccaggccagcttccagcaacactaaggcctgtcttactgtaccagaccagtttctggctgctaggagctgtttttctcatcaaatattggagaaaaaacagtaataccaagtgaaaaccaataattgatgtaggtaggagattgtattgaacttcatagctatgcagggagtatgtgaattactgtgagttttcttctaaaagcttataattggtggtttgattttgaaacatgtttaacaaagaatcgccctgaacttttattttcacgtagatgtccttttctaattaggtgcttcaggagtttgtatgtatgtatactggcaatgtgcaaagcattttagtttaatttttgaacgcctgtcttggggtttgcaatcagagccttgtgtcactttctttttaaaaataacctgagtggtgacagtgtttgttgctgaatgaaggatttcatttttttcagtcaactgaaaatcatttggacaaaatgaataataagtgaagtaatgttgctttcattaaaaaatcacaactagagattaccgagtaatctctggcattttgtggcttatatactgtttctggaagtaactgctttgaaggacagtcatgatgtagataagttctgcatatatttttaaatttatatttattttttaaaattttttgagacaaggtctccctctgtcatccaggctggagtgcagtggagtgatctcagccaactggacttcccctcccgggatcaagcaatcctcccaccccagcctcctgagtagctgggactgcaggcatgtgctgccacacttggctaattttttaaggtttttgtagagatgaagtctcactgtattgctcaggtttttcttgaactcctgggctcaagcagttctccctccttggcttcccaaagtggtgggattacaggtgtgagccaccatgcctggccctgcatatatttttttaacgatttcttttaagatcagctattttagttagctgttttttttcaagacaaagttatgcaagagggataacagacctatcagtcatgttatatctttaaacatgtatagagtaaggtatttttgtattattttaagaatagcgtgaaataaaatgagctttttaagttatataatttttattaaatttaataatttctattaaatttaataaatatttaagaacagcatgaaataaagtgagcttttgaagttatgatttttattaaatttaatcatttctattaaaaagtagagctcggattttcctaccaaacctttttaccagtaaggtcataggctataggtatggcatcaagaaagactgataattctgctttttttccaaaataagttattagccatagagaattctttttttttaaaaaaaaagttactccattacattgatatcttgtttttgtttttttaaaggaattgtatttatttttccttgttgcatattattagtatacttattcatgaacttctaattttaagcaaataaatgtttttatttcagttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatggtaaaccctgaatccattgtattctgacttattgttcttacgtctttttggaggttttaaaaaactctttttaagtaggagaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatcacttagattagtaatgttcattaaaaatggtatgttgtaaatttgaaacacagtttttaataataattaaagaaaaactaattttttccccattgtataatgacatgtactgtttgtgttaagataaagcaaaatgtgtcaacatttggaactgacataattttgggaccgaatgtattttaaaatgtggactgacctttaagtatgtgttaatgacttgaaagtacagttaaaaaactgctttcttcttttaagattcttagatgttgcatttaaagaaaactcttattattatttttttctttttacaaattctttgtttgcttataattttcatagtttaaaactgtccatattgtgaaatagtaatttaaaaaaagtctagactggatgactgcatataaagggcttaacatgagataatttttgtggataaatggtatgtattctatttttggccactaaatattttggaagtttttgttttctatttttattttagttacagtttaaataaagatgtattttccatcatttctctcttcctgtcttctaatagtcatatggaattatgttaatgatagatgtttaataaatatttggtgattgattattcctagttgcacttctatttcagaacataatggagatttgctgaatactataatgagatcctcttggtcactttatgatgaaaccttttatatttcaggtcaaagaaggttgcctattctgagccctacctctccaaacaaaaatttccaattttagatcaagaatcaatgaaaaagttagacaatttttccagaagaattcatagatgctgacacaacatttgcatataatttcaggggatttaaccatctgcagaatattaagaagtgtagatgagaatttaaccagtatagccaatactgttcagaaattagctacagtggcccacattctactctaaggaatggatttatgagttttttgctttaggtgaaactttttcctcacctctttcttgctactgtttatactttattctttgtgtctatattttttatacatactgttagctttttacctatgttaatgtaaaaggtgttaaaattggtttcttctctgcattttggaaatcatgccatatgttgttttcttgtatggccattttctagttattgtgtcctgtctgacatatctgatgataagatgatataagaataatacaatctgcattatatttttagagatagttcttatttttttagaaaacaaaaacaacaagaaaaccatacatcagaaactgaaatctagtccacaaaatgaaattgccaatcagctatcagtgctatttagaacctgtggcttaccctcaccaagaaatgtggccacctgtggtcttcagctctctattacagcggttcttggatgcttgttttcctttaagaggcaaatgatgtgtaaactaccttagatagaagattgacctgttgcagtatctccagcagctaatggagcaagtagtaggacgtatagtatgtttcctgatggttttagtttgtgataagtgaaaagaggcataggtagtgagatgtgaggggaaacaacttgtaagactgacgtggtatgctcttgggattagaggaaggaagttggtagggaagatagataactggtagacatgttttaaaggaatacttctagtagtagttttctttttccaaacatttagaaaatattagggtagcctggaatggtatgttaggaatgaatgagctgccagccagtgtgtgctgtgggtacttatattcggtttagcacttaacatttttttcagaagatacattttgtattgattacaggggtgatctaagaactgatgttcatttacttgcttggtaacaaaagtgataatcattgtcccttaattgagtaaatggttagcaacagtctttttgtttacttgttcgtgttttttgtttgtttcttttgatgtcttttgtatcttggacttggattcctatttgtaaaatgtatgttaaaattcttgaactctttttctttcacaagacagtagtataaatgcctgtggaatatcttagtatcctgagaagaaaagcatgattttaaatttaacctgctcataatatttgacattttgtttttctgttgttgttttaaacattttattatagaaaagtttaagtatataagaaagtagacattataatgaatcccagaaacccacatccagtttcaacagttaccaacttatagtatcatataattacactatacacatttccgcccctcctgttacccagagtggagtacaatctcagctcactacaaactttgcctcctgggttcaagtgattctcgtgactcagcctcctgagtagctgggattacaggcatgcatcactgtgcctagctaatttttgtatttttggtagagattgggttttgccaggctggtctcgagctcctgacctcaagtgatctacccacctcggcctctcaaagtgctggaattacaggcatgagctgttgcacccggctcccctcctgtattattttgatgcagatcccatatacatcatttcatctgtaagcattttaataagtattttaataagtaatacatattaaaatagaaggtagcaaattcaaaaatgtttttaatgtgctatttatggaagattatgaattaattatggttggcttgatttccatgtaatttaatagtggaccagtagacagtagaaataaaatgtaaaatttgagattataaccttagttcagtttctttttataaaataaagccttagttcctataattattttttccagagtgcccagtgggtatctgatactaggatataggttattgggctccaaaaaaaccaaaaaaagtaaaatgtttctctttatcaaggagcttgtatttttttcatctaatgtttcttacaaaaggaggtaaataatttttttggaaagcttttgttcatcttctgtttctttttgccctcttctccctgttactagaaggaaaaatataaaaaaaataaaggaattaaaatgatctgtaatcctatattccgacatgcttaacattccagactatcattatacacctgcattatttcccttgtacttttaggccttactgaatatagataaaaaggaaacaagtttttgtttattcctctatttttacagatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcaggtaagttggtttccaactcctttacacccttcgtttccttcatctttccgttcttccctttccttctttctttaattgaagaataacttggatatggtgaagtgcacaaatcttaagggttctgcttaacaaatttttacatatgtgtacacttatgtaaaagactaactagattaagatgtagatgatttccagcacttcagaaagctttcttatgtcctctccccaagagtagcaccctcccccttaaagaataagcactgttgggttcaagtaaatttttgaaagtaaaatttagaaagtttttaaaaatctgaactattttataatttgattagttgcagtattcgaattatatttgatttgtcttatctcctcatcttagagaaattgaaaattaaatgtagattttcttgttaaattgcttgagtatacagtgggtttttatataaataagtttttaaccttaaagcagtacctatattgttttattctgtttaacttttggttataatttcttcattattttttcctgctttttctcttttcggattctaataacacatacattggagagcttgatactgtctcatgggtcattaaggttcatttttcttcagtcttctctctgttcttcaggttgggtgatttctgttgaactcttcaaggtcgctgtgatttctaatatgctgtggaacctttctagtgaattgtttaattgtgctttcagctctagaatttccattgggtttttatagtttctgtttttctgttgagattctttattttacattcattaagtctatattttcctttaattgtttgaatgtatttatgtttgattctttaaaaatatttagctgctttaaaatgtttatctgcaatatgtaacacttggacccatttggagtcagtttctattgactgggttcctctcccccacacacactccccccaactccagtagggtcacatttttctgtttctttgcctgtctgatagtgtttggttgaaaactagacattctggttaatatgttgtagtgacttggacttatattcttttgaggattttctgttattgttgatctagcagggagttgatttgtatggacttaacataaataacaaacagaaaagcgctctctaaaagaaaaaggtatttgggaatagagcattgcattgaaaatatgcatgccatagtaaactatgtgcatattcagtgaggtaaaggcagacaaaggtttttaaaggaaaaaatgaggagaatatataattgttttgaaataattattgttggctacaaagatcattagcaagagtgatgccagtctgaggttggacaggcagtttctgggcagatgtcctcacagtcacagaagtttttttttttgcttttttttttgcaaagttgtgatggcctttgtgtaggcttgtggtttttgaactcttttgtgatagtttttgcaagaatcctctcttcatggccttatcagagtttttaatttttttttaacattaatgacttcattttggttttgataactttcacatactcaaaactgctccttctttctccctatggtgtatagcagctgatatgtatgctcagtcctttcagcttgctctaggtgctgcatttttctctgagccttcttgagatatcctcgtctgctctcccagccctatagtcagctggggatttggacagagtgtatatacctagatcgtgggtcttaccctttcagtagcaccttcacttccgggattttcctcctaaatcttcagctgcttgtctagccataaggttgttaacactgtggttttctgccattggagctgcagaggtcagcgcttttaattcttatccattctaattttattggggtaaactcctctggtttctgattgactttcagttatttcaaatagtttcttttgttttgttcatgtttttagttgttacctgggagagagtttatctgatggatttactttgcctttatcagtagttggaaatgtgtacagtccattttgtatttcttagagactttcatggaattactcacaaaagagaattgtgtgaaaatttgatgaggtcagacttttaaattttgatttaaatgtagtatattccagactagaataatattaatatgattcacattatttgaagaccatttttctcacagctttgtatgttgaattatagtaggaaaaactgtatgcatagctaggatacttttgtagttcttcaggtgtgatgtggtaaaaatgtggcttattagaataatgaatgtggcagtgggaaggagggataaaatattacaaacatggaatgaatattaactgtaataaattacatataagggaggaaagaggagccaaagtaataaatatatatatttaggctaataacagtgtcttttgtgggaagaatgtgtgtatttatctacatagatataaatttaagtaaaatggtggtagatagaaaccatcatccattttattttggcaatcatcagtctctcttgcattaccactattatatcctagtttaggttcttattaatacttggactgtcagctgtcaactgtgcctaatactgtggtaagttctggggatacatcagagcagaagatagaggtttgcccttagagaaattagtctgctgataatagcaagtacttatatggaactttctgagtagtagtcacttttataagcttttgctgtataattccttttataagcccatgctataagctcttgtaaactcataatcctcacaataaccttatcaagtaggaattagtatatcctttgtacagatgaggaaactgaggcacagaaagagattatgtaacatgtccagagttacacagctagtgagtgacagcactaggatttgaacctgggtagtctagctccaaaacctatgcttttaaccactcttctgcattgccaaagcagaaagaatttaaaggaataagacatatttacattgtcctcagaatatcttttttgactgtcacagcattggaactgtaatatattctctccattcatttctgtgttcattattttgtaagaattatagtggctccatatgtaagttagagtgctaggccttgttcggcagacaaaaagaatcaacagtcaggagcccggccaaaagagtgcagagtctttaagagggaaagtgagagctattcagaaatgcaaagtagaagtcagtatgagttaacaaaagtaaactagatagaagttcactagtagaaaaagtattcatgagtcaagaaggcttactagaagtgtggaattataattggattttaaataatgttatatttaaatatgtgaatgttatatttaaatatatgggatctagtgggagagaaatagaggtcaaaaaaatattagctatgttatgggagtagggagaaggttagtttagctgaaagggaggcatgtgagaagagaaattgtgagaaataatgtttggacccttaatgccaaactaggaggttgaacttaatttatggtcagtgaagaccccttgaagaatgaagtgacaattttggttcctgtgcagaatacattgcttggagtagggggatattggcattgcagacatgagttttgatttttgcagggagaggttaagactcaggaatatagtactctacactttataaggaaggagttccagttgtagctttggattaagagattggagcaaaggaaaaaataaagtacatacatttaatgtaaaaaggcgtatttgtggttatatacttattctatagtacttttagtatcttttaaccaaacttattccttgagcttgctgggggaaggccttgtgttggatactaaactgacttttttttgactatccagggccacccagtgctcctgcagaagatcgttcaggaacacccgacagcattgcttcctcctcctcagcagctcacccaccaggcgttcagccacagcagccaccatatacaggagctcagactcaagcaggtcagattgaaggtaaaatagagtttagaacacatgtttgggaaagtacatgtgtagaagtgtttattacagcattgttgtaaacacttcatgtatttagtcatgccttaaacacaggaaaaattttgatttactgacatgatttgatgttaaaaaaccaaatagaacaatatgtcaggtatgtttccaattattggaatgaaaaaaatacctcaaaaaagtgtttctatgaatatagatacagagtgaaagaccagtcattagtcagtggtgacccttggaggggaggatagtgaagttcagactggtgatttcacactttattttgtgttatagatgctattttatctccctcctttcttcaacatctgtgcatgatttttctaatttaaaaaagatttctgaatagaggtaaaggataactttagttgtagtgggttttttttgttaagattagtagccttttataattttgtaaatttagcaatatgtctttaatggaaaaaaagcagtgtattttaagtcagactttttcttctgaaataatctgtccttggatatgcagtttagtctctctgggttttgatattctttcactgtaaaatgtgaaaactggactgaacccagtggtttcaaaagaatgtctttagttctgaatgaaatataacctgaaagctccatatttaaaataggggattgaagggcaacagacttcacacagcaggcactaaggtgcctcattgaaaaccttggagttctgcagaatgtgactaagtacttaactaatctctagggtgccttccagataatgaagtgtgatttttgtattgtctatgtgtgttgggacctttaaagccgcattccacttcaaaacaaacaccaggtggtgctctaactatttgtttaacgggtcagatagtggtataatgtatttccagccccagaagcaagtgattaaggttatcaattacattaaaacaaaaacaaaacataggctaaaatgaactgaccacttttggaatagaatcctatcatcctgtggtgatactttcagagttacctggctaggtgtggtgcctcacgcctataatcccagcactttgggaggccgagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactccagcctgggcaacagaacgagaccctgtctcaaaaacaaacaaagccaaaaaaaaaaaaatccacagagttgtctgttggatgaacaccagtcattatggactagcaggtgacattttgctgatgaatcagtggtttgcgaagaatttcttattgcttaagccttttctcaaccaactttaattaactcctcctctgcaccaaaatgctactgccaaaactagaacaaactagaactaaagcagatgtcagctgaaatggacaaaagcagagtataggtatgatgagagtttaatgcctacatcaagcgaactaaagatttgtttttaaataaatcccattttaagcagtgtatactgtgatacaatgacagttggaaggatcattgtaccaaataatgtttgctgtttatgtataaataaatgggaattaaggcgctactagcaatatctaaacattctatgaagtgtttaattgagcattttcaaataagtaaaattttaaaaatgcgaaaggacatacagtgaaaattctctctcccacctctgtccacagcaaccaaattccttttttcagaggtagcagattaacactgtttatatgcatttaatttttagagtagtattgtatgccttgctgcaattaactgttagcttacattaaaacatacagtatgaaaattgtacaattaatatgtgacatcatttaaactattaataactgatctaattctagatcagtgctgtccaaaagaattacgatagaagccacatgtagtttttctatttagcagcattagaaaaatgtttaagaaaaggtaaaattaattttatttagcctaatgtatccaacgtgtactcactattaaaaagttaatttttttggtactgtgtattggaagtctgggatttgacactgatttggaacacttcaaacaacaaacaacatatcacatttcaaacaagccacatttcaggtgctcaatagccacatgtagctagtgattattttaagagcacagctttagataaatatagtcgttatttatagattcccagcatgaattataggctacttttactttttgttgtataatgagtctttgacattgtcagttatttagatcaactactggttataatttgagcagaattaccaacataaaatgtattacttataatttgttaacatagcaatctcttacaatgtgttaatagtccatactaaaattaagaattctgagttgttacttaactcccataaaagggactttggaactgtgaattttattccaaataaatgtagtcttaatatgtttttcagttaaaaggatcaacaagatattgagcatcattaaaaaaaaaccaaaagggataatgttactctttttcatataaagccagtgcctgttacaggaagactatgtgatgttgccagaaatgtaactggtaaggagaagaacgctaaaaatcatcagagatcgggagatattgctgtttgacagcctaaaaaaatgaaaaagcatataattaaaatctttaaaatcatatgccaatataatgaaaagctgagtagcctttattatgtaaatattgaaacatacatagaataatcaactcttcatgtagtcatgtggcttcaacacttaccaatattttggcattcttttttcatcattttttccccactgcaccccttttaatttgctggagtagtttaaatcaaattatgaacagcttattatactcaggtatttcagtatatatgtccaactgataatcttctttttaatataaccaccatgctgttacttaacagtgattctttttatttttaattgtgacagggtgtcactctgttgcccaggttggagtgtactggcttgattacagctcacctgcaacctcaacagtgattcttaatgtcaacgtgtgctagtctgtgtttgaatttccctaattgtttcaagattcgtttgttaaattgacttgttcaaatgaggggcctaacaaggttcacactttgcattgttaatgtgtcttgagtcgttttttctaatagccattagaaaaaacttacatgtttctaaaatcccttacatgtttctaaaatcaaaactatgtgtattatttattactgtgtaactattatcccaaaacatagatacttagacaacaaaagttaattatctcatacagttttagacagatatcccggaatggtttagctgggtgattttggctcagcatctctcatgaggttgcagttaaaaatggctgctggggttatagtcatctgaagcttaaccagagctggaggattcagttctttaccatttggacttctccatggggctgcttgggtgacctcatgacatgacagcttcaccagaatgagtaatcagaagagagtgaggtagaagataaccttttatagcctgtcctcagaaatgtcactgtcatttctgcaatattttcttggtatacaggtcagccctattcagtatgtgagggactaacagggagcagatactcatgtgcttgttgcttatttggtcatttttgtattgtggagttaaatctttctaatttctaagaatataaacgataccaacccattgtcataaatgctatacatgtgcagaagccgttgagggtcatgatagaggttggctactctgtgtaataaataattcccagaagtcttaccattactctttgcttcatcctgttctcttttccccttaattttttttattactttttactttattctgtcattgattctttttgaaaatatacataaaacatagcttatatatagtcatgcactgtataacatttcagtcaacagtggactgcatatatgatggtggtctcataagattataatggaggtgaaaaatttctattgcctagtgatgtgtagccatcataatgtagcacaaggcattacttacgtgtttgtggtgattctggtgtaaacagacttactgccagtcatataaaagtgtagctcacataattatgggtagtacctaatacttgataatgatgataggtgactctcttactcatttgtgaatttactatactatatttttaaatcattagagtgtactcctacttatttaaaaaaaaacaaagctgtagaaccaggctcagataggtccttcagaaggtattccggaagaaggcattgttatcataggagatgagagctccatggatgttcttgaccctgaagaccttccagtgggacaggatatggaggtggaaaatagtgatatcaatgatcctgatgctgtataggcctaggctaatgtgtatgtttgtgtcataatttttttctaaatgtttaaaaaagtaaaaatttaaaattaaaagaatagaaaaatgcttatagaataaggatataaagaataaatatttttgtatagtagcacaatgtactttaagctaaagtattaaaaaagttaaaaaatcaagtttataaagtaaaaacattacagtaagctaaggttaatttattgaagaaatggaattttaaaaaataaatgtagtatagcctaagtgtatagcgtttgtaaacctttagtagtgcacagtaatgtccttggccttcacattcactcaacacaagtacctcacttggagcagcttttaatcctacaagctccagtcatggtaagtgccctaggcaggcataccattttttatcttttttgccatattttcactgtaccttttttatgttttgatatgtttagatacacaaataattaccatgtgttagaattgcctaagtattcagtacaggaacatgctctacaggtttgtagactgctatgtaccatatagcctagctatgtagtaggctatatacatctaggtttgtgtaagtatactatatgattatacagtgacacaattttcagaacctactcttgtcattaagcaatgcatgaccatattttttattactcaaaacattgcttactataaacaatgtctgcattttgctctcttcatatatcctatagatctctcaagtatgtgaagaagttcatcctttttctttttttaaacaattaaacagacttcttaattaattttcagaatactgtgacagtcccatttggacttgaatgaggtgggtttaaagtaagtaccgtaaatcctcacttaacattgttgataggttcttggaaattgtaactttaagtgagatgacgtatgaggaaatcagttctaccataggctaattgatatgagtaagttgagttcctacagcatatctctgatcacaaaaatacccccagacttctagataaagactaaaaacaaatgtgagttatagatacatttaagaaagattaataaaaacaaataagataatgatttatgcagttattccaattcagggttgtgggtggctgaaatctatcccatcagctcagtagcaaagtggggaccaaccctgacaggttgctattccattgcagggtgcattgcaaccacacacacacccatagtcgttcagactgagatcatttagacatgctaagtaacctaacatacacatctttgggatgtgggaggaaattgaagtgcccagagaaaacccacacagacttggggagaatgtgcagactctacacagaacagtaaccccaactgggaataatttttttttccttctcagtgttttaacgaaacaatgtcgaacaaaagatgttatttgaggatctgctgtgtaaaaggaatcttgtgtagagatataataaacctctgaaatttttaactctagggatgtttttcaaaatcaatttatagcagtttatgaaaacatgcaaaaaaaaaaagctttatgaagagttgtaccctataaatttttattgaggggaataactgtggttttgaccaggagttccttactcattgatgaccacagtctactactacgtggaaccttaatctcagccttttttgatgatgcccaagttaatatttatattgttttgttcatgggataatatatgcaaaatgactttataaactaaagctttggagttatgcctgagttccagtgatggttcttagctcttcatggttctgttcttagctattgactgcaggtaagttgcttaatttttctgtatctgagataaggaatactaatatggttgaatttttttaaatgtgtttattgcctgtttgcttatttttttattgtggagttaagccttctaattttcaagaattaagagttcattgttatgtgctatacgtatttattccccttgattatatttctgtacctacttacctttttattttagattctggtcacttctattccgaaagttagttatgaagtacaatccaggattaaggtggcatctaaatttggttaatttctgtgctaccttttatgctattagtctaaatcattaagaaagcatttaagaaacttttgtaagcgtttctttttttttcttgtcatatttgggaataggataaatagcttaaaatagttgagctgatttttatttgtattctttttttattataaagaaacatttgctaggaaataagctggatataaacatagttgtatctcctttagtgctacccagcactaaaaacttagacacgtatagggctgagcagctggtataatagagtgggctccgtctcattttctaagcctgtgagtcctagctgcctactgcagctcgatttgagtgggagttgatataatgtctttttttttttctcacttcagcagtaagtatctggtttgctcatagtcttttgattaataggtagtttgaatatttttcaaagaatcagccaacatgtgattattttaaagatttaaataccagatagatattaaaatgcaaggttattgctactagatattacatctagctaaatcaaccattgtgaaataattgagaagtagagataataaagacataaaccaataaatctttgcttgaaaatcacaggtatgggaacagattgtgaggacagaaaaataaaaagtaaaaagaaaaatcataggtaataagtgtctaaagggtttcttcataggaacagtggttgttgaccccaaataggacaaataggactcccatgttcaagaacacatcaccgttgttaaaaaggtctgccattattaaatagtgcaatgaagaaccatttagactttattagagtccacgttattggcaaaagatgttggatattcatagaaaatcaaacttgacaaattccaaaagtgtctttcagctctggaacaaaagatgtcatatagttccttgctaccaaagagtttgttcatatggtaatagaggcccatacctttagagggcaaatacagtgctttaggaaggacttagatgatataaatggtatttgtcccttttctcatttttatttactgattttcaactcacttggcttttaatgaacattagcgttacttatctgttggcagctgggttggaaaacatttgtttttctagactttatgaaatggtagccactggtgttgcacttaatgtttattgccagttagttctctgcagttaatccacagcagaggaatcacacttctaaaatggttcattctcttcttcatagacatttaaagttgaacaaatactttcttgtatattgttactctgtttggatggagagggaatgtatatgtatcttaaaaatatttctctttgccacattaaacatgccttttttccttgtgtgtgtgtgtgtgtgttttcaggtcagatgtaccaacagtaccagcaacaggccggctatggtgcacagcagccgcaggctccacctcagcagcctcaacagtatggtattcagtattcaggtgagcaggtgttgaaagggagttggctcatggttttttgtttctatactcattaaactttaagttcttaattccttgatttgtagtacattgatataataggtattaagtttttattaggggaaacaacatttgttttatttatttttaaatattttacattaatattgtaaatcaacatttcagttttctggtggggagataaaacttacagtagatgattctgcagtaacttgtagtataaaaagtttttaatacaaagctgtcttactaacattatcagtttatctcttaggcgacttagtgcaagttttcccccttccctccacctctccatttatatgtaacacgtaattccagtgtactcttagtacctgtagaaatatgaacagtttactatacatggaaaggtgatgttatttaaataagagctcaattaagctacttagattttaaaatctcttgcaagtatgtaggaataccagaaataggccataaaaataaaatcgtataaaatgtaattcaggcaactaagaacattgtttagttgttttaaataagcatcctgagtattttgtttctattttaccatctgtccactgaagattatatgtatttaagtatgataaatattattaatgtaactttggctataattccagtattttttacagttatgtcagagagtttgtgtccaactcttgttttacagccaaagattgaagtatcagaatttcaactgtaattagaaataatttatgcaggttgaatctagtctaaattctattttatagagttttgtggtatcagctagagcaggagtcagtaaagtatagcccacaggccaaatctggactattgcctgtttttttgaataaagttttattggaacacacttctacttttatattctctactgctacttgggcactagaatggcagagttgagtagttgcaacagaagaccatgtggcccacaaagcctaaactatttactatctggctctttacagaaaagtttgctgactcctgacctagaccataacattctgtcattaattaaaatttgaaatattttgacacaattttatttagattgtatttgctgtagagtgacttaacttgtagctacttgtttttaattgtataaaatacatagaacttaagtttggattatatcaggaggaaggttatttttaggatgcagttcttttaaaaaaatcagtgttacaaactatgttatttatagaaagaatagcagagctgaagagatttagtcatcatttaatctcgggatttcggtcctcactatgctttagaatcacctgggggaggctatgtgtggggccccattcccagagattttgaatttcatttgattgggtgtgggactcaggcgtttgcattttataaatgaggcaactagttttgaaagagattgtgacttgtcaaagcacatacagccattcagtggagggagctggatcagttcagtatttccctgtatcattctgcattctacaacctagactggagttggcagacttactccataaaaggctagatgtcctatgtattaaaaaaaaaactcacataatttccatatttccatttttttgctatttctgatgtccttcacctaaagttatttattattttggagggacggaagggagactatatatatacacacacacacatgatagaagcattgccacattatgttcaagagactggtgggctgctaatgaaatcttcagcctgtagggttattccctcccctaagcaataattaaggatcagattacttccaggcccagttaaaaaaaaacaattcagatttcaggtgccaggatgaaaaggcacttttcttttttctcgcagtgttaaaatgaataggcattttcagtataaagctgaatccatctatttcttcaaaaccttatagtgaaaatttaagttttatgtagaggataggagaacttgtatgacattcagaattttttatgagttggtttcaggtcagtatttagatgctaccatgagttaatgcgttaaagatacttgatttacttattaagaactaagcttgctcttaataaatttagtcagggtcttcactctgagtaaaatttagtcttttcaaattattatctttgtatttctgatcctactagtctattaacttgaatttgattgagagatatggaaatagtcaactaaatactctgcttggagactaagaggtggtggtggtaacattggaccatctttgacactgttggtttgccagtttccctctgaccttttccagttttgttcatggactatgtcataaaggtttctttcatgagtaaattttgaacccaggttcaaggtgagttcagaatatactcaaattcattcaatcctttttttttttaatgcagggttgtacatattttaataattttcttatgtatctggtatttaatgctgacaggattccagtcaatggagaggtttcattgcaagtagctgcaggtgtgtttcatggtagagataaaagttttcagtgaagcagactttcgttgtaaaaaaaattacatcctagtaaataatgaatatagatgttgctttttatggggcaatatggtatgctttttatgtgttatgctgtactgctaagtaaaaattttgagttgtaaaggcaaaaaacatcagataccaaatctaaaaggaatgattttaaagattgtgaaaatggtactttttatttatttgcaaaatttaaagcacctgattagtacaataagatgtatttatagtattatttcatataaaaatgttcattctccgcaatgtgtttttatttgatactgttaagtaggtctcccctgaaaacctggttaatgactatttagctttcccatttttggtcttcctagaaagtataattctttcatttatcatttgagcatctgttctaggaattatgctatgtcaggaatttgctctcagggattatgtcttagagagtttaaaaaattgtagagaatgcctctttgataactacttggtcttgaaatattatgtgatggaatctaccactctgcttgttacatacatatttattaaatttctcaccatttttggtccacctaacagtaagactaattctttggaaaagtagttttactaaaagataagatacatgttatttattttgccttttcagcaagctatagtcagcagactggacctcaacaacctcagcagttccagggatatggccagcaaccaacttcccaggcaccagctcctgccttttctggtcagcctcaacaactgcctgctcagccgccacagcagtaccaggcgagcaattatcctgcacaaacttacactgcccaaacttctcagcctactaattatactgtggctcctgcctctcaacctggaatggctccaagccaacctggggcctatcaaccaagaccaggttttacttcacttcctggaagtaccatgacccctcctccaagtgggcctaatccttatgcgcgtaaccgtcctccctttggtcagggctatacccaacctggacctggttatcgataaggaggctcctctacaccaattaatgtagctgctagctattggcctcccaaaagactccagtactattttaatttgtattgaagaagttcagaaatttaaaagcagagcattttttatgatatcattgttggtgttaattgaaagtataatttgctggaacacaaagaccaaaatgaaagttttttcctccctgcttaaaaatgtagcagcttcttagttactttggaacactactcttacatgtataaagtgattgacttgactttctagcttcccttgtccggaggatattaaaatgctagggtgaggtttagccatcttacttggctttttactattaacatgatgtactaaagtagagccctttgagaatacaagatattatgtataaaatgtaacactgatgataggttaataaagatgattgaatccatt
